United States Patent
Shiffman

(10) Patent No.: US 10,563,263 B2
(45) Date of Patent: Feb. 18, 2020

(54) GENETIC POLYMORPHISMS ASSOCIATED WITH STATIN RESPONSE AND CARDIOVASCULAR DISEASES, METHODS OF DETECTION AND USES THEREOF

(71) Applicant: CELERA CORPORATION, San Clemente, CA (US)

(72) Inventor: Dov Shiffman, Palo Alto, CA (US)

(73) Assignee: Celera Corporation, San Juan Capistrano, CA (US)

(*) Notice: Subject to any disclaimer, the term of this patent is extended or adjusted under 35 U.S.C. 154(b) by 0 days.

(21) Appl. No.: 15/952,792

(22) Filed: Apr. 13, 2018

(65) Prior Publication Data

US 2019/0032136 A1   Jan. 31, 2019

Related U.S. Application Data

(63) Continuation of application No. 14/834,946, filed on Aug. 25, 2015, now abandoned, which is a continuation of application No. 13/833,905, filed on Mar. 15, 2013, now abandoned, which is a continuation of application No. 13/085,955, filed on Apr. 13, 2011, now abandoned.

(60) Provisional application No. 61/325,689, filed on Apr. 19, 2010, provisional application No. 61/332,509, filed on May 7, 2010, provisional application No. 61/405,972, filed on Oct. 22, 2010.

(51) Int. Cl.

| C07H 21/04 | (2006.01) |
| C12Q 1/68 | (2018.01) |
| A61K 31/00 | (2006.01) |
| C12Q 1/6883 | (2018.01) |
| A61K 31/22 | (2006.01) |
| A61K 31/366 | (2006.01) |
| A61K 31/397 | (2006.01) |
| A61K 31/40 | (2006.01) |
| A61K 31/405 | (2006.01) |
| A61K 31/455 | (2006.01) |
| A61K 31/505 | (2006.01) |
| G16B 20/00 | (2019.01) |
| G16B 25/00 | (2019.01) |

(52) U.S. Cl.
CPC ............ *C12Q 1/6883* (2013.01); *A61K 31/22* (2013.01); *A61K 31/366* (2013.01); *A61K 31/397* (2013.01); *A61K 31/40* (2013.01); *A61K 31/405* (2013.01); *A61K 31/455* (2013.01); *A61K 31/505* (2013.01); *C12Q 2600/106* (2013.01); *C12Q 2600/156* (2013.01); *C12Q 2600/172* (2013.01); *G16B 20/00* (2019.02); *G16B 25/00* (2019.02)

(58) Field of Classification Search
None
See application file for complete search history.

(56) References Cited

PUBLICATIONS

BGI (dbSNP ss104538553, rs13279522, Sep. 10, 2008)—. (Year: 2008).*
Shiffman et al. (PLoS ONE, vol. 7, No. 5, pp. e38240, May 2012)—(Year: 2012).*
Wilke et al. (Nature, vol. 92, No. 1, pp. 112-117, May 23, 2012)—(Year: 2012).*
Keskitalo et al. (Br. J. of Clinical Pharmacology, vol. 68,No. 2, pp. 207-213, 2009) (Year: 2009).*

* cited by examiner

*Primary Examiner* — Jeanine A Goldberg
(74) *Attorney, Agent, or Firm* — Celera Corporation

(57) ABSTRACT

The present invention provides compositions and methods based on genetic polymorphisms that are associated with response to statin treatment, particularly for reducing the risk of cardiovascular disease, especially coronary heart disease (such as myocardial infarction) and stroke. For example, the present invention relates to nucleic acid molecules containing the polymorphisms, variant proteins encoded by these nucleic acid molecules, reagents and kits for detecting the polymorphic nucleic acid molecules and variant proteins, and methods of using the nucleic acid molecules and proteins as well as methods of using reagents and kits for their detection.

4 Claims, No Drawings

Specification includes a Sequence Listing.

GENETIC POLYMORPHISMS ASSOCIATED WITH STATIN RESPONSE AND CARDIOVASCULAR DISEASES, METHODS OF DETECTION AND USES THEREOF

CROSS-REFERENCE TO RELATED APPLICATIONS

This application is a continuation application of U.S. non-provisional application Ser. No. 14/834,946, filed Aug. 25, 2015, which is a continuation application of U.S. non-provisional application Ser. No. 13/833,905, filed Mar. 15, 2013, which is a continuation application of U.S. non-provisional application Ser. No. 13/085,955, filed Apr. 13, 2011, which claims the benefit of U.S. provisional application Ser. No. 61/325,689 filed Apr. 19, 2010, U.S. provisional application Ser. No. 61/332,509 filed May 7, 2010, and U.S. provisional application Ser. No. 61/405,972 filed Oct. 22, 2010, the contents of each of which are hereby incorporated by reference in their entirety into this application.

FIELD OF THE INVENTION

The present invention is in the field of drug response and disease risk, particularly genetic polymorphisms that are associated with response to statins, especially for the prevention or treatment of cardiovascular diseases (CVD) such as coronary heart disease (CHD) (which includes coronary events such as myocardial infarction (MI)) and cerebrovascular events (such as stroke). In particular, the present invention relates to specific single nucleotide polymorphisms (SNPs) in the human genome, and their association with variability in responsiveness to statin treatment (including preventive treatment) in reducing CVD risk between different individuals. These SNPs are also useful for assessing an individual's risk for developing CVD. The SNPs disclosed herein can be used, for example, as targets for diagnostic reagents and for the development of therapeutic agents. In particular, the SNPs of the present invention are useful for such uses as predicting an individual's response to therapeutic agents such as evaluating the likelihood of an individual differentially responding positively to statins, particularly for the treatment or prevention of CVD (particularly CHD such as MI, as well as stroke), identifying an individual who has an increased or decreased risk of developing CVD (particularly CHD such as MI, as well as stroke), for early detection of the disease, for providing clinically important information for the prevention and/or treatment of CVD, for predicting recurrence of CVD, and for screening and selecting therapeutic agents. Methods, assays, kits, and reagents for detecting the presence of these polymorphisms and their encoded products are provided.

BACKGROUND OF THE INVENTION

The present invention relates to SNPs that are associated with variability between individuals in their response to statins, particularly for the prevention or treatment of cardiovascular disease (CVD), which includes coronary heart disease (CHD) (which further includes myocardial infarction (MI) and other coronary events) and cerebrovascular events such as stroke and transient ischemic attack (TIA). These SNPs are also useful for determining an individual's risk for developing CVD, particularly CHD (including coronary events such as MI) as well as cerebrovascular events (such as stroke and TIA).

HMG-CoA Reductase Inhibitors (Statins)

HMG-CoA reductase inhibitors (statins) are used for the treatment and prevention of CVD, particularly CHD (including coronary events such as MI) and cerebrovascular events (such as stroke). Reduction of MI, stroke, and other coronary and cerebrovascular events and total mortality by treatment with HMG-CoA reductase inhibitors has been demonstrated in a number of randomized, double-blinded, placebo-controlled prospective trials (D. D. Waters, *Clin Cardiol* 24(8 Suppl):III3-7 (2001); B. K. Singh and J. L. Mehta, *Curr Opin Cardiol* 17(5):503-11 (2002)). These drugs are thought to typically have their primary effect through the inhibition of hepatic cholesterol synthesis, thereby upregulating LDL receptors in the liver. The resultant increase in LDL catabolism results in decreased circulating LDL, a major risk factor for cardiovascular disease.

Examples of statins include, but are not limited to, atorvastatin (Lipitor®), rosuvastatin (Crestor®), pravastatin (Pravachol®), simvastatin (Zocor®), fluvastatin (Lescol®), and lovastatin (Mevacor®), as well as combination therapies that include a statin such as simvastatin+ezetimibe (Vytorin®), lovastatin+niacin (Advicor®), atorvastatin+amlodipine besylate (Caduet®), and simvastatin+niacin (Simcor®).

Statins can be divided into two types according to their physicochemical and pharmacokinetic properties. Statins such as atorvastatin, simvastatin, lovastatin, and cerivastatin are lipophilic in nature and, as such, diffuse across membranes and thus are highly cell permeable. Hydrophilic statins such as pravastatin are more polar, such that they require specific cell surface transporters for cellular uptake. K. Ziegler and W. Stunkel, *Biochim Biophys Acta* 1139(3): 203-9 (1992); M. Yamazaki et al., *Am J Physiol* 264(1 Pt 1):G36-44 (1993); T. Komai et al., *Biochem Pharmacol* 43(4):667-70 (1992). The latter statins utilizes a transporter, OATP2, whose tissue distribution is confined to the liver and, therefore, they are relatively hepato-specific inhibitors. B. Hsiang et al., *J Biol Chem* 274(52):37161-37168 (1999). The former statins, not requiring specific transport mechanisms, are available to all cells and they can directly impact a much broader spectrum of cells and tissues. These differences in properties may influence the spectrum of activities that each statin possesses. Pravastatin, for instance, has a low myopathic potential in animal models and myocyte cultures compared to lipophilic statins. B. A. Masters et al., *Toxicol Appl Pharmacol* 131(1): 163-174 (1995); K. Nakahara et al., *Toxicol Appl Pharmacol* 152(1):99-106 (1998); J. C. Reijneveld et al., *Pediatr Res* 39(6):1028-1035 (1996). Statins are reviewed in Vaughan et al., "Update on Statins: 2003", Circulation 2004; 110; 886-892.

Evidence from gene association studies is accumulating to indicate that responses to drugs are, indeed, at least partly under genetic control. As such, pharmacogenetics—the study of variability in drug responses attributed to hereditary factors in different populations—may significantly assist in providing answers toward meeting this challenge. A. D. Roses, *Nature* 405(6788):857-865 (2000); V. Mooser et al., *J Thromb Haemost* 1(7):1398-1402 (2003); L. M. Humma and S. G. Terra, *Am J Health Syst Pharm* 59(13):1241-1252 (2002). Associations have been reported between specific genotypes, as defined by SNPs and other genetic sequence variations, and specific responses to cardiovascular drugs. For example, a polymorphism in the KIF6 gene is associated with response to statin treatment (Iakoubova et al., "Polymorphism in KIF6 gene and benefit from statins after acute coronary syndromes: results from the PROVE IT-TIMI 22 study", *J Am Coll Cardiol*. 2008 Jan. 29; 51(4):449-55;

Iakoubova et al., "Association of the 719Arg variant of KIF6 with both increased risk of coronary events and with greater response to statin therapy", *J Am Coll Cardiol.* 2008 Jun. 3; 51(22):2195; Iakoubova et al., "KIF6 Trp719Arg polymorphism and the effect of statin therapy in elderly patients: results from the PROSPER study", *Eur J Cardiovasc Prev Rehabil.* 2010 Apr. 20; and Shiffman et al., "Effect of pravastatin therapy on coronary events in carriers of the KIF6 719Arg allele from the cholesterol and recurrent events trial", *Am J Cardiol.* 2010 May 1; 105(9):1300-5).

There is a need for genetic markers that can be used to predict an individual's responsiveness to statins. For example, there is a growing need to better identify people who have a high chance of benefiting from statins, and those who have a low risk of developing side-effects. For example, severe myopathies represent a significant risk for a low percentage of the patient population, and this may be a particular concern for patients who are treated more aggressively with statins. Furthermore, different patients may have the same the risk for adverse events but are more likely to benefit from a drug (such as statins) and this may justify use of the drug in those individuals who are more likely to benefit. Similarly, in individuals who are less likely to benefit from a drug but are at risk for adverse events, use of the drug in these individuals can be de-prioritized or delayed.

An example of a large trial which analyzed the benefits of statin treatment for reducing the risk of CVD in a large population was the JUPITER Study (described in Ridker et al., "Rosuvastatin to prevent vascular events in men and women with elevated C-reactive protein", *N Engl J Med.* 2008 Nov. 20; 359(21):2195-207), which demonstrated that rosuvastatin (Crestor®) significantly reduced the incidence of major cardiovascular events (including MI, stroke, arterial revascularization, hospitalization for unstable angina, and death from cardiovascular causes) in a study of 17,802 individuals.

The benefits of using statins for stroke is also described in O'Regan et al., "Statin therapy in stroke prevention: a meta-analysis involving 121,000 patients", *Am J Med.* 2008 January; 121(1):24-33 and Everett et al., "Rosuvastatin in the prevention of stroke among men and women with elevated levels of C-reactive protein: justification for the Use of Statins in Prevention: an Intervention Trial Evaluating Rosuvastatin (JUPITER)", Circulation. 2010 Jan. 5; 121(1):143-50.

Cardiovascular Disease (CVD), Including Coronary Heart Disease (CHD) and Stroke

Cardiovascular disease (CVD) includes coronary heart disease (CHD) (which further includes myocardial infarction (MI) and other coronary events) and cerebrovascular events such as stroke and transient ischemic attack (TIA).

Coronary heart disease (CHD) is defined herein as encompassing MI (fatal or non-fatal) and other coronary events, death from coronary disease, angina pectoris (particularly unstable angina), and coronary stenosis. The presence of CHD may be indicated by the occurrence of medical interventions such as coronary revascularization, which can include percutaneous transluminal coronary angioplasty (PTCA), coronary stent placement, and coronary artery bypass graft (CABG). Cardiovascular disease (CVD) is defined herein as encompassing CHD as well as cerebrovascular events such as stroke and transient ischemic attack (TIA).

Myocardial Infarction (MI)

Myocardial infarction (MI) is encompassed within CHD. MI, also referred to as a "heart attack", is the most common cause of mortality in developed countries. The incidence of MI is still high despite currently available preventive measures and therapeutic intervention. More than 1,500,000 people in the U.S. suffer acute MI each year, many without seeking help due to unrecognized MI, and one third of these people die. The lifetime risk of coronary artery disease events at age 40 is 42.4% for men, nearly one in two, and 24.9% for women, or one in four (D. M. Lloyd-Jones, *Lancet* 353:89-92 (1999)).

MI is a multifactorial disease that involves atherogenesis, thrombus formation and propagation. Thrombosis can result in complete or partial occlusion of coronary arteries. The luminal narrowing or blockage of coronary arteries reduces oxygen and nutrient supply to the cardiac muscle (cardiac ischemia), leading to myocardial necrosis and/or stunning. MI, unstable angina, and sudden ischemic death are clinical manifestations of cardiac muscle damage. All three endpoints are part of acute coronary syndrome since the underlying mechanisms of acute complications of atherosclerosis are considered to be the same.

Atherogenesis, the first step of pathogenesis of MI, is an interaction between blood elements, mechanical forces, disturbed blood flow, and vessel wall abnormality that results in plaque accumulation. An unstable (vulnerable) plaque is an underlying cause of arterial thrombotic events and MI. A vulnerable plaque is a plaque, often not stenotic, that has a high likelihood of becoming disrupted or eroded, thus forming a thrombogenic focus. The "vulnerability" of an individual to MI may be due to vulnerable plaque, blood vulnerability (hypercoagulation, hypothrombolysis), and heart vulnerability (sensitivity of the heart to ischemia or propensity for arrhythmia). Recurrent myocardial infarction (RMI) can generally be viewed as a severe form of MI progression caused by multiple vulnerable plaques that are able to undergo pre-rupture or a pre-erosive state, coupled with extreme blood coagulability.

The current diagnosis of MI with presentation (rather than to predict if MI is likely to occur in the future) is based on the levels of troponin I or T that indicate the cardiac muscle progressive necrosis, impaired electrocardiogram (ECG), and detection of abnormal ventricular wall motion or angiographic data (the presence of acute thrombi). However, due to the asymptomatic nature of 25% of acute MIs (absence of atypical chest pain, low ECG sensitivity), a significant portion of MIs are not diagnosed and therefore not treated appropriately (e.g., prevention of recurrent MIs).

MI risk assessment and prognosis is currently done using classic risk factors or the recently introduced Framingham Risk Index. Both of these assessments put a significant weight on LDL levels to justify preventive treatment. However, it is well established that half of all MIs occur in individuals without overt hyperlipidemia.

Other emerging risk factors of MI are inflammatory biomarkers such as C-reactive protein (CRP), ICAM-1, SAA, TNF c, homocysteine, impaired fasting glucose, new lipid markers (ox LDL, Lp-a, MAD-LDL, etc.) and pro-thrombotic factors (fibrinogen, PAI-1). These markers have significant limitations such as low specificity and low positive predictive value, and the need for multiple reference intervals to be used for different groups of people (e.g., males-females, smokers-non smokers, hormone replacement therapy users, different age groups). These limitations diminish the utility of such markers as independent prognostic markers for MI screening.

Genetics plays an important role in MI risk. Families with a positive family history of MI account for 14% of the general population, 72% of premature MIs, and 48% of all MIs (R. R. Williams, *Am J Cardiology* 87:129 (2001)). Associations have been reported between genetic polymorphisms and MI risk. For example, polymorphism in the KIF6, LPA, and other genes and chromosomal regions are associated with MI risk (Shiffman et al., "Association of gene variants with incident myocardial infarction in the Cardiovascular Health Study", *Arterioscler Thromb Vasc Biol.* 2008 January; 28(1):173-9; Bare et al., "Five common gene variants identify elevated genetic risk for coronary heart disease", *Genet Med.* 2007 October; 9(10):682-9; Iakoubova et al., "Association of the Trp719Arg polymorphism in kinesin-like protein 6 with myocardial infarction and coronary heart disease in 2 prospective trials: the CARE and WOSCOPS trials", *J Am Coll Cardiol.* 2008 Jan. 29; 51(4):435-43; and Shiffman et al., "A kinesin family member 6 variant is associated with coronary heart disease in the Women's Health Study", *J Am Coll Cardiol.* 2008 Jan. 29; 51(4):444-8.

Genetic markers such as single nucleotide polymorphisms (SNPs) are preferable to other types of biomarkers. Genetic markers that are prognostic for MI can be genotyped early in life and could predict individual response to various risk factors. The combination of serum protein levels and genetic predisposition revealed by genetic analysis of susceptibility genes can provide an integrated assessment of the interaction between genotypes and environmental factors, resulting in synergistically increased prognostic value of diagnostic tests.

Thus, there is an urgent need for novel genetic markers that are predictive of predisposition to CHD such as MI, particularly for individuals who are unrecognized as having a predisposition to MI. Such genetic markers may enable prognosis of MI in much larger populations compared with the populations that can currently be evaluated by using existing risk factors and biomarkers. The availability of a genetic test may allow, for example, appropriate preventive treatments for acute coronary events to be provided for susceptible individuals (such preventive treatments may include, for example, statin treatments and statin dose escalation, as well as changes to modifiable risk factors), lowering of the thresholds for ECG and angiography testing, and allow adequate monitoring of informative biomarkers. Moreover, the discovery of genetic markers associated with MI can provide novel targets for therapeutic intervention or preventive treatments of MI, and enable the development of new therapeutic agents for treating or preventing MI and other cardiovascular disorders.

Furthermore, novel genetic markers that are predictive of predisposition to MI can be particularly useful for identifying individuals who are at risk for early-onset MI. "Early-onset MI" may be defined as MI in men who are less than 55 years of age and women who are less than 65 years of age (K. O. Akosah et al., "Preventing myocardial infarction in the young adult in the first place: How do the National Cholesterol Education Panel III guidelines perform?" *JACC* 41(9): 1475-1479 (2003)). Individuals who experience early-onset MI may not be effectively identified by current cholesterol treatment guidelines, such as those suggested by the National Cholesterol Education Program. In one study, for example, a significant number of individuals who suffered MI at an earlier age (≤50 years) were shown to have LDL cholesterol below 100 mg/dl (K. O. Akosah et al., "Myocardial infarction in young adults with low-density lipoprotein cholesterol levels less than or equal to 100 mg/dl. Clinical profile and 1-year outcomes." *Chest* 120:1953-1958 (2001)). Because risk for MI can be reduced by lifestyle changes and by treatment of modifiable risk factors, better methods to identify individuals at risk for early-onset MI could be useful for making preventive treatment decisions, especially considering that these patients may not be identified for medical management by conventional treatment guidelines. Genetic markers for risk of early-onset MI could potentially be incorporated into individual risk assessment protocols, as they have the advantage of being easily detected at any age.

Stroke

Stroke is a prevalent and serious cerebrovascular disease. It affects 4.7 million individuals in the United States, with 500,000 first attacks and 200,000 recurrent cases yearly. Approximately one in four men and one in five women aged 45 years will have a stroke if they live to their 85th year. About 25% of those who have a stroke die within a year. Stroke is the third leading cause of mortality in the United States and is responsible for 170,000 deaths a year. Among those who survive a stroke attack, 30 to 50% do not regain functional independence. Stroke therefore is the most common cause of disability and the second leading cause of dementia (Heart Disease and Stroke Statistics—2004 Update, American Heart Association).

Stroke occurs when an artery bringing oxygen and nutrients to the brain either ruptures, causing hemorrhagic stroke, or gets occluded, causing ischemic stroke. Ischemic stroke can be caused by thrombi formation at the site of an atherosclerotic plaque rupture (this type of ischemic stroke is interchangeably referred to as thrombotic or atherothrombotic stroke) or by emboli (clots) that have travelled from another part of the vasculature (this type of ischemic stroke is referred to as embolic stroke), often from the heart (this type of embolic stroke may be referred to as cardioembolic stroke). In both ischemic and hemorrhagic stroke, a cascade of cellular changes due to ischemia or increased cranial pressure leads to injuries or death of the brain cells. In the United States, the majority (about 80-90%) of stroke cases are ischemic (Rathore, et al., *Stroke* 33:2718-2721 ((2002)), including 30% large-vessel thrombotic (also referred to as large-vessel occlusive disease), 20% small-vessel thrombotic (also referred to as small-vessel occlusive disease), and 30% embolic or cardiogenic (caused by a clot originating from elsewhere in the body, e.g., from blood pooling due to atrial fibrillation, or from carotid artery stenosis). The ischemic form of stroke results from obstruction of blood flow in cerebral blood vessels, and it shares common pathological etiology with atherosclerosis and thrombosis.

About 10-20% of stroke cases are of the hemorrhagic type (Rathore, et al., *Stroke* 33:2718-2721 ((2002)), involving bleeding within or around the brain. Bleeding within the brain is known as cerebral hemorrhage, which is often linked to high blood pressure. Bleeding into the meninges surrounding the brain is known as a subarachnoid hemorrhage, which could be caused by a ruptured cerebral aneurysm, an arteriovenous malformation, or a head injury. The hemorrhagic stroke, although less prevalent, poses a greater danger. Whereas about 8% of ischemic stroke cases result in death within 30 days, about 38% of hemorrhagic stroke cases result in death within the same time period (Collins, et al., *J. Clin. Epidemiol.* 56:81-87 (2003)).

Transient ischemic attack (TIA) is a condition related to stroke. According to the National Institute of Neurological Disorders and Stroke (NINDS), "A transient ischemic attack (TIA) is a transient stroke that lasts only a few minutes. It occurs when the blood supply to part of the brain is briefly interrupted. TIA symptoms, which usually occur suddenly, are similar to those of stroke but do not last as long. Most symptoms of a TIA disappear within an hour, although they may persist for up to 24 hours. Symptoms can include: numbness or weakness in the face, arm, or leg, especially on one side of the body; confusion or difficulty in talking or understanding speech; trouble seeing in one or both eyes; and difficulty with walking, dizziness, or loss of balance and coordination". NINDS further states that, "TIAs are often warning signs that a person is at risk for a more serious and debilitating stroke. About one-third of those who have a TIA will have an acute stroke some time in the future. Many strokes can be prevented by heeding the warning signs of TIAs and treating underlying risk factors."

Known risk factors for stroke or TIA can be divided into modifiable and non-modifiable risk factors. Older age, male sex, black or Hispanic ethnicity, and family history of stroke are non-modifiable risk factors. Modifiable risk factors include hypertension, smoking, increased insulin levels, asymptomatic carotid disease, cardiac vessel disease, and hyperlipidemia.

Multiple reports based on twin studies (Brass et al., *Stroke*. 1992; 23:221-223 and Bak et al., *Stroke*. 2002; 33:769-774) and family studies (Welin L, et al. *N Engl J Med*. 1987; 317:521-526 and Jousilahti et al., *Stroke*. 1997; 28:1361-136) have shown that genetics contributes to risk of stroke independently of traditional risk factors. A number of genetic markers have been reported to be associated with stroke. For example, SNPs in the 4q25 region were reported to be associated with stroke (Gretarsdottir et al., "Risk variants for atrial fibrillation on chromosome 4q25 associate with ischemic stroke", *Ann Neurol*. 2008; 64:402-409) and with atrial fibrillation (AF) (Gudbjartsson et al., "Variants conferring risk of atrial fibrillation on chromosome 4q25", *Nature*. 2007; 448:353-357), SNPs in the 16q22 region (Gudbjartsson et al., "A sequence variant in ZFHX3 on 16q22 associates with atrial fibrillation and ischemic stroke", *Nat Genet*. 2009; 41:876-878) and in the 9p21 region were found to be associated with noncardioembolic or atherothrombotic stroke (Luke et al., "Polymorphisms associated with both noncardioembolic stroke and coronary heart disease: vienna stroke registry", *Cerebrovasc Dis*. 2009; 28:499-504 and Gschwendtner et al., "Sequence variants on chromosome 9p21.3 confer risk for atherosclerotic stroke", *Ann Neurol*. 2009; 65:531-539), and variants in the 12p13 region were associated with stroke in general and with atherothrombotic stroke in particular (Ikram et al., "Genomewide association studies of stroke", *N Engl J Med*. 2009; 360:1718-1728).

The acute nature of stroke leaves physicians with little time to prevent or lessen the devastation of brain damage. Strategies to diminish the impact of stroke include prevention and treatment with thrombolytic and, possibly, neuroprotective agents. The success of preventive measures will depend on the identification of risk factors in individual patients and means to modulate their impact.

Although some risk factors for stroke or TIA are not modifiable, such as age and family history, other underlying pathology or risk factors of stroke or TIA such as atherosclerosis, hypertension, smoking, diabetes, aneurysm, and atrial fibrillation, are chronic and amenable to effective life-style changes, pharmacological interventions, as well as surgical treatments. Early recognition of patients with informative risk factors, and especially those with a family history, using a non-invasive test of genetic markers associated with stroke can enable physicians to target the highest risk individuals for aggressive risk reduction.

Thus, there is a need for the identification of genetic markers that are predictive of an individual's predisposition to stroke or TIA and other vascular diseases. Furthermore, the identification of genetic markers which are useful for identifying individuals who are at an increased risk of having a stroke may lead to, for example, better preventive and therapeutic strategies, economic models, and health care policy decisions.

Single Nucleotide Polymorphisms (SNPs)

The genomes of all organisms undergo spontaneous mutations in the course of their continuing evolution, generating variant forms of progenitor genetic sequences. Gusella, *Ann Rev Biochem* 55:831-854 (1986). A variant form may confer an evolutionary advantage or disadvantage relative to a progenitor form or may be neutral. In some instances, a variant form confers an evolutionary advantage to individual members of a species and is eventually incorporated into the DNA of many or most members of the species and effectively becomes the progenitor form. Additionally, the effects of a variant form may be both beneficial and detrimental, depending on the environment. For example, a heterozygous sickle cell mutation confers resistance to malaria, but a homozygous sickle cell mutation is usually lethal. In many cases, both progenitor and variant forms survive and co-exist in a species population. The coexistence of multiple forms of a genetic sequence segregating at appreciable frequencies is defined as a genetic polymorphism, which includes single nucleotide polymorphisms (SNPs).

Approximately 90% of all genetic polymorphisms in the human genome are SNPs. SNPs are single base positions in DNA at which different alleles, or alternative nucleotides, exist in a population. The SNP position (interchangeably referred to herein as SNP, SNP site, SNP locus, SNP marker, or marker) is usually preceded by and followed by highly conserved sequences (e.g., sequences that vary in less than 1/100 or 1/1000 members of the populations). An individual may be homozygous or heterozygous for an allele at each SNP position. A SNP can, in some instances, be referred to as a "cSNP" to denote that the nucleotide sequence containing the SNP is an amino acid coding sequence.

A SNP may arise from a substitution of one nucleotide for another at the polymorphic site. Substitutions can be transitions or transversions. A transition is the replacement of one purine nucleotide by another purine nucleotide, or one pyrimidine by another pyrimidine. A transversion is the replacement of a purine by a pyrimidine, or vice versa. A SNP may also be a single base insertion or deletion variant referred to as an "indel." Weber et al., "Human diallelic insertion/deletion polymorphisms," *Am J Hum Genet* 71(4): 854-62 (October 2002).

A synonymous codon change, or silent mutation/SNP (terms such as "SNP", "polymorphism", "mutation", "mutant", "variation", and "variant" are used herein interchangeably), is one that does not result in a change of amino acid due to the degeneracy of the genetic code. A substitution that changes a codon coding for one amino acid to a codon coding for a different amino acid (i.e., a non-synonymous codon change) is referred to as a missense mutation. A nonsense mutation results in a type of non-synonymous codon change in which a stop codon is formed, thereby leading to premature termination of a polypeptide chain and a truncated protein. A read-through mutation is another type of non-synonymous codon change that causes the destruction of a stop codon, thereby resulting in an extended polypeptide product. While SNPs can be bi-, tri-, or tetra-allelic, the vast majority of SNPs are bi-allelic, and are thus often referred to as "bi-allelic markers," or "di-allelic markers."

As used herein, references to SNPs and SNP genotypes include individual SNPs and/or haplotypes, which are groups of SNPs that are generally inherited together. Haplotypes can have stronger correlations with diseases or other phenotypic effects compared with individual SNPs, and therefore may provide increased diagnostic accuracy in some cases. Stephens et al., *Science* 293:489-493 (July 2001).

Causative SNPs are those SNPs that produce alterations in gene expression or in the expression, structure, and/or function of a gene product, and therefore are most predictive of a possible clinical phenotype. One such class includes SNPs falling within regions of genes encoding a polypeptide product, i.e. cSNPs. These SNPs may result in an alteration of the amino acid sequence of the polypeptide product (i.e., non-synonymous codon changes) and give rise to the expression of a defective or other variant protein. Furthermore, in the case of nonsense mutations, a SNP may lead to premature termination of a polypeptide product. Such variant products can result in a pathological condition, e.g., genetic disease. Examples of genes in which a SNP within a coding sequence causes a genetic disease include sickle cell anemia and cystic fibrosis.

Causative SNPs do not necessarily have to occur in coding regions; causative SNPs can occur in, for example, any genetic region that can ultimately affect the expression, structure, and/or activity of the protein encoded by a nucleic acid. Such genetic regions include, for example, those involved in transcription, such as SNPs in transcription factor binding domains, SNPs in promoter regions, in areas involved in transcript processing, such as SNPs at intron-exon boundaries that may cause defective splicing, or SNPs in mRNA processing signal sequences such as polyadenylation signal regions. Some SNPs that are not causative SNPs nevertheless are in close association with, and therefore segregate with, a disease-causing sequence. In this situation, the presence of a SNP correlates with the presence of, or predisposition to, or an increased risk in developing the disease. These SNPs, although not causative, are nonetheless also useful for diagnostics, disease predisposition screening, and other uses.

An association study of a SNP and a specific disorder involves determining the presence or frequency of the SNP allele in biological samples from individuals with the disorder of interest, such as CVD, and comparing the information to that of controls (i.e., individuals who do not have the disorder; controls may be also referred to as "healthy" or "normal" individuals) who are preferably of similar age and race. The appropriate selection of patients and controls is important to the success of SNP association studies. Therefore, a pool of individuals with well-characterized phenotypes is extremely desirable.

A SNP may be screened in diseased tissue samples or any biological sample obtained from a diseased individual, and compared to control samples, and selected for its increased (or decreased) occurrence in a specific pathological condition, such as pathologies related to CVD and in particular, CHD (e.g., MI). Once a statistically significant association is established between one or more SNP(s) and a pathological condition (or other phenotype) of interest, then the region around the SNP can optionally be thoroughly screened to identify the causative genetic locus/sequence(s) (e.g., causative SNP/mutation, gene, regulatory region, etc.) that influences the pathological condition or phenotype. Association studies may be conducted within the general population and are not limited to studies performed on related individuals in affected families (linkage studies).

Clinical trials have shown that patient response to treatment with pharmaceuticals is often heterogeneous. There is a continuing need to improve pharmaceutical agent design and therapy. In that regard, SNPs can be used to identify patients most suited to therapy with particular pharmaceutical agents (this is often termed "pharmacogenomics"). Similarly, SNPs can be used to exclude patients from certain treatment due to the patient's increased likelihood of developing toxic side effects or their likelihood of not responding to the treatment. Pharmacogenomics can also be used in pharmaceutical research to assist the drug development and selection process. Linder et al., *Clinical Chemistry* 43:254 (1997); Marshall, *Nature Biotechnology* 15:1249 (1997); International Patent Application WO 97/40462, Spectra Biomedical; and Schafer et al., *Nature Biotechnology* 16:3 (1998).

SUMMARY OF THE INVENTION

Exemplary embodiments of the present invention relate to the identification of SNPs, as well as unique combinations of such SNPs and haplotypes of SNPs, that are associated with variability between individuals in their response to statins, particularly for the prevention or treatment of cardiovascular disease (CVD), which includes coronary heart disease (CHD) (which further includes myocardial infarction (MI) and other coronary events) and cerebrovascular events such as stroke. These SNPs are also useful for determining an individual's risk for developing CVD, particularly CHD (including coronary events such as MI) as well as cerebrovascular events such as stroke. The polymorphisms disclosed herein are directly useful as targets for the design of diagnostic and prognostic reagents and the development of therapeutic and preventive agents for use in the diagnosis, prognosis, treatment, and/or prevention of CVD (particularly CHD, such as MI), as well as for predicting a patient's response to therapeutic agents such as statins, particularly for the treatment or prevention of CVD (particularly CHD, such as MI).

Based on the identification of SNPs associated with variability between individuals in their response to statins, particularly for reducing the risk of CVD such as CHD (e.g., MI) and stroke, exemplary embodiments of the present invention also provide methods of detecting these variants as well as the design and preparation of detection reagents needed to accomplish this task. The invention specifically provides, for example, SNPs associated with responsiveness to statin treatment, isolated nucleic acid molecules (including DNA and RNA molecules) containing these SNPs, variant proteins encoded by nucleic acid molecules containing such SNPs, antibodies to the encoded variant proteins, computer-based and data storage systems containing the novel SNP information, methods of detecting these SNPs in a test sample, methods of identifying individuals who have an altered (i.e., increased or decreased) risk of developing CVD (such as CHD (e.g., MI) or stroke), methods for determining the risk of an individual for recurring CVD (e.g., recurrent MI), methods of treating an individual who has an increased risk for CVD and/or increased likelihood of responding to statin treatment, and methods for identifying individuals (e.g., determining a particular individual's likelihood) who have an altered (i.e., increased or decreased) likelihood of responding to drug treatment (especially statin treatment), particularly drug treatment of CVD (e.g., prevention or treatment of CHD such as MI), based on the presence or absence of one or more particular nucleotides (alleles) at one or more SNP sites disclosed herein or the detection of one or more encoded variant products (e.g., variant mRNA transcripts or variant proteins), methods of screening for compounds useful in the treatment or prevention of CVD, compounds identified by these methods, methods of treating or preventing CVD, etc.

Exemplary embodiments of the present invention further provide methods for selecting or formulating a treatment regimen (e.g., methods for determining whether or not to administer statin treatment to an individual having CVD, or who is at risk for developing CVD in the future, or who has previously had CVD, methods for selecting a particular statin-based treatment regimen such as dosage and frequency of administration of statin, or a particular form/type of statin such as a particular pharmaceutical formulation or statin compound, methods for administering (either in addition to or instead of a statin) an alternative, non-statin-based treatment, such as niacin, fibrates, or ezetimibe (e.g., Zetia® or Ezetrol®), to individuals who are predicted to be unlikely to respond positively to statin treatment, etc.), and methods for determining the likelihood of experiencing toxicity or other undesirable side effects from statin treatment, etc. Various embodiments of the present invention also provide methods for selecting individuals to whom a statin or other therapeutic will be administered based on the individual's genotype, and methods for selecting individuals for a clinical trial of a statin or other therapeutic agent based on the genotypes of the individuals (e.g., selecting individuals to participate in the trial who are most likely to respond positively from the statin treatment and/or excluding individuals from the trial who are unlikely to respond positively from the statin treatment based on their SNP genotype(s), or selecting individuals who are unlikely to respond positively to statins based on their SNP genotype(s) to participate in a clinical trial of another type of drug that may benefit them). Further embodiments of the present invention provide methods for reducing an individual's risk of developing CVD (such as CHD (e.g., MI) or stroke) using statin treatment, including preventing recurring CVD (e.g., recurrent MI) using statin treatment, when said individual carries one or more SNPs identified herein as being associated with statin response.

Tables 1 and 2 provides gene information, references to the identification of transcript sequences (SEQ ID NOS: 1-51), encoded amino acid sequences (SEQ ID NOS: 52-102), genomic sequences (SEQ ID NOS: 177-622), transcript-based context sequences (SEQ ID NOS: 103-176) and genomic-based context sequences (SEQ ID NOS: 623-3661) that contain the SNPs of the present application, and extensive SNP information that includes observed alleles, allele frequencies, populations/ethnic groups in which alleles have been observed, information about the type of SNP and corresponding functional effect, and, for cSNPs, information about the encoded polypeptide product. The actual transcript sequences (SEQ ID NOS: 1-51), amino acid sequences (SEQ ID NOS: 52-102), genomic sequences (SEQ ID NOS: 177-622), transcript-based SNP context sequences (SEQ ID NOS: 103-176), and genomic-based SNP context sequences (SEQ ID NOS: 623-3661) are provided in the Sequence Listing.

In certain exemplary embodiments, the invention provides methods for identifying an individual who has an altered likelihood of responding to statin treatment or an altered risk for developing CVD, particularly CHD or stroke (including, for example, a first incidence and/or a recurrence of the disease, such as primary or recurrent MI), in which the method comprises detecting a single nucleotide polymorphism (SNP) in any one of the nucleotide sequences of SEQ ID NOS: 1-51, SEQ ID NOS: 103-176, SEQ ID NOS: 177-622, and SEQ ID NOS: 623-3661 in said individual's nucleic acids, wherein the SNP is specified in Table 1 and/or Table 2, and the presence of the SNP is indicative of an altered response to statin treatment or an altered risk for CVD in said individual. In certain embodiments, the CVD is CHD, particularly MI. In certain other embodiments, the CVD is stroke. In certain exemplary embodiments of the invention, SNPs that occur naturally in the human genome are provided within isolated nucleic acid molecules. These SNPs are associated with response to statin treatment thereby reducing the risk of CVD, such as CHD (e.g., MI) or stroke, such that they can have a variety of uses in the diagnosis, prognosis, treatment, and/or prevention of CVD, and particularly in the treatment or prevention of CVD using statins. In certain embodiments, a nucleic acid of the invention is an amplified polynucleotide, which is produced by amplification of a SNP-containing nucleic acid template. In another embodiment, the invention provides for a variant protein that is encoded by a nucleic acid molecule containing a SNP disclosed herein.

In further embodiments of the invention, reagents for detecting a SNP in the context of its naturally-occurring flanking nucleotide sequences (which can be, e.g., either DNA or mRNA) are provided. In particular, such a reagent may be in the form of, for example, a hybridization probe or an amplification primer that is useful in the specific detection of a SNP of interest. In an alternative embodiment, a protein detection reagent is used to detect a variant protein that is encoded by a nucleic acid molecule containing a SNP disclosed herein. A preferred embodiment of a protein detection reagent is an antibody or an antigen-reactive antibody fragment. Various embodiments of the invention also provide kits comprising SNP detection reagents, and methods for detecting the SNPs disclosed herein by employing the SNP detection reagents. An exemplary embodiment of the present invention provides a kit comprising a SNP detection reagent for use in determining whether a human's risk for CVD is reduced by treatment with statins based upon the presence or absence of a particular allele of one or more SNPs disclosed herein.

In various embodiments, the present invention provides methods for evaluating whether an individual is likely (or unlikely) to respond to statin treatment (i.e., benefit from statin treatment)), particularly statin treatment for reducing the risk of CVD, particularly CHD (such as MI) or stroke, by detecting the presence or absence of one or more SNP alleles disclosed herein. The present invention also provides methods of identifying an individual having an increased or decreased risk of developing CVD, such as CHD (e.g., MI) or stroke, by detecting the presence or absence of one or more SNP alleles disclosed herein.

In certain embodiments, the presence of a statin response allele disclosed herein in Tables 4-22 (an allele associated with increased response to statin treatment for reducing CVD or CHD risk) is detected and indicates that an individual has an increased risk for developing CVD, such as CHD (e.g., MI) or stroke. In these embodiments, in which the same allele is associated with both increased risk for developing CVD and increased response to statin treatment (i.e., the same allele is both a risk and a response allele), this increased risk for developing CVD can be reduced by administering statin treatment to an individual having the allele.

The nucleic acid molecules of the invention can be inserted in an expression vector, such as to produce a variant protein in a host cell. Thus, the present invention also provides for a vector comprising a SNP-containing nucleic acid molecule, genetically-engineered host cells containing the vector, and methods for expressing a recombinant variant protein using such host cells. In another specific embodiment, the host cells, SNP-containing nucleic acid molecules, and/or variant proteins can be used as targets in a method for screening and identifying therapeutic agents or pharmaceutical compounds useful in the treatment or prevention of CVD, such as CHD (e.g., MI) or stroke.

An aspect of this invention is a method for treating or preventing CVD such as CHD or stroke (including, for example, a first occurrence and/or a recurrence of the disease, such as primary or recurrent MI), in a human subject wherein said human subject harbors a SNP, gene, transcript, and/or encoded protein identified in Tables 1 and 2, which method comprises administering to said human subject a therapeutically or prophylactically effective amount of one or more agents counteracting the effects of the disease, such as by inhibiting (or stimulating) the activity of a gene, transcript, and/or encoded protein identified in Tables 1 and 2.

Another aspect of this invention is a method for identifying an agent useful in therapeutically or prophylactically treating CVD (particularly CHD or stroke), in a human subject wherein said human subject harbors a SNP, gene, transcript, and/or encoded protein identified in Tables 1 and 2, which method comprises contacting the gene, transcript, or encoded protein with a candidate agent under conditions suitable to allow formation of a binding complex between the gene, transcript, or encoded protein and the candidate agent and detecting the formation of the binding complex, wherein the presence of the complex identifies said agent.

Another aspect of this invention is a method for treating or preventing CVD such as CHD (e.g., MI) or stroke, in a human subject, in which the method comprises:

Solely for clarity of discussion, the invention is described in the sections below by way of non-limiting examples.

DESCRIPTION OF THE TEXT (ASCII) FILES SUBMITTED ELECTRONICALLY VIA EFS-WEB

The following three text (ASCII) files are submitted electronically via EFS-Web as part of the instant application:

1) File SEQLIST_CD000027ORD.txt provides the Sequence Listing. The Sequence Listing provides the transcript sequences (SEQ ID NOS: 1-51) and protein sequences (SEQ ID NOS: 52-102) as referred to in Table 1, and genomic sequences (SEQ ID NOS: 177-622) as referred to in Table 2, for each gene (or genomic region for intergenic SNPs) that contains one or more statin response-associated SNPs of the present invention. Also provided in the Sequence Listing are context sequences flanking each SNP, including both transcript-based context sequences as referred to in Table 1 (SEQ ID NOS: 103-176) and genomic-based context sequences as referred to in Table 2 (SEQ ID NOS: 623-3661). The context sequences generally provide 100 bp upstream (5') and 100 bp downstream (3') of each SNP, with the SNP in the middle of the context sequence, for a total of 200 bp of context sequence surrounding each SNP. File SEQLIST_CD000027ORD.txt is 63,960 KB in size, and was created on Apr. 5, 2011.

2) File TABLE1_CD000027ORD.txt provides Table 1, which is 78 KB in size and was created on Apr. 6, 2011.

3) File TABLE2_CD000027ORD.txt provides Table 2, which is 1,971 KB in size and was created on Apr. 6, 2011.

These three text files are hereby incorporated by reference pursuant to 37 CFR 1.77(b)(4).

LENGTHY TABLES

The patent contains a lengthy table section. A copy of the table is available in electronic form from the USPTO web site (http://seqdata.uspto.gov/?pageRequest=docDetail&DocID=US10563263B2). An electronic copy of the table will also be available from the USPTO upon request and payment of the fee set forth in 37 CFR 1.19(b)(3).

(i) determining that said human subject harbors a SNP, gene, transcript, and/or encoded protein identified in Tables 1 and 2, and (ii) administering to said subject a therapeutically or prophylactically effective amount of one or more agents counteracting the effects of the disease, such as statins.

Another aspect of the invention is a method for identifying a human who is likely to benefit from statin treatment, in which the method comprises detecting an allele of one or more SNPs disclosed herein in said human's nucleic acids, wherein the presence of the allele indicates that said human is likely to benefit from statin treatment.

Another aspect of the invention is a method for identifying a human who is likely to benefit from statin treatment, in which the method comprises detecting an allele of one or more SNPs that are in LD with one or more SNPs disclosed herein in said human's nucleic acids, wherein the presence of the allele of the LD SNP indicates that said human is likely to benefit from statin treatment.

Many other uses and advantages of the present invention will be apparent to those skilled in the art upon review of the detailed description of the exemplary embodiments herein.

Description of Table 1 and Table 2 Table 1 and Table 2 (both submitted electronically via EFS-Web as part of the instant application) disclose the SNP and associated gene/transcript/protein information and sequences for the SNPs disclosed in Tables 4-22, as well as for the LD SNPs disclosed in Table 3. Table 1 is based on transcript and protein sequences, whereas Table 2 is based on genomic sequences.

For each gene, Table 1 provides a header containing gene, transcript and protein information, followed by a transcript and protein sequence identifier (SEQ ID NO), and then SNP information regarding each SNP found in that gene/transcript including the transcript context sequence. For each gene in Table 2, a header is provided that contains gene and genomic information, followed by a genomic sequence identifier (SEQ ID NO) and then SNP information regarding each SNP found in that gene, including the genomic context sequence.

Note that SNP markers may be included in both Table 1 and Table 2; Table 1 presents the SNPs relative to their transcript sequences and encoded protein sequences, whereas Table 2 presents the SNPs relative to their genomic sequences. In some instances Table 2 may also include, after the last gene sequence, genomic sequences of one or more intergenic regions, as well as SNP context sequences and other SNP information for any SNPs that lie within these intergenic regions. Additionally, in either Table 1 or 2, a "Related Interrogated SNP" may be listed following a SNP which is determined to be in LD with that interrogated SNP according to the given Power value. SNPs can be readily cross-referenced between all Tables based on their Celera hCV (or, in some instances, hDV) identification numbers and/or public rs identification numbers, and to the Sequence Listing based on their corresponding SEQ ID NOs.

The gene/transcript/protein information includes:
  a gene number (1 through n, where n=the total number of genes in the Table),
  a gene symbol, along with an Entrez gene identification number (Entrez Gene database, National Center for Biotechnology Information (NCBI), National Library of Medicine (NLM), National Institutes of Health (NIH))
  a gene name,
  an accession number for the transcript (e.g., RefSeq NM number, or a Celera hCT identification number if no RefSeq NM number is available) (Table 1 only),
  an accession number for the protein (e.g., RefSeq NP number, or a Celera hCP identification number if no RefSeq NP number is available) (Table 1 only),
  the chromosome number of the chromosome on which the gene is located,
  an OMIM ("Online Mendelian Inheritance in Man" database, Johns Hopkins University/NCBI) public reference number for the gene, and OMIM information such as alternative gene/protein name(s) and/or symbol(s) in the OMIM entry.

Note that, due to the presence of alternative splice forms, multiple transcript/protein entries may be provided for a single gene entry in Table 1; i.e., for a single Gene Number, multiple entries may be provided in series that differ in their transcript/protein information and sequences.

Following the gene/transcript/protein information is a transcript context sequence (Table 1), or a genomic context sequence (Table 2), for each SNP within that gene.

After the last gene sequence, Table 2 may include additional genomic sequences of intergenic regions (in such instances, these sequences are identified as "Intergenic region:" followed by a numerical identification number), as well as SNP context sequences and other SNP information for any SNPs that lie within each intergenic region (such SNPs are identified as "INTERGENIC" for SNP type).

Note that the transcript, protein, and transcript-based SNP context sequences are all provided in the Sequence Listing. The transcript-based SNP context sequences are provided in both Table 1 and also in the Sequence Listing. The genomic and genomic-based SNP context sequences are provided in the Sequence Listing. The genomic-based SNP context sequences are provided in both Table 2 and in the Sequence Listing. SEQ ID NOs are indicated in Table 1 for the transcript-based context sequences (SEQ ID NOS: 103-176); SEQ ID NOs are indicated in Table 2 for the genomic-based context sequences (SEQ ID NOS: 623-3661).

The SNP information includes:
  Context sequence (taken from the transcript sequence in Table 1, the genomic sequence in Table 2) with the SNP represented by its IUB code, including 100 bp upstream (5') of the SNP position plus 100 bp downstream (3') of the SNP position (the transcript-based SNP context sequences in Table 1 are provided in the Sequence Listing as SEQ ID NOS: 103-176; the genomic-based SNP context sequences in Table 2 are provided in the Sequence Listing as SEQ ID NOS: 623-3661).
  Celera hCV internal identification number for the SNP (in some instances, an "hDV" number is given instead of an "hCV" number).
  The corresponding public identification number for the SNP, the rs number.
  "SNP Chromosome Position" indicates the nucleotide position of the SNP along the entire sequence of the chromosome as provided in NCBI Genome Build 36.
  SNP position (nucleotide position of the SNP within the given transcript sequence (Table 1) or within the given genomic sequence (Table 2)).
  "Related Interrogated SNP" is the interrogated SNP with which the listed SNP is in LD at the given value of Power.
  SNP source (may include any combination of one or more of the following five codes, depending on which internal sequencing projects and/or public databases the SNP has been observed in: "Applera"=SNP observed during the re-sequencing of genes and regulatory regions of 39 individuals, "Celera"=SNP observed during shotgun sequencing and assembly of the Celera human genome sequence, "Celera Diagnostics"=SNP observed during re-sequencing of nucleic acid samples from individuals who have a disease, "dbSNP"=SNP observed in the dbSNP public database, "HGBASE"=SNP observed in the HGBASE public database, "HGMD"=SNP observed in the Human Gene Mutation Database (HGMD) public database, "HapMap"=SNP observed in the International HapMap Project public database, "CSNP"=SNP observed in an internal Applied Biosystems (Foster City, Calif.) database of coding SNPS (cSNPs).

Note that multiple "Applera" source entries for a single SNP indicate that the same SNP was covered by multiple overlapping amplification products and the re-sequencing results (e.g., observed allele counts) from each of these amplification products is being provided.

Population/allele/allele count information in the format of [population1(first_allele,count|second_allele,count) population2(first_allele,count|second_allele,coun t) total (first_allele,total count|second_allele,total count)]. The information in this field includes populations/ethnic groups in which particular SNP alleles have been observed ("cau"=Caucasian, "his"=Hispanic, "chn"=Chinese, and "afr"=African-American, "jpn"=Japanese, "ind"=Indian, "mex"=Mexican, "ain"="American Indian, "cra"=Celera donor, "no_pop"=no population information available), identified SNP alleles, and observed allele counts (within each population group and total allele counts), where available ["–" in the allele field represents a deletion allele of an insertion/deletion ("indel") polymorphism (in which case the corresponding insertion allele, which may be comprised of one or more nucleotides, is indicated in the allele field on the opposite side of the "|"); "-" in the count field indicates that allele count information is not available]. For certain SNPs from the public dbSNP database, population/ethnic information is indicated as follows (this population information is publicly available in dbSNP): "HISP1"=human individual DNA (anonymized samples) from 23 individuals of self-described HISPANIC heritage; "PAC 1"=human individual DNA (anonymized samples) from 24 individuals of self-described PACIFIC RIM heritage; "CAUC 1"=human individual DNA (anonymized samples) from 31 individuals of self-described CAUCASIAN heritage; "AFR1"=human individual DNA (anonymized samples) from 24 individuals of self-described AFRICAN/AFRICAN AMERICAN heritage; "P1"=human individual DNA (anonymized samples) from 102 individuals of self-described heritage; "PA130299515"; "SC_12_A"=SANGER 12 DNAs of Asian origin from Corielle cell repositories, 6 of which are male and 6 female; "SC_12_C"=SANGER 12 DNAs of Caucasian origin from Corielle cell repositories from the CEPH/UTAH library, six male and six female; "SC_12 AA"=SANGER 12 DNAs of African-American origin from Corielle cell repositories 6 of which are male and 6 female; "SC_95_C"=SANGER 95 DNAs of Caucasian origin from Corielle cell repositories from the CEPH/UTAH library; and "SC_12_CA"=Caucasians—12 DNAs from Corielle cell repositories that are from the CEPH/UTAH library, six male and six female.

Note that for SNPs of "Applera" SNP source, genes/regulatory regions of 39 individuals (20 Caucasians and 19 African Americans) were re-sequenced and, since each SNP position is represented by two chromosomes in each individual (with the exception of SNPs on X and Y chromosomes in males, for which each SNP position is represented by a single chromosome), up to 78 chromosomes were genotyped for each SNP position. Thus, the sum of the African-American ("afr") allele counts is up to 38, the sum of the Caucasian allele counts ("cau") is up to 40, and the total sum of all allele counts is up to 78.

Note that semicolons separate population/allele/count information corresponding to each indicated SNP source; i.e., if four SNP sources are indicated, such as "Celera," "dbSNP," "HGBASE," and "HGMD," then population/allele/count information is provided in four groups which are separated by semicolons and listed in the same order as the listing of SNP sources, with each population/allele/count information group corresponding to the respective SNP source based on order; thus, in this example, the first population/allele/count information group would correspond to the first listed SNP source (Celera) and the third population/allele/count information group separated by semicolons would correspond to the third listed SNP source (HGBASE); if population/allele/count information is not available for any particular SNP source, then a pair of semicolons is still inserted as a place-holder in order to maintain correspondence between the list of SNP sources and the corresponding listing of population/allele/count information.

SNP type (e.g., location within gene/transcript and/or predicted functional effect) ["MIS-SENSE MUTATION"=SNP causes a change in the encoded amino acid (i.e., a non-synonymous coding SNP); "SILENT MUTATION"=SNP does not cause a change in the encoded amino acid (i.e., a synonymous coding SNP); "STOP CODON MUTATION"=SNP is located in a stop codon; "NONSENSE MUTATION"=SNP creates or destroys a stop codon; "UTR 5"=SNP is located in a 5' UTR of a transcript; "UTR 3"=SNP is located in a 3' UTR of a transcript; "PUTATIVE UTR 5"=SNP is located in a putative 5' UTR; "PUTATIVE UTR 3"=SNP is located in a putative 3' UTR; "DONOR SPLICE SITE"=SNP is located in a donor splice site (5' intron boundary); "ACCEPTOR SPLICE SITE"=SNP is located in an acceptor splice site (3' intron boundary); "CODING REGION"=SNP is located in a protein-coding region of the transcript; "EXON"=SNP is located in an exon; "INTRON"=SNP is located in an intron; "hmCS"=SNP is located in a human-mouse conserved segment; "TFBS"=SNP is located in a transcription factor binding site; "UNKNOWN"=SNP type is not defined; "INTERGENIC"=SNP is intergenic, i.e., outside of any gene boundary].

Protein coding information (Table 1 only), where relevant, in the format of [protein SEQ ID NO, amino acid position, (amino acid-1, codon1) (amino acid-2, codon2)]. The information in this field includes SEQ ID NO of the encoded protein sequence, position of the amino acid residue within the protein identified by the SEQ ID NO that is encoded by the codon containing the SNP, amino acids (represented by one-letter amino acid codes) that are encoded by the alternative SNP alleles (in the case of stop codons, "X" is used for the one-letter amino acid code), and alternative codons containing the alternative SNP nucleotides which encode the amino acid residues (thus, for example, for missense mutation-type SNPs, at least two different amino acids and at least two different codons are generally indicated; for silent mutation-type SNPs, one amino acid and at least two different codons are generally indicated, etc.). In instances where the SNP is located outside of a protein-coding region (e.g., in a UTR region), "None" is indicated following the protein SEQ ID NO.

Description of Table 3

Table 3 provides a list of linkage disequilibrium (LD) SNPs that are related to and derived from certain interrogated SNPs. The interrogated SNPs, which are those SNPs provided in Tables 4-22, are statistically significantly associated with, for example, response to statin treatment for reducing CVD/CHD risk, as described and shown herein. The LD SNPs provided in Table 3 all have an $r^2$ value at or above 0.9 (which was set as the Threshold $r^2$ value), and are provided as examples of SNPs which can also be used as markers for, for example, response to statin treatment for reducing risk of CVD (especially CHD, such as MI and other coronary events, as well as cerebrovascular events such as stroke) based on their being in high LD with an interrogated statin response-associated SNP.

In Table 3, the columns labeled "Interrogated SNP" presents each interrogated SNP as identified by its unique hCV and rs identification number. The columns labeled "LD SNP" presents the hCV and rs numbers of the LD SNPs that are derived from their corresponding interrogated SNPs. The column labeled "Threshold $r^2$" presents the minimum value of $r^2$ that an LD SNP must meet in reference to an interrogated SNP in order to be included in Table 3 (the Threshold $r^2$ value is set at 0.9 for all SNPs in Table 3). The column labeled "$r^2$" presents the actual $r^2$ value of the LD SNP in reference to the interrogated SNP to which it is related (since the Threshold $r^2$ value is set at 0.9, all SNPs in Table 3 will have an $r^2$ value at or above 0.9). The criteria for selecting the LD SNPs provided in Table 3 are further described in Example 4 below.

Sequences, SNP information, and associated gene/transcript/protein information for each of the LD SNPs listed in Table 3 is provided in Tables 1-2.

Description of Tables 4-22

Tables 4-22 provide the results of analyses for SNPs disclosed in Tables 1 and 2 (SNPs can be cross-referenced between all the tables herein based on their hCV and/or rs identification numbers). The results shown in Tables 4-22 provide support for the association of these SNPs with, for example, response to statin treatment for reducing the risk of CVD, particularly CHD (e.g., MI) and stroke.

Tables 4-8

The analyses in Tables 4-8 are further described in Example 1 below.

Cohort and case-only study designs were used to identify SNPs associated with response to statin treatment in sample sets from the CARE, WOSCOPS, and PROVE-IT trials (these sample sets, with corresponding references, are described in Example 1 below). Specifically, analyses were carried out using the entire cohorts (individuals with and without incident CHD or CVD events) or cases only (only individuals with an incident CHD or CVD event) from these three sample sets (individually, as well as in combined meta-analyses) to identify SNPs associated with a reduction in the risk of CHD or CVD (CVD includes CHD and stroke) in response to statin treatment, and the results of these analyses are provided in Table 4-7 (Table 8 provides the degree of LD ($r^2$) between pairs of SNPs listed in Tables 5 and 7).

Tables 4-7 provides SNPs that had a synergy index (odds ratio) with P value lower than $10^{-4}$ in a meta-analysis of CARE and WOSCOPS combined (Table 4-5) or in a meta-analysis of CARE, WOSCOPS, and PROVE-IT combined (Table 6-7), in any genetic model (dominant, recessive, or additive) in either the CHD or CVD endpoint (the CHD or CVD endpoint is indicated in the last column, labeled "Endpoint", of Tables 4-7, and the genetic model is indicated in the next to last column, labeled "Model", of Tables 4-7). For each analysis, Tables 4-7 indicate whether the data comes from case-only analysis ("CaseOnly" in the "Source" column) or from analysis of the entire cohort ("cohort" in the "Source" column). Whenever cohort data was available, it was used in the meta-analysis.

Tables 4-5 provide meta-analyses of CARE and WOSCOPS combined ($2^{nd}$ section of each table) for two endpoints (CHD and CVD) and three genetic models (dominant, recessive, and additive), as well as logistic regression analyses of CARE ($3^{rd}$ section of each table) and WOSCOPS ($4^{th}$ section of each table) individually.

Tables 6-7 provide meta-analyses of CARE, WOSCOPS, and PROVE-IT combined ($2^{nd}$ section of each table) for two endpoints (CHD and CVD) and three genetic models (dominant, recessive, and additive), as well as logistic regression analyses of CARE ($3^{rd}$ section of each table), WOSCOPS ($4^{th}$ section of each table), and PROVE-IT ($5^{th}$ section of each table) individually. For PROVE-IT, there was only one endpoint (the composite primary endpoint of the original PROVE-IT study, which includes some stroke cases), and this endpoint was used in meta-analysis of both CHD and CVD.

Tables 5 and 7 provide analyses of certain LD SNPs in CARE and WOSCOPS (Table 5) and in CARE, WOSCOPS, and PROVE-IT (Table 7). For some SNPs, case-only data was available for a first SNP while cohort data was available for a SNP in LD with the first SNP (LD SNP), which occurred when a working kPCR assay could not be made for the first SNP. For these SNPs, the data for case-only analysis and the available data for the cohort is reported. The meta-analysis was performed using the cohort data when available. These SNPs are listed in Tables 5 and 7, with the two SNPs in LD listed one below the other, and the degree of LD between each of these pairs of SNPs is provided in Table 8.

Notations in Tables 4-7 are as follows:

In Tables 4-7, "allele A1" may be interchangeably referred to as the "non-reference allele" ("non-ref"), and "allele A2" may be interchangeably referred to as the "reference allele" ("ref"). The OR's that are indicated in Tables 4-7 correspond to the indicated "non-reference allele" ("allele A1"). Thus, if OR<1, the "non-reference allele" ("allele A1") is associated with reduction of CVD/CHD risk by statin treatment, whereas if OR>1, the other alternative allele at the SNP (the "reference allele" or "allele A2") is associated with reduction of CVD/CHD risk by statin treatment.

The counts are indicated in the following format: allele A1 homozygotes/heterozygotes/allele A2 homozygotes. These counts indicate the number of individuals in the pravastatin ("Prava"), placebo, or atorvastatin ("Atorva") arms of the CARE, WOSCOPS, or PROVE-IT trials (as indicated) who have the corresponding genotypes.

In Tables 4-7, "P value" indicates the p-value, "OR" indicates the odds ratio (synergy index), "OR L95" and "OR U95" indicates the lower and upper (respectively) 95% confidence interval for the odds ratio, and "Source" indicates whether the data comes from case-only analysis ("CaseOnly") or from analysis of the entire cohort ("cohort").

Tables 9-18

Tables 9-18 provide additional SNPs associated with response to statin treatment for reducing CVD/CHD risk. Tables 9-18 differ from Tables 4-8 in that Tables 9-18 include SNPs analyzed by imputation as well as by genotyping, whereas all of the SNPs in Tables 4-8 were analyzed by genotyping. Imputation involves imputing the allele/genotype present at a SNP for each individual in the sample set (CARE, WOSCOPS, and PROVE-IT) rather than directly genotyping the SNP in a sample from the individual. The column labeled "Source" in each of Tables 9-18 indicates whether the data presented for each SNP was derived from imputation or from genotyping.

Specifically, analyses were carried out using the same three sample sets as in Tables 4-8 (CARE, WOSCOPS, and PROVE-IT) to identify (by both genotyping and imputation) additional SNPs beyond those provided in Tables 4-8 that are also associated with a reduction in the risk of CHD or CVD. Tables 9-18 provide results of analyses of statin response for the same two endpoints as in Tables 4-8 (CHD in Tables 9-13, and CVD in Tables 14-18) and four genetic models (dominant, recessive, additive, and genotypic 2df).

Tables 9-18 provide genotyped and imputed SNPs for which the p-value for a random effect was lower than $10^{-4}$ for either the meta-analysis of CARE and WOSCOPS combined or the meta-analysis of CARE, WOSCOPS, and PROVE-IT combined, for either the CHD or CVD endpoint, and for any genetic model (dominant, recessive, additive, or genotypic). Association interaction between statin response and either the CHD or CVD phenotype was performed.

Tables 9-13 have CHD as an endpoint, whereas Tables 14-18 have CVD as an endpoint (CVD includes CHD and stroke).

Tables 9 and 14 provide results of logistic regression analysis of the CARE sample set by direct genotyping and by imputing genotypes.

Tables 10 and 15 provide results of logistic regression analysis of the WOSCOPS sample set by direct genotyping and by imputing genotypes.

Tables 11 and 16 provide results of logistic regression analysis of the PROVE-IT sample set by direct genotyping and by imputing genotypes.

Tables 12 and 17 provide results of meta-analysis of the CARE and WOSCOPS sample sets combined by direct genotyping and by imputing genotypes.

Tables 13 and 18 provide results of meta-analysis of the CARE, WOSCOPS, and PROVE-IT sample sets combined by direct genotyping and by imputing genotypes.

Notations in Tables 9-11 and 14-16 (for the analysis of CARE, WOSCOPS, and PROVE-IT sample sets individually) are as follows:

"SOURCE" indicates whether each SNP was genotyped ("Genotyped") or imputed ("Imputed").

"ALLELE" indicates the allele for which the given data (such as the OR) correspond to, which is also referred to herein as allele "A1" (and the other alternative allele at each SNP, which is not shown in Tables 9-11 and 14-16, but is shown in Tables 1-2 for each SNP, is referred to as allele "A2").

"MODEL" indicates whether the model was additive ("ADD"), recessive ("REC"), dominant ("DOM"), or genotypic 2df ("GEN").

"NMISS" indicates the number of genotypes present in the analysis (the number of non-missing genotypes).

"OR" indicates the odds ratio (synergy index (SI)). If the odds ratio is less than one for the indicated allele (i.e., allele A1) then this indicates that this allele is associated with statin response (benefit from statin treatment), i.e., fewer CVD or CHD events (e.g., MI) were observed in individuals with this allele in the pravastatin arm of CARE or WOSCOPS or the atorvastatin arm of PROVE-IT, relative to individuals with this allele in the placebo arm of CARE or WOSCOPS or the pravastatin arm of PROVE-IT. If the odds ratio is greater than one for the indicated allele, then this indicates that the other alternative allele at the SNP (the allele which is not shown in Tables 9-11 and 14-16, but is indicated in Tables 1-2, i.e., allele A2), is associated with statin response (benefit from statin treatment).

"SE" indicates standard error of the natural log of the synergy index (the synergy index is the odds ratio, labeled "OR").

"L95" and "U95" indicates the lower and upper (respectively) 95% confidence interval for the odds ratio.

"STAT" is the test statistic used in evaluating the significance of an association in logistic regression analysis. The statistic is equal to the natural log of the synergy index divided by its standard error and follows a Gaussian distribution under the null hypothesis that the synergy index is equal to one.

"P" indicates the p-value (corresponding to a statistical test of whether the synergy index is equal to one), and "HW_PVALUE" indicates the p-value corresponding to a statistical test of whether the distribution of genotypes among subjects in the study agrees with the distribution expected according to Hardy-Weinberg equilibrium.

"ALLELE_FREQ" indicates the allele frequency of the given allele in the analyzed sample set (CARE in Tables 9 and 14; WOSCOPS in Tables 10 and 15; or PROVE-IT in Tables 11 and 16).

"PRAVA_ALLELE_FREQ" or "ATORVA_ALLELE_FREQ" indicates the allele frequency of the given allele in the pravastatin or atorvastatin-treated arms (respectively) of the CARE, WOSCOPS, or PROVE-IT trials.

"PRAVA_A1_HZ_COUNT", "PRAVA_HET_COUNT", and "PRAVA_A2_HZ_COUNT" (or, in Tables 11 and 16, "ATORVA_A1_HZ_COUNT", "ATORVA_HET_COUNT", and "ATORVA_A2_HZ_COUNT") indicate the number of homozygotes of the allele that is indicated in the table (allele A1), the number of heterozygotes, and the number of homozygotes of the other alternative allele (allele A2) at the SNP, respectively, in the pravastatin arm of the CARE trial (in Tables 9 and 14) or the WOSCOPS trial (in Tables 10 and 15), or in the atorvastatin arm of the PROVE-IT trial (in Tables 11 and 16, in which the column headings labeled "atorvastatin" ("atorva") are analogous to the column headings labeled "pravastatin" ("prava") in Tables 9-10 and 14-15).

"PLACEBO_A1_HZ_COUNT", "PLACEBO_HET_COUNT", and "PLACEBO_A2_HZ_COUNT" (or, in Tables 11 and 16, "PRAVA_A1_HZ_COUNT", "PRAVA_HET_COUNT", and "PRAVA_A2_HZ_COUNT") indicate the number of homozygotes of the allele that is indicated in the table (allele A1), the number of heterozygotes, and the number of homozygotes of the other alternative allele (allele A2) at the SNP, respectively, in the placebo arm of the CARE trial (in Tables 9 and 14) or the WOSCOPS trial (in Tables 10 and 15), or in the pravastatin arm of the PROVE-IT trial (in Tables 11 and 16, in which the column headings labeled "pravastatin" ("prava") are analogous to the column headings labeled "placebo" in Tables 9-10 and 14-15).

Notations in Tables 12-13 and 17-18 (for the meta-analysis of CARE and WOSCOPS combined, and CARE, WOSCOPS, and PROVE-IT combined) are as follows:

"SOURCE" indicates whether each SNP was genotyped or imputed.

"ALLELE" indicates the allele for which the given data (such as the OR) correspond to, which is also referred to herein as allele "A1" (and the other alternative allele at each SNP, which is not shown in Tables 12-13 and 17-18, but is shown in Tables 1-2 for each SNP, is referred to as allele "A2").

"MODEL" indicates whether the model was additive, recessive, dominant, or genotypic.

"P" indicates the p-value, and "P(R)" (or "P.R.") indicates the p-value random effect. Both of these are p-values corresponding to a statistical test of whether the combined synergy index is equal to one but use different assumptions to derive the p-value. "P" is calculated using a fixed effects model, and "P(R)" is calculated using a random effects model.

"OR" indicates the odds ratio (synergy index) calculated from a fixed effects model, and "OR(R)" (or "OR.R.") indicates the odds ratio (synergy index) calculated from a random effects model. If the odds ratio is less than one for the indicated allele (i.e., allele A1) then this indicates that this allele is associated with statin response (benefit from statin treatment), i.e., fewer CVD or CHD events (e.g., MI) were observed in individuals with this allele in a combined meta-analysis of the pravastatin arms of CARE and WOSCOPS (Tables 12 and 17) and the atorvastatin arm of PROVE-IT (Tables 13 and 18), relative to individuals with this allele in the placebo arms of CARE and WOSCOPS (Tables 12 and 17) and the pravastatin arm of PROVE-IT (Tables 13 and 18). If the odds ratio is greater than one for the indicated allele, then this indicates that the other alternative allele at the SNP (the allele which is not shown in Tables 12-13 and 17-18, but is indicated in Tables 1-2, i.e., allele A2), is associated with statin response (benefit from statin treatment).

"Q" indicates the Cochran Q test p-value, which is a p-value corresponding to the statistical test of the homogeneity of the synergy index across studies (small p-values indicate a greater degree of heterogeneity between studies).

"I" indicates the $I^2$ heterogeneity index, which can be interpreted as the proportion of total variation in the estimates of effect that is due to heterogeneity between studies.

Table 19

The analysis in Table 19 is further described in Example 2 below.

Notations in Table 19 are similar to Tables 4-7. "P.R." and "OR.R." indicate the p-value and odds ratio (synergy index), respectively, calculated from a random effects model (rather than a fixed effects model).

Table 19 shows that SNP rs11556924 (hCV31283062) in the ZC3HC1 gene is associated with differential reduction of CHD risk by pravastatin therapy in both the CARE and WOSCOPS sample sets.

Tables 20-22

The analyses in Tables 20-22 are further described in Example 3 below.

The results shown in Tables 20-22 provide support for the association of these SNPs with CVD risk and/or statin response, particularly risk for stroke and/or response to statin treatment for reducing the risk of stroke (Tables 20-21) and CHD (Table 22).

Tables 20-21 provides SNPs associated with stroke risk and/or stroke statin response (reduction in stroke risk by statin treatment) in the CARE sample set. Consistent with the CARE trial, the stroke endpoint in the analysis for which the results are provided in Tables 20-21 included stroke as well as transient ischemic attack (TIA).

Table 22 provides a SNP associated with CHD statin response in the CARE sample set. Table 22 shows that SNP rs873134 in the B4GALNT3 gene is associated with response to statin treatment for reducing the risk of CHD, particularly recurrent MI. In the analysis for which the results are provided in Table 22, the endpoint was recurrent MI, and the analysis was adjusted for age, gender, hypertension, diabetes, base LDL and HDL, and whether an individual was a current smoker.

Notations in Tables 20-22 are as follows:

In Tables 20-22, certain columns are labeled "RESP", "PLACEBO, OR "ALL". "RESP" is for statin response as measured by comparing risk (risk for stroke, including TIA, in Tables 20-21, and risk for CHD, specifically recurrent MI, in Table 22) in the pravastatin-treated group with risk in the placebo-treated group, "PLACEBO" is the placebo-treated group, and "ALL" is the combination of the placebo-treated group and the pravastatin-treated group. "RESP" is the analysis to assess statin response in the indicated genotype group.

"MODE" indicates whether the model was additive ("ADD"), recessive ("REC"), dominant ("DOM"), or genotypic ("GEN").

"mAF CEU" (Table 20 only) indicates the frequency of the minor allele in HapMap for Europeans.

"GENO" indicates the genotype.

"STATIN" indicates either the pravastatin-treated ("Pravastatin") or placebo-treated ("Placebo") groups (i.e., arms of the CARE trial).

"EVENTS" indicates the total number of events (stroke or TIA for Tables 20-21, and recurrent MI for Table 22) in individuals with the indicated genotype.

"TOTAL" indicates the total number of individuals with the indicated genotype.

"HR" indicates the hazard ratio.

"L95" and "U95" indicates the lower and upper (respectively) 95% confidence interval for the hazard ratio.

"P" indicates the p-value, "P_INT" indicates p-interaction, "P_DF2" indicates two degrees of freedom p-value, and "HW(ALL)pExact" (Table 21 only) indicates p exact for Hardy Weinberg Equilibrium for the ALL group.

Throughout Tables 4-22, "OR" refers to the odds ratio, "HR" refers to the hazard ratio, and "OR L95" or "OR U95" refers to the lower and upper (respectively) 95% confidence interval for the odds ratio or hazard ratio. With respect to drug response (e.g., response to a statin), if the OR or HR of those treated with the drug (e.g., a statin) compared with those treated with a placebo within a particular genotype (or with a particular allele) is less than one, this indicates that an individual with this particular genotype or allele would benefit from the drug (an OR or HR equal to one would indicate that the drug has no effect). In contrast, with respect to drug response, if the OR or HR is greater than one for a particular allele, then this indicates that an individual with the other alternative allele would benefit from the drug. As used herein, the term "benefit" (with respect to a preventive or therapeutic drug treatment) is defined as achieving a reduced risk for a disease that the drug is intended to treat or prevent (e.g., CVD such as CHD, particularly MI) by administering the drug treatment, compared with the risk for the disease in the absence of receiving the drug treatment (or receiving a placebo in lieu of the drug treatment) for the same genotype.

With respect to disease risk, an OR or HR that is greater than one indicates that a given allele is a risk allele (which may also be referred to as a susceptibility allele), whereas an OR or HR that is less than one indicates that a given allele is a non-risk allele (which may also be referred to as a protective allele). For a given risk allele, the other alternative allele at the SNP position (which can be derived from the information provided in Tables 1-2, for example) may be considered a non-risk allele. For a given non-risk allele, the other alternative allele at the SNP position may be considered a risk allele. Thus, with respect to disease risk, if the OR or HR for a particular allele at a SNP position is greater than one, this indicates that an individual with this particular allele has a higher risk for the disease than an individual who has the other allele at the SNP position. In contrast, if the OR or HR for a particular allele is less than one, this indicates that an individual with this particular allele has a reduced risk for the disease compared with an individual who has the other allele at the SNP position.

DETAILED DESCRIPTION OF THE INVENTION

Exemplary embodiments of the present invention provide SNPs associated with response to statin treatment, particularly for reducing the risk of CVD (especially CHD, such as MI and other coronary events, as well as cerebrovascular events such as stroke), and methods for their use. The present invention further provides nucleic acid molecules containing these SNPs, methods and reagents for the detection of the SNPs disclosed herein, uses of these SNPs for the development of detection reagents, and assays or kits that utilize such reagents. The statin response-associated SNPs disclosed herein are particularly useful for predicting, screening for, and evaluating response to statin treatment, particularly for prevention or treatment of CVD (particularly CHD, such as MI and other coronary events, as well as cerebrovascular events such as stroke) using statins, in humans. The SNPs disclosed herein are also useful for diagnosing, prognosing, screening for, and evaluating predisposition to CVD, particularly CHD (such as MI) as well as cerebrovascular events such as stroke, in humans. Furthermore, such SNPs and their encoded products are useful targets for the development of therapeutic and preventive agents.

Thus, exemplary embodiments of the present invention provide individual SNPs associated with response to statin treatments, particularly for reducing the risk of CVD (especially CHD, such as MI and other coronary events, as well as cerebrovascular events such as stroke), as well as combinations of SNPs and haplotypes, polymorphic/variant transcript sequences (SEQ ID NOS: 1-51) and genomic sequences (SEQ ID NOS: 177-622) containing SNPs, encoded amino acid sequences (SEQ ID NOS: 52-102), and both transcript-based SNP context sequences (SEQ ID NOS: 103-176) and genomic-based SNP context sequences (SEQ ID NOS: 623-3661) (transcript sequences, protein sequences, and transcript-based SNP context sequences are provided in Table 1 and the Sequence Listing; genomic sequences and genomic-based SNP context sequences are provided in Table 2 and the Sequence Listing), methods of detecting these polymorphisms in a test sample, methods of determining if an individual is likely to respond to a particular treatment such as statins (particularly for treating or preventing CVD, such as CHD or stroke), methods of determining an individual's risk for developing CVD, methods of screening for compounds useful for treating CVD, compounds identified by these screening methods, methods of using the disclosed SNPs to select a treatment/preventive strategy or therapeutic agent, and methods of treating or preventing CVD.

Exemplary embodiments of the present invention further provide methods for selecting or formulating a treatment regimen (e.g., methods for determining whether or not to administer statin treatment to an individual having CVD, or who is at risk for developing CVD in the future, or who has previously had CVD, methods for selecting a particular statin-based treatment regimen such as dosage and frequency of administration of statin, or a particular form/type of statin such as a particular pharmaceutical formulation or statin compound, methods for administering (either in addition to or instead of a statin) an alternative, non-statin-based treatment, such as niacin, fibrates, or ezetimibe (e.g., Zetia® or Ezetrol®), to individuals who are predicted to be unlikely to respond positively to statin treatment, etc.), and methods for determining the likelihood of experiencing toxicity or other undesirable side effects from statin treatment, etc. The present invention also provides methods for selecting individuals to whom a statin or other therapeutic will be administered based on the individual's genotype, and methods for selecting individuals for a clinical trial of a statin or other therapeutic agent based on the genotypes of the individuals (e.g., selecting individuals to participate in the trial who are most likely to respond positively from the statin treatment and/or excluding individuals from the trial who are unlikely to respond positively from the statin treatment based on their SNP genotype(s), or selecting individuals who are unlikely to respond positively to statins based on their SNP genotype(s) to participate in a clinical trial of another type of drug that may benefit them).

Exemplary embodiments of the present invention may include novel SNPs associated with response to statin treatment, as well as SNPs that were previously known in the art, but were not previously known to be associated with response to statin treatment. Accordingly, the present invention may provide novel compositions and methods based on novel SNPs disclosed herein, and may also provide novel methods of using known, but previously unassociated, SNPs in methods relating to, for example, methods relating to evaluating an individual's likelihood of responding to statin treatment (particularly statin treatment, including preventive treatment, of CVD, such as CHD or stroke), evaluating an individual's likelihood of having or developing CVD (particularly CHD or stroke), and predicting the likelihood of an individual experiencing a reccurrence of CVD (e.g., experiencing recurrent MI). In Tables 1 and 2, known SNPs are identified based on the public database in which they have been observed, which is indicated as one or more of the following SNP types: "dbSNP"=SNP observed in dbSNP, "HGBASE"=SNP observed in HGBASE, and "HGMD"=SNP observed in the Human Gene Mutation Database (HGMD).

Particular alleles of the SNPs disclosed herein can be associated with either an increased likelihood of responding to statin treatment (particularly for reducing the risk of CVD, such as CHD (e.g., MI) or stroke) or increased risk of developing CVD (e.g., CHD or stroke), or a decreased likelihood of responding to statin treatment or a decreased risk of developing CVD. Thus, whereas certain SNPs (or their encoded products) can be assayed to determine whether an individual possesses a SNP allele that is indicative of an increased likelihood of responding to statin treatment or an increased risk of developing CVD, other SNPs (or their encoded products) can be assayed to determine whether an individual possesses a SNP allele that is indicative of a decreased likelihood of responding to statin treatment or a decreased risk of developing CVD. Similarly, particular alleles of the SNPs disclosed herein can be associated with either an increased or decreased likelihood of having a reccurrence of CVD (e.g., recurrent MI), etc. The term "altered" may be used herein to encompass either of these two possibilities (e.g., either an increased or a decreased likelihood/risk).

SNP alleles that are associated with increased response to statin treatment for reducing CVD risk (benefit from statin treatment) may be referred to as "response" alleles, and SNP alleles that are associated with a lack of response to statin treatment may be referred to as "non-response" alleles. SNP alleles that are associated with an increased risk of having or developing CVD may be referred to as "risk" or "susceptibility" alleles, and SNP alleles that are associated with a decreased risk of having or developing CVD may be referred to as "non-risk" or "protective" alleles.

In certain embodiments, the presence of a statin response allele disclosed herein in Tables 4-22 (an allele associated with increased response to statin treatment for reducing CVD or CHD risk) is detected and indicates that an individual has an increased risk for developing CVD, such as CHD (e.g., MI) or stroke. In these embodiments, in which the same allele is associated with both increased risk for developing CVD and increased response to statin treatment (i.e., the same allele is both a risk and a response allele), this increased risk for developing CVD can be reduced by administering statin treatment to an individual having the allele.

Those skilled in the art will readily recognize that nucleic acid molecules may be double-stranded molecules and that reference to a particular site on one strand refers, as well, to the corresponding site on a complementary strand. In defining a SNP position, SNP allele, or nucleotide sequence, reference to an adenine, a thymine (uridine), a cytosine, or a guanine at a particular site on one strand of a nucleic acid molecule also defines the thymine (uridine), adenine, guanine, or cytosine (respectively) at the corresponding site on a complementary strand of the nucleic acid molecule. Thus, reference may be made to either strand in order to refer to a particular SNP position, SNP allele, or nucleotide sequence. Probes and primers, may be designed to hybridize to either strand and SNP genotyping methods disclosed herein may generally target either strand. Throughout the specification, in identifying a SNP position, reference is generally made to the protein-encoding strand, only for the purpose of convenience.

References to variant peptides, polypeptides, or proteins of the present invention include peptides, polypeptides, proteins, or fragments thereof, that contain at least one amino acid residue that differs from the corresponding amino acid sequence of the art-known peptide/polypeptide/ protein (the art-known protein may be interchangeably referred to as the "wild-type," "reference," or "normal" protein). Such variant peptides/polypeptides/proteins can result from a codon change caused by a nonsynonymous nucleotide substitution at a protein-coding SNP position (i.e., a missense mutation) disclosed by the present invention. Variant peptides/polypeptides/proteins of the present invention can also result from a nonsense mutation (i.e., a SNP that creates a premature stop codon, a SNP that generates a read-through mutation by abolishing a stop codon), or due to any SNP disclosed by the present invention that otherwise alters the structure, function, activity, or expression of a protein, such as a SNP in a regulatory region (e.g. a promoter or enhancer) or a SNP that leads to alternative or defective splicing, such as a SNP in an intron or a SNP at an exon/intron boundary. As used herein, the terms "polypeptide," "peptide," and "protein" are used interchangeably.

As used herein, an "allele" may refer to a nucleotide at a SNP position (wherein at least two alternative nucleotides exist in the population at the SNP position, in accordance with the inherent definition of a SNP) or may refer to an amino acid residue that is encoded by the codon which contains the SNP position (where the alternative nucleotides that are present in the population at the SNP position form alternative codons that encode different amino acid residues). An "allele" may also be referred to herein as a "variant". Also, an amino acid residue that is encoded by a codon containing a particular SNP may simply be referred to as being encoded by the SNP.

A phrase such as "as represented by", "as shown by", "as symbolized by", or "as designated by" may be used herein to refer to a SNP within a sequence (e.g., a polynucleotide context sequence surrounding a SNP), such as in the context of "a polymorphism as represented by position 101 of SEQ ID NO: X or its complement". Typically, the sequence surrounding a SNP may be recited when referring to a SNP, however the sequence is not intended as a structural limitation beyond the specific SNP position itself. Rather, the sequence is recited merely as a way of referring to the SNP (in this example, "SEQ ID NO: X or its complement" is recited in order to refer to the SNP located at position 101 of SEQ ID NO: X, but SEQ ID NO: X or its complement is not intended as a structural limitation beyond the specific SNP position itself). In other words, it is recognized that the context sequence of SEQ ID NO: X in this example may contain one or more polymorphic nucleotide positions outside of position 101 and therefore an exact match over the full-length of SEQ ID NO: X is irrelevant since SEQ ID NO: X is only meant to provide context for referring to the SNP at position 101 of SEQ ID NO: X. Likewise, the length of the context sequence is also irrelevant (100 nucleotides on each side of a SNP position has been arbitrarily used in the present application as the length for context sequences merely for convenience and because 201 nucleotides of total length is expected to provide sufficient uniqueness to unambiguously identify a given nucleotide sequence). Thus, since a SNP is a variation at a single nucleotide position, it is customary to refer to context sequence (e.g., SEQ ID NO: X in this example) surrounding a particular SNP position in order to uniquely identify and refer to the SNP. Alternatively, a SNP can be referred to by a unique identification number such as a public "rs" identification number or an internal "hCV" identification number, such as provided herein for each SNP (e.g., in Tables 1-2). For example, in the instant application, "rs11556924", "hCV31283062", and "position 101 of SEQ ID NO: 1074" all refer to the same SNP.

As used herein, the term "benefit" (with respect to a preventive or therapeutic drug treatment, such as statin treatment) is defined as achieving a reduced risk for a disease that the drug is intended to treat or prevent (e.g., CVD such as CHD (particularly MI) or stroke) by administrating the drug treatment, compared with the risk for the disease in the absence of receiving the drug treatment (or receiving a placebo in lieu of the drug treatment) for the same genotype. The term "benefit" may be used herein interchangeably with terms such as "respond positively" or "positively respond".

As used herein, the terms "drug" and "therapeutic agent" are used interchangeably, and may include, but are not limited to, small molecule compounds, biologics (e.g., antibodies, proteins, protein fragments, fusion proteins, glycoproteins, etc.), nucleic acid agents (e.g., antisense, RNAi/ siRNA, and microRNA molecules, etc.), vaccines, etc., which may be used for therapeutic and/or preventive treatment of a disease (e.g., CVD such as CHD or stroke).

Examples of statins (also known as HMG-CoA reductase inhibitors) include, but are not limited to, atorvastatin (Lipitor®), rosuvastatin (Crestor®), pravastatin (Pravachol®), simvastatin (Zocor®), fluvastatin (Lescol®), and lovastatin (Mevacor®), as well as combination therapies that include a statin such as simvastatin+ezetimibe (Vytorin®), lovastatin+ niacin (Advicor®), atorvastatin+amlodipine besylate (Caduet®), and simvastatin+niacin (Simcor®).

Certain exemplary embodiments of the invention provide the following compositions and uses: (1) a reagent (such as an allele-specific probe or primer, or any other oligonucleotide or other reagent suitable for detecting a polymorphism disclosed herein, which can include detection of any allele of the polymorphism) for use as a diagnostic or predictive agent for determining statin response, particularly for reducing the risk of CVD such as CHD (e.g., MI) or stroke (and/or for determining risk for developing CVD); (2) a kit, device, array, or assay component that includes or is coupled with the reagent of (1) above for use in determining statin response, particularly for reducing the risk of CVD (and/or for determining risk for developing CVD); (3) the use of the reagent of (1) above for the manufacture of a kit, device, array, or assay component for determining statin response, particularly for reducing the risk of CVD (and/or for determining risk for CVD); and (4) the use of a polymorphism disclosed herein for the manufacture of a reagent for use as a diagnostic or predictive agent for determining statin response, particularly for reducing the risk of CVD (and/or for determining risk for developing CVD).

The various methods described herein, such as correlating the presence or absence of a polymorphism with the predicted response of an individual to a drug such as a statin, particularly for reducing the risk for CVD such as CHD (e.g., MI) or stroke (and/or correlating the presence or absence of a polymorphism with an altered (e.g., increased or decreased) risk (or no altered risk) for developing CVD), can be carried out by automated methods such as by using a computer (or other apparatus/devices such as biomedical devices, laboratory instrumentation, or other apparatus/devices having a computer processor) programmed to carry out any of the methods described herein. For example, computer software (which may be interchangeably referred to herein as a computer program) can perform the step of correlating the presence or absence of a polymorphism in an individual with an altered (e.g., increased or decreased) response (or no altered response) to statin treatment, particularly for reducing the risk for CVD such as CHD (e.g., MI) or stroke. Accordingly, certain embodiments of the invention provide a computer (or other apparatus/device) programmed to carry out any of the methods described herein.

Reports, Programmed Computers, Business Methods, and Systems

The results of a test (e.g., an individual's predicted responsiveness to statin treatment for reducing CVD risk, or an individual's risk for developing CVD, based on assaying one or more SNPs disclosed herein, and/or an individual's allele(s)/genotype at one or more SNPs disclosed herein, etc.), and/or any other information pertaining to a test, may be referred to herein as a "report". A tangible report can optionally be generated as part of a testing process (which may be interchangeably referred to herein as "reporting", or as "providing" a report, "producing" a report, or "generating" a report).

Examples of tangible reports may include, but are not limited to, reports in paper (such as computer-generated printouts of test results) or equivalent formats and reports stored on computer readable medium (such as a CD, USB flash drive or other removable storage device, computer hard drive, or computer network server, etc.). Reports, particularly those stored on computer readable medium, can be part of a database, which may optionally be accessible via the internet (such as a database of patient records or genetic information stored on a computer network server, which may be a "secure database" that has security features that limit access to the report, such as to allow only the patient and the patient's medical practioners to view the report while preventing other unauthorized individuals from viewing the report, for example). In addition to, or as an alternative to, generating a tangible report, reports can also be displayed on a computer screen (or the display of another electronic device or instrument).

A report can include, for example, an individual's predicted responsiveness to statin treatment (e.g., whether the individual will benefit from statin treatment by having their risk for CVD, particularly CHD (e.g., MI) or stroke, reduced), or may just include the allele(s)/genotype that an individual carries at one or more SNPs disclosed herein, which may optionally be linked to information regarding the significance of having the allele(s)/genotype at the SNP (for example, a report on computer readable medium such as a network server may include hyperlink(s) to one or more journal publications or websites that describe the medical/biological implications, such as statin response and/or CVD risk, for individuals having a certain allele/genotype at the SNP). Thus, for example, the report can include drug responsiveness, disease risk, and/or other medical/biological significance, as well as optionally also including the allele/genotype information, or the report may just include allele/genotype information without including drug responsiveness, disease risk, or other medical/biological significance (such that an individual viewing the report can use the allele/genotype information to determine the associated drug response, disease risk, or other medical/biological significance from a source outside of the report itself, such as from a medical practioner, publication, website, etc., which may optionally be linked to the report such as by a hyperlink).

A report can further be "transmitted" or "communicated" (these terms may be used herein interchangeably), such as to the individual who was tested, a medical practitioner (e.g., a doctor, nurse, clinical laboratory practitioner, genetic counselor, etc.), a healthcare organization, a clinical laboratory, and/or any other party or requester intended to view or possess the report. The act of "transmitting" or "communicating" a report can be by any means known in the art, based on the format of the report. Furthermore, "transmitting" or "communicating" a report can include delivering/sending a report ("pushing") and/or retrieving ("pulling") a report. For example, reports can be transmitted/communicated by various means, including being physically transferred between parties (such as for reports in paper format) such as by being physically delivered from one party to another, or by being transmitted electronically or in signal form (e.g., via e-mail or over the internet, by facsimile, and/or by any wired or wireless communication methods known in the art) such as by being retrieved from a database stored on a computer network server, etc.

In certain exemplary embodiments, the invention provides computers (or other apparatus/devices such as biomedical devices or laboratory instrumentation) programmed to carry out the methods described herein. For example, in certain embodiments, the invention provides a computer programmed to receive (i.e., as input) the identity (e.g., the allele(s) or genotype at a SNP) of one or more SNPs disclosed herein and provide (i.e., as output) the predicted drug responsiveness or disease risk (e.g., an individual's predicted statin responsiveness or risk for developing CVD) or other result based on the identity of the SNP(s). Such output (e.g., communication of disease risk, disease diagnosis or prognosis, drug responsiveness, etc.) may be, for example, in the form of a report on computer readable medium, printed in paper form, and/or displayed on a computer screen or other display.

In various exemplary embodiments, the invention further provides methods of doing business (with respect to methods of doing business, the terms "individual" and "customer" are used herein interchangeably). For example, exemplary methods of doing business can comprise assaying one or more SNPs disclosed herein and providing a report that includes, for example, a customer's predicted response to statin treatment (e.g., for reducing their risk for CVD, particularly CHD (such as MI) or stroke) or their risk for developing CVD (based on which allele(s)/genotype is present at the assayed SNP(s)) and/or that includes the allele(s)/genotype at the assayed SNP(s) which may optionally be linked to information (e.g., journal publications, websites, etc.) pertaining to disease risk or other biological/medical significance such as by means of a hyperlink (the report may be provided, for example, on a computer network server or other computer readable medium that is internet-accessible, and the report may be included in a secure database that allows the customer to access their report while preventing other unauthorized individuals from viewing the report), and optionally transmitting the report. Customers (or another party who is associated with the customer, such as the customer's doctor, for example) can request/order (e.g., purchase) the test online via the internet (or by phone, mail order, at an outlet/store, etc.), for example, and a kit can be sent/delivered (or otherwise provided) to the customer (or another party on behalf of the customer, such as the customer's doctor, for example) for collection of a biological sample from the customer (e.g., a buccal swab for collecting buccal cells), and the customer (or a party who collects the customer's biological sample)

can submit their biological samples for assaying (e.g., to a laboratory or party associated with the laboratory such as a party that accepts the customer samples on behalf of the laboratory, a party for whom the laboratory is under the control of (e.g., the laboratory carries out the assays by request of the party or under a contract with the party, for example), and/or a party that receives at least a portion of the customer's payment for the test). The report (e.g., results of the assay including, for example, the customer's disease risk and/or allele(s)/genotype at the assayed SNP(s)) may be provided to the customer by, for example, the laboratory that assays the SNP(s) or a party associated with the laboratory (e.g., a party that receives at least a portion of the customer's payment for the assay, or a party that requests the laboratory to carry out the assays or that contracts with the laboratory for the assays to be carried out) or a doctor or other medical practitioner who is associated with (e.g., employed by or having a consulting or contracting arrangement with) the laboratory or with a party associated with the laboratory, or the report may be provided to a third party (e.g., a doctor, genetic counselor, hospital, etc.) which optionally provides the report to the customer. In further embodiments, the customer may be a doctor or other medical practitioner, or a hospital, laboratory, medical insurance organization, or other medical organization that requests/orders (e.g., purchases) tests for the purposes of having other individuals (e.g., their patients or customers) assayed for one or more SNPs disclosed herein and optionally obtaining a report of the assay results.

In certain exemplary methods of doing business, a kit for collecting a biological sample (e.g., a buccal swab for collecting buccal cells, or other sample collection device) is provided to a medical practitioner (e.g., a physician) which the medical practitioner uses to obtain a sample (e.g., buccal cells, saliva, blood, etc.) from a patient, the sample is then sent to a laboratory (e.g., a CLIA-certified laboratory) or other facility that tests the sample for one or more SNPs disclosed herein (e.g., to determine the genotype of one or more SNPs disclosed herein, such as to determine the patient's predicted response to statin treatment for reducing their risk for CVD, particularly CHD (such as MI) or stroke, and/or their risk for developing CVD), and the results of the test (e.g., the patient's genotype at one or more SNPs disclosed herein and/or the patient's predicted statin response or CVD risk based on their SNP genotype) are provided back to the medical practitioner (and/or directly to the patient and/or to another party such as a hospital, medical insurance company, genetic counselor, etc.) who may then provide or otherwise convey the results to the patient. The results are typically provided in the form of a report, such as described above.

In certain further exemplary methods of doing business, kits for collecting a biological sample from a customer (e.g., a buccal swab for collecting buccal cells, or other sample collection device) are provided (e.g., for sale), such as at an outlet (e.g., a drug store, pharmacy, general merchandise store, or any other desirable outlet), online via the internet, by mail order, etc., whereby customers can obtain (e.g., purchase) the kits, collect their own biological samples, and submit (e.g., send/deliver via mail) their samples to a laboratory (e.g., a CLIA-certified laboratory) or other facility which tests the samples for one or more SNPs disclosed herein (e.g., to determine the genotype of one or more SNPs disclosed herein, such as to determine the customer's predicted response to statin treatment for reducing their risk for CVD, particularly CHD (e.g., MI) or stroke, and/or their risk for developing CVD) and provides the results of the test (e.g., of the customer's genotype at one or more SNPs disclosed herein and/or the customer's statin response or CVD risk based on their SNP genotype) back to the customer and/or to a third party (e.g., a physician or other medical practitioner, hospital, medical insurance company, genetic counselor, etc.). The results are typically provided in the form of a report, such as described above. If the results of the test are provided to a third party, then this third party may optionally provide another report to the customer based on the results of the test (e.g., the result of the test from the laboratory may provide the customer's genotype at one or more SNPs disclosed herein without statin response or CVD risk information, and the third party may provide a report of the customer's statin response or CVD risk based on this genotype result).

Certain further embodiments of the invention provide a system for determining whether an individual will benefit from statin treatment (or other therapy) in reducing CVD risk (particularly risk for CHD (such as MI) or stroke), or for determining an individual's risk for developing CVD. Certain exemplary systems comprise an integrated "loop" in which an individual (or their medical practitioner) requests a determination of such individual's predicted statin response (or CVD risk, etc.), this determination is carried out by testing a sample from the individual, and then the results of this determination are provided back to the requestor. For example, in certain systems, a sample (e.g., buccal cells, saliva, blood, etc.) is obtained from an individual for testing (the sample may be obtained by the individual or, for example, by a medical practitioner), the sample is submitted to a laboratory (or other facility) for testing (e.g., determining the genotype of one or more SNPs disclosed herein), and then the results of the testing are sent to the patient (which optionally can be done by first sending the results to an intermediary, such as a medical practioner, who then provides or otherwise conveys the results to the individual and/or acts on the results), thereby forming an integrated loop system for determining an individual's predicted statin response (or CVD risk, etc.). The portions of the system in which the results are transmitted (e.g., between any of a testing facility, a medical practitioner, and/or the individual) can be carried out by way of electronic or signal transmission (e.g., by computer such as via e-mail or the internet, by providing the results on a website or computer network server which may optionally be a secure database, by phone or fax, or by any other wired or wireless transmission methods known in the art). Optionally, the system can further include a risk reduction component (i.e., a disease management system) as part of the integrated loop (for an example of a disease management system, see U.S. Pat. No. 6,770,029, "Disease management system and method including correlation assessment"). For example, the results of the test can be used to reduce the risk of the disease in the individual who was tested, such as by implementing a preventive therapy regimen (e.g., administration of a statin or other drug for reducing CVD risk), modifying the individual's diet, increasing exercise, reducing stress, and/or implementing any other physiological or behavioral modifications in the individual with the goal of reducing disease risk. For reducing CVD risk, this may include any means used in the art for improving aspects of an individual's health relevant to reducing CVD risk. Thus, in exemplary embodiments, the system is controlled by the individual and/or their medical practioner in that the individual and/or their medical practioner requests the test, receives the test results back, and (optionally) acts on the test results to reduce the individual's disease risk, such as by implementing a disease management system.

Isolated Nucleic Acid Molecules and SNP Detection Reagents & Kits

Tables 1 and 2 provide a variety of information about each SNP of the present invention that is associated with response to statin treatment, particularly for reducing an individual's risk for CVD such as CHD (e.g., MI) or stroke, including the transcript sequences (SEQ ID NOS: 1-51), genomic sequences (SEQ ID NOS: 177-622), and protein sequences (SEQ ID NOS: 52-102) of the encoded gene products (with the SNPs indicated by IUB codes in the nucleic acid sequences). In addition, Tables 1 and 2 include SNP context sequences, which generally include 100 nucleotide upstream (5') plus 100 nucleotides downstream (3') of each SNP position (SEQ ID NOS: 103-176 correspond to transcript-based SNP context sequences disclosed in Table 1, and SEQ ID NOS: 623-3661 correspond to genomic-based context sequences disclosed in Table 2), the alternative nucleotides (alleles) at each SNP position, and additional information about the variant where relevant, such as SNP type (coding, missense, splice site, UTR, etc.), human populations in which the SNP was observed, observed allele frequencies, information about the encoded protein, etc.

Isolated Nucleic Acid Molecules

Exemplary embodiments of the invention provide isolated nucleic acid molecules that contain one or more SNPs disclosed herein, particularly SNPs disclosed in Table 1 and/or Table 2. Isolated nucleic acid molecules containing one or more SNPs disclosed herein (such as in at least one of Tables 1 and 2) may be interchangeably referred to throughout the present text as "SNP-containing nucleic acid molecules." Isolated nucleic acid molecules may optionally encode a full-length variant protein or fragment thereof. The isolated nucleic acid molecules of the present invention also include probes and primers (which are described in greater detail below in the section entitled "SNP Detection Reagents"), which may be used for assaying the disclosed SNPs, and isolated full-length genes, transcripts, cDNA molecules, and fragments thereof, which may be used for such purposes as expressing an encoded protein.

As used herein, an "isolated nucleic acid molecule" generally is one that contains a SNP of the present invention or one that hybridizes to such molecule such as a nucleic acid with a complementary sequence, and is separated from most other nucleic acids present in the natural source of the nucleic acid molecule. Moreover, an "isolated" nucleic acid molecule, such as a cDNA molecule containing a SNP of the present invention, can be substantially free of other cellular material, or culture medium when produced by recombinant techniques, or chemical precursors or other chemicals when chemically synthesized. A nucleic acid molecule can be fused to other coding or regulatory sequences and still be considered "isolated." Nucleic acid molecules present in non-human transgenic animals, which do not naturally occur in the animal, are also considered "isolated." For example, recombinant DNA molecules contained in a vector are considered "isolated." Further examples of "isolated" DNA molecules include recombinant DNA molecules maintained in heterologous host cells, and purified (partially or substantially) DNA molecules in solution. Isolated RNA molecules include in vivo or in vitro RNA transcripts of the isolated SNP-containing DNA molecules of the present invention. Isolated nucleic acid molecules according to the present invention further include such molecules produced synthetically.

Generally, an isolated SNP-containing nucleic acid molecule comprises one or more SNP positions disclosed by the present invention with flanking nucleotide sequences on either side of the SNP positions. A flanking sequence can include nucleotide residues that are naturally associated with the SNP site and/or heterologous nucleotide sequences. Preferably, the flanking sequence is up to about 500, 300, 100, 60, 50, 30, 25, 20, 15, 10, 8, or 4 nucleotides (or any other length in-between) on either side of a SNP position, or as long as the full-length gene or entire protein-coding sequence (or any portion thereof such as an exon), especially if the SNP-containing nucleic acid molecule is to be used to produce a protein or protein fragment.

For full-length genes and entire protein-coding sequences, a SNP flanking sequence can be, for example, up to about 5 KB, 4 KB, 3 KB, 2 KB, 1 KB on either side of the SNP. Furthermore, in such instances the isolated nucleic acid molecule comprises exonic sequences (including protein-coding and/or non-coding exonic sequences), but may also include intronic sequences. Thus, any protein coding sequence may be either contiguous or separated by introns. The important point is that the nucleic acid is isolated from remote and unimportant flanking sequences and is of appropriate length such that it can be subjected to the specific manipulations or uses described herein such as recombinant protein expression, preparation of probes and primers for assaying the SNP position, and other uses specific to the SNP-containing nucleic acid sequences.

An isolated SNP-containing nucleic acid molecule can comprise, for example, a full-length gene or transcript, such as a gene isolated from genomic DNA (e.g., by cloning or PCR amplification), a cDNA molecule, or an mRNA transcript molecule. Polymorphic transcript sequences are referred to in Table 1 and provided in the Sequence Listing (SEQ ID NOS: 1-51), and polymorphic genomic sequences are referred to in Table 2 and provided in the Sequence Listing (SEQ ID NOS: 177-622). Furthermore, fragments of such full-length genes and transcripts that contain one or more SNPs disclosed herein are also encompassed by the present invention, and such fragments may be used, for example, to express any part of a protein, such as a particular functional domain or an antigenic epitope.

Thus, the present invention also encompasses fragments of the nucleic acid sequences as disclosed in Tables 1 and 2 (transcript sequences are referred to in Table 1 as SEQ ID NOS: 1-51, genomic sequences are referred to in Table 2 as SEQ ID NOS: 177-622, transcript-based SNP context sequences are referred to in Table 1 as SEQ ID NOS: 103-176, and genomic-based SNP context sequences are referred to in Table 2 as SEQ ID NOS: 623-3661) and their complements. The actual sequences referred to in the tables are provided in the Sequence Listing. A fragment typically comprises a contiguous nucleotide sequence at least about 8 or more nucleotides, more preferably at least about 12 or more nucleotides, and even more preferably at least about 16 or more nucleotides. Furthermore, a fragment could comprise at least about 18, 20, 22, 25, 30, 40, 50, 60, 80, 100, 150, 200, 250 or 500 nucleotides in length (or any other number in between). The length of the fragment will be based on its intended use. For example, the fragment can encode epitope-bearing regions of a variant peptide or regions of a variant peptide that differ from the normal/wild-type protein, or can be useful as a polynucleotide probe or primer. Such fragments can be isolated using the nucleotide sequences provided in Table 1 and/or Table 2 for the synthesis of a polynucleotide probe. A labeled probe can then be used, for example, to screen a cDNA library, genomic DNA library, or mRNA to isolate nucleic acid corresponding to the coding region. Further, primers can be used in amplification reactions, such as for purposes of assaying one or more SNPs sites or for cloning specific regions of a gene.

An isolated nucleic acid molecule of the present invention further encompasses a SNP-containing polynucleotide that is the product of any one of a variety of nucleic acid amplification methods, which are used to increase the copy numbers of a polynucleotide of interest in a nucleic acid sample. Such amplification methods are well known in the art, and they include but are not limited to, polymerase chain reaction (PCR) (U.S. Pat. Nos. 4,683,195 and 4,683,202; PCR Technology: *Principles and Applications for DNA Amplification*, ed. H. A. Erlich, Freeman Press, NY, N.Y. (1992)), ligase chain reaction (LCR) (Wu and Wallace, *Genomics* 4:560 (1989); Landegren et al., *Science* 241:1077 (1988)), strand displacement amplification (SDA) (U.S. Pat. Nos. 5,270,184 and 5,422,252), transcription-mediated amplification (TMA) (U.S. Pat. No. 5,399,491), linked linear amplification (LLA) (U.S. Pat. No. 6,027,923) and the like, and isothermal amplification methods such as nucleic acid sequence based amplification (NASBA) and self-sustained sequence replication (Guatelli et al., *Proc Natl Acad Sci USA* 87:1874 (1990)). Based on such methodologies, a person skilled in the art can readily design primers in any suitable regions 5' and 3' to a SNP disclosed herein. Such primers may be used to amplify DNA of any length so long that it contains the SNP of interest in its sequence.

As used herein, an "amplified polynucleotide" of the invention is a SNP-containing nucleic acid molecule whose amount has been increased at least two fold by any nucleic acid amplification method performed in vitro as compared to its starting amount in a test sample. In other preferred embodiments, an amplified polynucleotide is the result of at least ten fold, fifty fold, one hundred fold, one thousand fold, or even ten thousand fold increase as compared to its starting amount in a test sample. In a typical PCR amplification, a polynucleotide of interest is often amplified at least fifty thousand fold in amount over the unamplified genomic DNA, but the precise amount of amplification needed for an assay depends on the sensitivity of the subsequent detection method used.

Generally, an amplified polynucleotide is at least about 16 nucleotides in length. More typically, an amplified polynucleotide is at least about 20 nucleotides in length. In a preferred embodiment of the invention, an amplified polynucleotide is at least about 30 nucleotides in length. In a more preferred embodiment of the invention, an amplified polynucleotide is at least about 32, 40, 45, 50, or 60 nucleotides in length. In yet another preferred embodiment of the invention, an amplified polynucleotide is at least about 100, 200, 300, 400, or 500 nucleotides in length. While the total length of an amplified polynucleotide of the invention can be as long as an exon, an intron or the entire gene where the SNP of interest resides, an amplified product is typically up to about 1,000 nucleotides in length (although certain amplification methods may generate amplified products greater than 1000 nucleotides in length). More preferably, an amplified polynucleotide is not greater than about 600-700 nucleotides in length. It is understood that irrespective of the length of an amplified polynucleotide, a SNP of interest may be located anywhere along its sequence.

In a specific embodiment of the invention, the amplified product is at least about 201 nucleotides in length, comprises one of the transcript-based context sequences or the genomic-based context sequences shown in Tables 1 and 2. Such a product may have additional sequences on its 5' end or 3' end or both. In another embodiment, the amplified product is about 101 nucleotides in length, and it contains a SNP disclosed herein. Preferably, the SNP is located at the middle of the amplified product (e.g., at position 101 in an amplified product that is 201 nucleotides in length, or at position 51 in an amplified product that is 101 nucleotides in length), or within 1, 2, 3, 4, 5, 6, 7, 8, 9, 10, 12, 15, or 20 nucleotides from the middle of the amplified product. However, as indicated above, the SNP of interest may be located anywhere along the length of the amplified product.

The present invention provides isolated nucleic acid molecules that comprise, consist of, or consist essentially of one or more polynucleotide sequences that contain one or more SNPs disclosed herein, complements thereof, and SNP-containing fragments thereof.

Accordingly, the present invention provides nucleic acid molecules that consist of any of the nucleotide sequences shown in Table 1 and/or Table 2 (transcript sequences are referred to in Table 1 as SEQ ID NOS: 1-51, genomic sequences are referred to in Table 2 as SEQ ID NOS: 177-622, transcript-based SNP context sequences are referred to in Table 1 as SEQ ID NOS: 103-176, and genomic-based SNP context sequences are referred to in Table 2 as SEQ ID NOS: 623-3661), or any nucleic acid molecule that encodes any of the variant proteins referred to in Table 1 (SEQ ID NOS: 52-102). The actual sequences referred to in the tables are provided in the Sequence Listing. A nucleic acid molecule consists of a nucleotide sequence when the nucleotide sequence is the complete nucleotide sequence of the nucleic acid molecule.

The present invention further provides nucleic acid molecules that consist essentially of any of the nucleotide sequences referred to in Table 1 and/or Table 2 (transcript sequences are referred to in Table 1 as SEQ ID NOS: 1-51, genomic sequences are referred to in Table 2 as SEQ ID NOS: 177-622, transcript-based SNP context sequences are referred to in Table 1 as SEQ ID NOS: 103-176, and genomic-based SNP context sequences are referred to in Table 2 as SEQ ID NOS: 623-3661), or any nucleic acid molecule that encodes any of the variant proteins referred to in Table 1 (SEQ ID NOS: 52-102). The actual sequences referred to in the tables are provided in the Sequence Listing. A nucleic acid molecule consists essentially of a nucleotide sequence when such a nucleotide sequence is present with only a few additional nucleotide residues in the final nucleic acid molecule.

The present invention further provides nucleic acid molecules that comprise any of the nucleotide sequences shown in Table 1 and/or Table 2 or a SNP-containing fragment thereof (transcript sequences are referred to in Table 1 as SEQ ID NOS: 1-51, genomic sequences are referred to in Table 2 as SEQ ID NOS: 177-622, transcript-based SNP context sequences are referred to in Table 1 as SEQ ID NOS: 103-176, and genomic-based SNP context sequences are referred to in Table 2 as SEQ ID NOS: 623-3661), or any nucleic acid molecule that encodes any of the variant proteins provided in Table 1 (SEQ ID NOS: 52-102). The actual sequences referred to in the tables are provided in the Sequence Listing. A nucleic acid molecule comprises a nucleotide sequence when the nucleotide sequence is at least part of the final nucleotide sequence of the nucleic acid molecule. In such a fashion, the nucleic acid molecule can be only the nucleotide sequence or have additional nucleotide residues, such as residues that are naturally associated with it or heterologous nucleotide sequences. Such a nucleic acid molecule can have one to a few additional nucleotides or can comprise many more additional nucleotides. A brief description of how various types of these nucleic acid molecules can be readily made and isolated is provided below, and such techniques are well known to those of ordinary skill in the art. Sambrook and Russell, *Molecular Cloning: A Laboratory Manual*, Cold Spring Harbor Press, N.Y. (2000).

The isolated nucleic acid molecules can encode mature proteins plus additional amino or carboxyl-terminal amino acids or both, or amino acids interior to the mature peptide (when the mature form has more than one peptide chain, for instance). Such sequences may play a role in processing of a protein from precursor to a mature form, facilitate protein trafficking, prolong or shorten protein half-life, or facilitate manipulation of a protein for assay or production. As generally is the case in situ, the additional amino acids may be processed away from the mature protein by cellular enzymes.

Thus, the isolated nucleic acid molecules include, but are not limited to, nucleic acid molecules having a sequence encoding a peptide alone, a sequence encoding a mature peptide and additional coding sequences such as a leader or secretory sequence (e.g., a pre-pro or pro-protein sequence), a sequence encoding a mature peptide with or without additional coding sequences, plus additional non-coding sequences, for example introns and non-coding 5' and 3' sequences such as transcribed but untranslated sequences that play a role in, for example, transcription, mRNA processing (including splicing and polyadenylation signals), ribosome binding, and/or stability of mRNA. In addition, the nucleic acid molecules may be fused to heterologous marker sequences encoding, for example, a peptide that facilitates purification.

Isolated nucleic acid molecules can be in the form of RNA, such as mRNA, or in the form DNA, including cDNA and genomic DNA, which may be obtained, for example, by molecular cloning or produced by chemical synthetic techniques or by a combination thereof. Sambrook and Russell, *Molecular Cloning: A Laboratory Manual*, Cold Spring Harbor Press, N.Y. (2000). Furthermore, isolated nucleic acid molecules, particularly SNP detection reagents such as probes and primers, can also be partially or completely in the form of one or more types of nucleic acid analogs, such as peptide nucleic acid (PNA). U.S. Pat. Nos. 5,539,082; 5,527,675; 5,623,049; and 5,714,331. The nucleic acid, especially DNA, can be double-stranded or single-stranded. Single-stranded nucleic acid can be the coding strand (sense strand) or the complementary non-coding strand (anti-sense strand). DNA, RNA, or PNA segments can be assembled, for example, from fragments of the human genome (in the case of DNA or RNA) or single nucleotides, short oligonucleotide linkers, or from a series of oligonucleotides, to provide a synthetic nucleic acid molecule. Nucleic acid molecules can be readily synthesized using the sequences provided herein as a reference; oligonucleotide and PNA oligomer synthesis techniques are well known in the art. See, e.g., Corey, "Peptide nucleic acids: expanding the scope of nucleic acid recognition," *Trends Biotechnol* 15(6):224-9 (June 1997), and Hyrup et al., "Peptide nucleic acids (PNA): synthesis, properties and potential applications," *Bioorg Med Chem* 4(1):5-23 (January 1996). Furthermore, large-scale automated oligonucleotide/PNA synthesis (including synthesis on an array or bead surface or other solid support) can readily be accomplished using commercially available nucleic acid synthesizers, such as the Applied Biosystems (Foster City, Calif.) 3900 High-Throughput DNA Synthesizer or Expedite 8909 Nucleic Acid Synthesis System, and the sequence information provided herein.

The present invention encompasses nucleic acid analogs that contain modified, synthetic, or non-naturally occurring nucleotides or structural elements or other alternative/modified nucleic acid chemistries known in the art. Such nucleic acid analogs are useful, for example, as detection reagents (e.g., primers/probes) for detecting one or more SNPs identified in Table 1 and/or Table 2. Furthermore, kits/systems (such as beads, arrays, etc.) that include these analogs are also encompassed by the present invention. For example, PNA oligomers that are based on the polymorphic sequences of the present invention are specifically contemplated. PNA oligomers are analogs of DNA in which the phosphate backbone is replaced with a peptide-like backbone. Lagriffoul et al., *Bioorganic & Medicinal Chemistry Letters* 4:1081-1082 (1994); Petersen et al., *Bioorganic & Medicinal Chemistry Letters* 6:793-796 (1996); Kumar et al., *Organic Letters* 3(9):1269-1272 (2001); WO 96/04000. PNA hybridizes to complementary RNA or DNA with higher affinity and specificity than conventional oligonucleotides and oligonucleotide analogs. The properties of PNA enable novel molecular biology and biochemistry applications unachievable with traditional oligonucleotides and peptides.

Additional examples of nucleic acid modifications that improve the binding properties and/or stability of a nucleic acid include the use of base analogs such as inosine, intercalators (U.S. Pat. No. 4,835,263) and the minor groove binders (U.S. Pat. No. 5,801,115). Thus, references herein to nucleic acid molecules, SNP-containing nucleic acid molecules, SNP detection reagents (e.g., probes and primers), oligonucleotides/polynucleotides include PNA oligomers and other nucleic acid analogs. Other examples of nucleic acid analogs and alternative/modified nucleic acid chemistries known in the art are described in *Current Protocols in Nucleic Acid Chemistry*, John Wiley & Sons, N.Y. (2002).

The present invention further provides nucleic acid molecules that encode fragments of the variant polypeptides disclosed herein as well as nucleic acid molecules that encode obvious variants of such variant polypeptides. Such nucleic acid molecules may be naturally occurring, such as paralogs (different locus) and orthologs (different organism), or may be constructed by recombinant DNA methods or by chemical synthesis. Non-naturally occurring variants may be made by mutagenesis techniques, including those applied to nucleic acid molecules, cells, or organisms. Accordingly, the variants can contain nucleotide substitutions, deletions, inversions and insertions (in addition to the SNPs disclosed in Tables 1 and 2). Variation can occur in either or both the coding and non-coding regions. The variations can produce conservative and/or non-conservative amino acid substitutions.

Further variants of the nucleic acid molecules disclosed in Tables 1 and 2, such as naturally occurring allelic variants (as well as orthologs and paralogs) and synthetic variants produced by mutagenesis techniques, can be identified and/or produced using methods well known in the art. Such further variants can comprise a nucleotide sequence that shares at least 70-80%, 80-85%, 85-90%, 91%, 92%, 93%, 94%, 95%, 96%, 97%, 98%, or 99% sequence identity with a nucleic acid sequence disclosed in Table 1 and/or Table 2 (or a fragment thereof) and that includes a novel SNP allele disclosed in Table 1 and/or Table 2. Further, variants can comprise a nucleotide sequence that encodes a polypeptide that shares at least 70-80%, 80-85%, 85-90%, 91%, 92%, 93%, 94%, 95%, 96%, 97%, 98%, or 99% sequence identity with a polypeptide sequence disclosed in Table 1 (or a fragment thereof) and that includes a novel SNP allele disclosed in Table 1 and/or Table 2. Thus, an aspect of the present invention that is specifically contemplated are isolated nucleic acid molecules that have a certain degree of sequence variation compared with the sequences shown in Tables 1-2, but that contain a novel SNP allele disclosed herein. In other words, as long as an isolated nucleic acid molecule contains a novel SNP allele disclosed herein, other portions of the nucleic acid molecule that flank the novel SNP allele can vary to some degree from the specific transcript, genomic, and context sequences referred to and shown in Tables 1 and 2, and can encode a polypeptide that varies to some degree from the specific polypeptide sequences referred to in Table 1.

To determine the percent identity of two amino acid sequences or two nucleotide sequences of two molecules that share sequence homology, the sequences are aligned for optimal comparison purposes (e.g., gaps can be introduced in one or both of a first and a second amino acid or nucleic acid sequence for optimal alignment and non-homologous sequences can be disregarded for comparison purposes). In a preferred embodiment, at least 30%, 40%, 50%, 60%, 70%, 80%, or 90% or more of the length of a reference sequence is aligned for comparison purposes. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position (as used herein, amino acid or nucleic acid "identity" is equivalent to amino acid or nucleic acid "homology"). The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. *Computational Molecular Biology*, A. M. Lesk, ed., Oxford University Press, N.Y (1988); *Biocomputing: Informatics and Genome Projects*, D. W. Smith, ed., Academic Press, N.Y. (1993); *Computer Analysis of Sequence Data, Part* 1, A. M. Griffin and H. G. Griffin, eds., Humana Press, N.J. (1994); *Sequence Analysis in Molecular Biology*, G. von Heinje, ed., Academic Press, N.Y. (1987); and *Sequence Analysis Primer*, M. Gribskov and J. Devereux, eds., M. Stockton Press, N.Y. (1991). In a preferred embodiment, the percent identity between two amino acid sequences is determined using the Needleman and Wunsch algorithm (*J Mol Biol* (48):444-453 (1970)) which has been incorporated into the GAP program in the GCG software package, using either a Blossom 62 matrix or a PAM250 matrix, and a gap weight of 16, 14, 12, 10, 8, 6, or 4 and a length weight of 1, 2, 3, 4, 5, or 6.

In yet another preferred embodiment, the percent identity between two nucleotide sequences is determined using the GAP program in the GCG software package using a NWSgapdna.CMP matrix and a gap weight of 40, 50, 60, 70, or 80 and a length weight of 1, 2, 3, 4, 5, or 6. J. Devereux et al., *Nucleic Acids Res.* 12(1):387 (1984). In another embodiment, the percent identity between two amino acid or nucleotide sequences is determined using the algorithm of E. Myers and W. Miller (CABIOS 4:11-17 (1989)) which has been incorporated into the ALIGN program (version 2.0), using a PAM120 weight residue table, a gap length penalty of 12, and a gap penalty of 4.

The nucleotide and amino acid sequences of the present invention can further be used as a "query sequence" to perform a search against sequence databases; for example, to identify other family members or related sequences. Such searches can be performed using the NBLAST and XBLAST programs (version 2.0). Altschul et al., *J Mol Biol* 215:403-10 (1990). BLAST nucleotide searches can be performed with the NBLAST program, score=100, wordlength=12 to obtain nucleotide sequences homologous to the nucleic acid molecules of the invention. BLAST protein searches can be performed with the XBLAST program, score=50, wordlength=3 to obtain amino acid sequences homologous to the proteins of the invention. To obtain gapped alignments for comparison purposes, Gapped BLAST can be utilized. Altschul et al., *Nucleic Acids Res* 25(17):3389-3402 (1997). When utilizing BLAST and gapped BLAST programs, the default parameters of the respective programs (e.g., XBLAST and NBLAST) can be used. In addition to BLAST, examples of other search and sequence comparison programs used in the art include, but are not limited to, FASTA (Pearson, *Methods Mol Biol* 25, 365-389 (1994)) and KERR (Dufresne et al., *Nat Biotechnol* 20(12): 1269-71 (December 2002)). For further information regarding bioinformatics techniques, see *Current Protocols in Bioinformatics*, John Wiley & Sons, Inc., N.Y.

The present invention further provides non-coding fragments of the nucleic acid molecules disclosed in Table 1 and/or Table 2. Preferred non-coding fragments include, but are not limited to, promoter sequences, enhancer sequences, intronic sequences, 5' untranslated regions (UTRs), 3' untranslated regions, gene modulating sequences and gene termination sequences. Such fragments are useful, for example, in controlling heterologous gene expression and in developing screens to identify gene-modulating agents.

SNP Detection Reagents

In a specific aspect of the present invention, the SNPs disclosed in Table 1 and/or Table 2, and their associated transcript sequences (referred to in Table 1 as SEQ ID NOS: 1-51), genomic sequences (referred to in Table 2 as SEQ ID NOS: 177-622), and context sequences (transcript-based context sequences are referred to in Table 1 as SEQ ID NOS: 103-176; genomic-based context sequences are provided in Table 2 as SEQ ID NOS: 623-3661), can be used for the design of SNP detection reagents. The actual sequences referred to in the tables are provided in the Sequence Listing. As used herein, a "SNP detection reagent" is a reagent that specifically detects a specific target SNP position disclosed herein, and that is preferably specific for a particular nucleotide (allele) of the target SNP position (i.e., the detection reagent preferably can differentiate between different alternative nucleotides at a target SNP position, thereby allowing the identity of the nucleotide present at the target SNP position to be determined). Typically, such detection reagent hybridizes to a target SNP-containing nucleic acid molecule by complementary base-pairing in a sequence specific manner, and discriminates the target variant sequence from other nucleic acid sequences such as an art-known form in a test sample. An example of a detection reagent is a probe that hybridizes to a target nucleic acid containing one or more of the SNPs referred to in Table 1 and/or Table 2. In a preferred embodiment, such a probe can differentiate between nucleic acids having a particular nucleotide (allele) at a target SNP position from other nucleic acids that have a different nucleotide at the same target SNP position. In addition, a detection reagent may hybridize to a specific region 5' and/or 3' to a SNP position, particularly a region corresponding to the context sequences referred to in Table 1 and/or Table 2

(transcript-based context sequences are referred to in Table 1 as SEQ ID NOS: 103-176; genomic-based context sequences are referred to in Table 2 as SEQ ID NOS: 623-3661). Another example of a detection reagent is a primer that acts as an initiation point of nucleotide extension along a complementary strand of a target polynucleotide. The SNP sequence information provided herein is also useful for designing primers, e.g. allele-specific primers, to amplify (e.g., using PCR) any SNP of the present invention.

In one preferred embodiment of the invention, a SNP detection reagent is an isolated or synthetic DNA or RNA polynucleotide probe or primer or PNA oligomer, or a combination of DNA, RNA and/or PNA, that hybridizes to a segment of a target nucleic acid molecule containing a SNP identified in Table 1 and/or Table 2. A detection reagent in the form of a polynucleotide may optionally contain modified base analogs, intercalators or minor groove binders. Multiple detection reagents such as probes may be, for example, affixed to a solid support (e.g., arrays or beads) or supplied in solution (e.g. probe/primer sets for enzymatic reactions such as PCR, RT-PCR, TaqMan assays, or primer-extension reactions) to form a SNP detection kit.

A probe or primer typically is a substantially purified oligonucleotide or PNA oligomer. Such oligonucleotide typically comprises a region of complementary nucleotide sequence that hybridizes under stringent conditions to at least about 8, 10, 12, 16, 18, 20, 22, 25, 30, 40, 50, 55, 60, 65, 70, 80, 90, 100, 120 (or any other number in-between) or more consecutive nucleotides in a target nucleic acid molecule. Depending on the particular assay, the consecutive nucleotides can either include the target SNP position, or be a specific region in close enough proximity 5' and/or 3' to the SNP position to carry out the desired assay.

Other preferred primer and probe sequences can readily be determined using the transcript sequences (SEQ ID NOS: 1-51), genomic sequences (SEQ ID NOS: 177-622), and SNP context sequences (transcript-based context sequences are referred to in Table 1 as SEQ ID NOS: 103-176; genomic-based context sequences are referred to in Table 2 as SEQ ID NOS: 623-3661) disclosed in the Sequence Listing and in Tables 1 and 2. The actual sequences referred to in the tables are provided in the Sequence Listing. It will be apparent to one of skill in the art that such primers and probes are directly useful as reagents for genotyping the SNPs of the present invention, and can be incorporated into any kit/system format.

In order to produce a probe or primer specific for a target SNP-containing sequence, the gene/transcript and/or context sequence surrounding the SNP of interest is typically examined using a computer algorithm that starts at the 5' or at the 3' end of the nucleotide sequence. Typical algorithms will then identify oligomers of defined length that are unique to the gene/SNP context sequence, have a GC content within a range suitable for hybridization, lack predicted secondary structure that may interfere with hybridization, and/or possess other desired characteristics or that lack other undesired characteristics.

A primer or probe of the present invention is typically at least about 8 nucleotides in length. In one embodiment of the invention, a primer or a probe is at least about 10 nucleotides in length. In a preferred embodiment, a primer or a probe is at least about 12 nucleotides in length. In a more preferred embodiment, a primer or probe is at least about 16, 17, 18, 19, 20, 21, 22, 23, 24 or 25 nucleotides in length. While the maximal length of a probe can be as long as the target sequence to be detected, depending on the type of assay in which it is employed, it is typically less than about 50, 60, 65, or 70 nucleotides in length. In the case of a primer, it is typically less than about 30 nucleotides in length. In a specific preferred embodiment of the invention, a primer or a probe is within the length of about 18 and about 28 nucleotides. However, in other embodiments, such as nucleic acid arrays and other embodiments in which probes are affixed to a substrate, the probes can be longer, such as on the order of 30-70, 75, 80, 90, 100, or more nucleotides in length (see the section below entitled "SNP Detection Kits and Systems").

For analyzing SNPs, it may be appropriate to use oligonucleotides specific for alternative SNP alleles. Such oligonucleotides that detect single nucleotide variations in target sequences may be referred to by such terms as "allele-specific oligonucleotides," "allele-specific probes," or "allele-specific primers." The design and use of allele-specific probes for analyzing polymorphisms is described in, e.g., *Mutation Detection: A Practical Approach*, Cotton et al., eds., Oxford University Press (1998); Saiki et al., *Nature* 324:163-166 (1986); Dattagupta, EP235,726; and Saiki, WO 89/11548.

While the design of each allele-specific primer or probe depends on variables such as the precise composition of the nucleotide sequences flanking a SNP position in a target nucleic acid molecule, and the length of the primer or probe, another factor in the use of primers and probes is the stringency of the condition under which the hybridization between the probe or primer and the target sequence is performed. Higher stringency conditions utilize buffers with lower ionic strength and/or a higher reaction temperature, and tend to require a more perfect match between probe/primer and a target sequence in order to form a stable duplex. If the stringency is too high, however, hybridization may not occur at all. In contrast, lower stringency conditions utilize buffers with higher ionic strength and/or a lower reaction temperature, and permit the formation of stable duplexes with more mismatched bases between a probe/primer and a target sequence. By way of example and not limitation, exemplary conditions for high stringency hybridization conditions using an allele-specific probe are as follows: prehybridization with a solution containing 5× standard saline phosphate EDTA (SSPE), 0.5% $NaDodSO_4$ (SDS) at 55° C., and incubating probe with target nucleic acid molecules in the same solution at the same temperature, followed by washing with a solution containing 2×SSPE, and 0.1% SDS at 55° C. or room temperature.

Moderate stringency hybridization conditions may be used for allele-specific primer extension reactions with a solution containing, e.g., about 50 mM KCl at about 46° C. Alternatively, the reaction may be carried out at an elevated temperature such as 60° C. In another embodiment, a moderately stringent hybridization condition suitable for oligonucleotide ligation assay (OLA) reactions wherein two probes are ligated if they are completely complementary to the target sequence may utilize a solution of about 100 mM KCl at a temperature of 46° C.

In a hybridization-based assay, allele-specific probes can be designed that hybridize to a segment of target DNA from one individual but do not hybridize to the corresponding segment from another individual due to the presence of different polymorphic forms (e.g., alternative SNP alleles/nucleotides) in the respective DNA segments from the two individuals. Hybridization conditions should be sufficiently stringent that there is a significant detectable difference in hybridization intensity between alleles, and preferably an essentially binary response, whereby a probe hybridizes to only one of the alleles or significantly more strongly to one allele. While a probe may be designed to hybridize to a target sequence that contains a SNP site such that the SNP site aligns anywhere along the sequence of the probe, the probe is preferably designed to hybridize to a segment of the target sequence such that the SNP site aligns with a central position of the probe (e.g., a position within the probe that is at least three nucleotides from either end of the probe). This design of probe generally achieves good discrimination in hybridization between different allelic forms.

In another embodiment, a probe or primer may be designed to hybridize to a segment of target DNA such that the SNP aligns with either the 5' most end or the 3' most end of the probe or primer. In a specific preferred embodiment that is particularly suitable for use in a oligonucleotide ligation assay (U.S. Pat. No. 4,988,617), the 3' most nucleotide of the probe aligns with the SNP position in the target sequence.

Oligonucleotide probes and primers may be prepared by methods well known in the art. Chemical synthetic methods include, but are not limited to, the phosphotriester method described by Narang et al., *Methods in Enzymology* 68:90 (1979); the phosphodiester method described by Brown et al., *Methods in Enzymology* 68:109 (1979); the diethylphosphoamidate method described by Beaucage et al., *Tetrahedron Letters* 22:1859 (1981); and the solid support method described in U.S. Pat. No. 4,458,066.

Allele-specific probes are often used in pairs (or, less commonly, in sets of 3 or 4, such as if a SNP position is known to have 3 or 4 alleles, respectively, or to assay both strands of a nucleic acid molecule for a target SNP allele), and such pairs may be identical except for a one nucleotide mismatch that represents the allelic variants at the SNP position. Commonly, one member of a pair perfectly matches a reference form of a target sequence that has a more common SNP allele (i.e., the allele that is more frequent in the target population) and the other member of the pair perfectly matches a form of the target sequence that has a less common SNP allele (i.e., the allele that is rarer in the target population). In the case of an array, multiple pairs of probes can be immobilized on the same support for simultaneous analysis of multiple different polymorphisms.

In one type of PCR-based assay, an allele-specific primer hybridizes to a region on a target nucleic acid molecule that overlaps a SNP position and only primes amplification of an allelic form to which the primer exhibits perfect complementarity. Gibbs, *Nucleic Acid Res* 17:2427-2448 (1989). Typically, the primer's 3'-most nucleotide is aligned with and complementary to the SNP position of the target nucleic acid molecule. This primer is used in conjunction with a second primer that hybridizes at a distal site. Amplification proceeds from the two primers, producing a detectable product that indicates which allelic form is present in the test sample. A control is usually performed with a second pair of primers, one of which shows a single base mismatch at the polymorphic site and the other of which exhibits perfect complementarity to a distal site. The single-base mismatch prevents amplification or substantially reduces amplification efficiency, so that either no detectable product is formed or it is formed in lower amounts or at a slower pace. The method generally works most effectively when the mismatch is at the 3'-most position of the oligonucleotide (i.e., the 3'-most position of the oligonucleotide aligns with the target SNP position) because this position is most destabilizing to elongation from the primer (see, e.g., WO 93/22456). This PCR-based assay can be utilized as part of the TaqMan assay, described below.

In a specific embodiment of the invention, a primer of the invention contains a sequence substantially complementary to a segment of a target SNP-containing nucleic acid molecule except that the primer has a mismatched nucleotide in one of the three nucleotide positions at the 3'-most end of the primer, such that the mismatched nucleotide does not base pair with a particular allele at the SNP site. In a preferred embodiment, the mismatched nucleotide in the primer is the second from the last nucleotide at the 3'-most position of the primer. In a more preferred embodiment, the mismatched nucleotide in the primer is the last nucleotide at the 3'-most position of the primer.

In another embodiment of the invention, a SNP detection reagent of the invention is labeled with a fluorogenic reporter dye that emits a detectable signal. While the preferred reporter dye is a fluorescent dye, any reporter dye that can be attached to a detection reagent such as an oligonucleotide probe or primer is suitable for use in the invention. Such dyes include, but are not limited to, Acridine, AMCA, BODIPY, Cascade Blue, Cy2, Cy3, Cy5, Cy7, Dabcyl, Edans, Eosin, Erythrosin, Fluorescein, 6-Fam, Tet, Joe, Hex, Oregon Green, Rhodamine, Rhodol Green, Tamra, Rox, and Texas Red.

In yet another embodiment of the invention, the detection reagent may be further labeled with a quencher dye such as Tamra, especially when the reagent is used as a self-quenching probe such as a TaqMan (U.S. Pat. Nos. 5,210,015 and 5,538,848) or Molecular Beacon probe (U.S. Pat. Nos. 5,118,801 and 5,312,728), or other stemless or linear beacon probe (Livak et al., *PCR Method Appl* 4:357-362 (1995); Tyagi et al., *Nature Biotechnology* 14:303-308 (1996); Nazarenko et al., *Nucl Acids Res* 25:2516-2521 (1997); U.S. Pat. Nos. 5,866,336 and 6,117,635.

The detection reagents of the invention may also contain other labels, including but not limited to, biotin for streptavidin binding, hapten for antibody binding, and oligonucleotide for binding to another complementary oligonucleotide such as pairs of zipcodes.

The present invention also contemplates reagents that do not contain (or that are complementary to) a SNP nucleotide identified herein but that are used to assay one or more SNPs disclosed herein. For example, primers that flank, but do not hybridize directly to a target SNP position provided herein are useful in primer extension reactions in which the primers hybridize to a region adjacent to the target SNP position (i.e., within one or more nucleotides from the target SNP site). During the primer extension reaction, a primer is typically not able to extend past a target SNP site if a particular nucleotide (allele) is present at that target SNP site, and the primer extension product can be detected in order to determine which SNP allele is present at the target SNP site. For example, particular ddNTPs are typically used in the primer extension reaction to terminate primer extension once a ddNTP is incorporated into the extension product (a primer extension product which includes a ddNTP at the 3'-most end of the primer extension product, and in which the ddNTP is a nucleotide of a SNP disclosed herein, is a composition that is specifically contemplated by the present invention). Thus, reagents that bind to a nucleic acid molecule in a region adjacent to a SNP site and that are used for assaying the SNP site, even though the bound sequences do not necessarily include the SNP site itself, are also contemplated by the present invention.

SNP Detection Kits and Systems

A person skilled in the art will recognize that, based on the SNP and associated sequence information disclosed herein, detection reagents can be developed and used to assay any SNP of the present invention individually or in combination, and such detection reagents can be readily incorporated into one of the established kit or system formats which are well known in the art. The terms "kits" and "systems," as used herein in the context of SNP detection reagents, are intended to refer to such things as combinations of multiple SNP detection reagents, or one or more SNP detection reagents in combination with one or more other types of elements or components (e.g., other types of biochemical reagents, containers, packages such as packaging intended for commercial sale, substrates to which SNP detection reagents are attached, electronic hardware components, etc.). Accordingly, the present invention further provides SNP detection kits and systems, including but not limited to, packaged probe and primer sets (e.g. TaqMan probe/primer sets), arrays/microarrays of nucleic acid molecules, and beads that contain one or more probes, primers, or other detection reagents for detecting one or more SNPs of the present invention. The kits/systems can optionally include various electronic hardware components; for example, arrays ("DNA chips") and microfluidic systems ("lab-on-a-chip" systems) provided by various manufacturers typically comprise hardware components. Other kits/systems (e.g., probe/primer sets) may not include electronic hardware components, but may be comprised of, for example, one or more SNP detection reagents (along with, optionally, other biochemical reagents) packaged in one or more containers.

In some embodiments, a SNP detection kit typically contains one or more detection reagents and other components (e.g. a buffer, enzymes such as DNA polymerases or ligases, chain extension nucleotides such as deoxynucleotide triphosphates, and in the case of Sanger-type DNA sequencing reactions, chain terminating nucleotides, positive control sequences, negative control sequences, and the like) necessary to carry out an assay or reaction, such as amplification and/or detection of a SNP-containing nucleic acid molecule. A kit may further contain means for determining the amount of a target nucleic acid, and means for comparing the amount with a standard, and can comprise instructions for using the kit to detect the SNP-containing nucleic acid molecule of interest. In one embodiment of the present invention, kits are provided which contain the necessary reagents to carry out one or more assays to detect one or more SNPs disclosed herein. In a preferred embodiment of the present invention, SNP detection kits/systems are in the form of nucleic acid arrays, or compartmentalized kits, including microfluidic/lab-on-a-chip systems.

Exemplary kits of the invention can comprise a container containing a SNP detection reagent which detects a SNP disclosed herein, said container can optionally be enclosed in a package (e.g., a box for commercial sale), and said package can further include other containers containing any or all of the following: enzyme (e.g., polymerase or ligase, any of which can be thermostable), dNTPs and/or ddNTPs (which can optionally be detectably labeled, such as with a fluorescent label or mass tag, and such label can optionally differ between any of the dATPs, dCTPs, dGTPs, dTTPs, ddATPs, ddCTPs, ddGTPs, and/or ddTTPs, so that each of these dNTPs and/or ddNTPs can be distinguished from each other by detection of the label, and any of these dNTPs and/or ddNTPs can optionally be stored in the same container or each in separate containers), buffer, controls (e.g., positive control nucleic acid, or a negative control), reagent(s) for extracting nucleic acid from a test sample, and instructions for using the kit (such as instructions for correlating the presence or absence of a particular allele or genotype with an increased or decreased risk for disease such as CVD, or an increased or decreased likelihood of responding to a drug such as a statin). The SNP detection reagent can comprise, for example, at least one primer and/or probe, any of which can optionally be allele-specific, and any of which can optionally be detectably labeled (e.g., with a fluorescent label).

SNP detection kits/systems may contain, for example, one or more probes, or pairs of probes, that hybridize to a nucleic acid molecule at or near each target SNP position. Multiple pairs of allele-specific probes may be included in the kit/system to simultaneously assay large numbers of SNPs, at least one of which is a SNP of the present invention. In some kits/systems, the allele-specific probes are immobilized to a substrate such as an array or bead. For example, the same substrate can comprise allele-specific probes for detecting at least 1; 10; 100; 1000; 10,000; 100,000 (or any other number in-between) or substantially all of the SNPs shown in Table 1 and/or Table 2.

The terms "arrays," "microarrays," and "DNA chips" are used herein interchangeably to refer to an array of distinct polynucleotides affixed to a substrate, such as glass, plastic, paper, nylon or other type of membrane, filter, chip, or any other suitable solid support. The polynucleotides can be synthesized directly on the substrate, or synthesized separate from the substrate and then affixed to the substrate. In one embodiment, the microarray is prepared and used according to the methods described in Chee et al., U.S. Pat. No. 5,837,832 and PCT application WO95/11995; D. J. Lockhart et al., *Nat Biotech* 14:1675-1680 (1996); and M. Schena et al., *Proc Natl Acad Sci* 93:10614-10619 (1996), all of which are incorporated herein in their entirety by reference. In other embodiments, such arrays are produced by the methods described by Brown et al., U.S. Pat. No. 5,807,522.

Nucleic acid arrays are reviewed in the following references: Zammatteo et al., "New chips for molecular biology and diagnostics," *Biotechnol Annu Rev* 8:85-101 (2002); Sosnowski et al., "Active microelectronic array system for DNA hybridization, genotyping and pharmacogenomic applications," *Psychiatr Genet* 12(4):181-92 (December 2002); Heller, "DNA microarray technology: devices, systems, and applications," *Annu Rev Biomed Eng* 4:129-53 (2002); Epub Mar. 22, 2002; Kolchinsky et al., "Analysis of SNPs and other genomic variations using gel-based chips," *Hum Mutat* 19(4):343-60 (April 2002); and McGall et al., "High-density genechip oligonucleotide probe arrays," *Adv Biochem Eng Biotechnol* 77:21-42 (2002).

Any number of probes, such as allele-specific probes, may be implemented in an array, and each probe or pair of probes can hybridize to a different SNP position. In the case of polynucleotide probes, they can be synthesized at designated areas (or synthesized separately and then affixed to designated areas) on a substrate using a light-directed chemical process. Each DNA chip can contain, for example, thousands to millions of individual synthetic polynucleotide probes arranged in a grid-like pattern and miniaturized (e.g., to the size of a dime). Preferably, probes are attached to a solid support in an ordered, addressable array.

A microarray can be composed of a large number of unique, single-stranded polynucleotides, usually either synthetic antisense polynucleotides or fragments of cDNAs, fixed to a solid support. Typical polynucleotides are preferably about 6-60 nucleotides in length, more preferably about 15-30 nucleotides in length, and most preferably about 18-25 nucleotides in length. For certain types of microarrays or other detection kits/systems, it may be preferable to use oligonucleotides that are only about 7-20 nucleotides in length. In other types of arrays, such as arrays used in conjunction with chemiluminescent detection technology, preferred probe lengths can be, for example, about 15-80 nucleotides in length, preferably about 50-70 nucleotides in length, more preferably about 55-65 nucleotides in length, and most preferably about 60 nucleotides in length. The microarray or detection kit can contain polynucleotides that cover the known 5' or 3' sequence of a gene/transcript or target SNP site, sequential polynucleotides that cover the full-length sequence of a gene/transcript; or unique polynucleotides selected from particular areas along the length of a target gene/transcript sequence, particularly areas corresponding to one or more SNPs disclosed in Table 1 and/or Table 2. Polynucleotides used in the microarray or detection kit can be specific to a SNP or SNPs of interest (e.g., specific to a particular SNP allele at a target SNP site, or specific to particular SNP alleles at multiple different SNP sites), or specific to a polymorphic gene/transcript or genes/transcripts of interest.

Hybridization assays based on polynucleotide arrays rely on the differences in hybridization stability of the probes to perfectly matched and mismatched target sequence variants. For SNP genotyping, it is generally preferable that stringency conditions used in hybridization assays are high enough such that nucleic acid molecules that differ from one another at as little as a single SNP position can be differentiated (e.g., typical SNP hybridization assays are designed so that hybridization will occur only if one particular nucleotide is present at a SNP position, but will not occur if an alternative nucleotide is present at that SNP position). Such high stringency conditions may be preferable when using, for example, nucleic acid arrays of allele-specific probes for SNP detection. Such high stringency conditions are described in the preceding section, and are well known to those skilled in the art and can be found in, for example, *Current Protocols in Molecular Biology* 6.3.1-6.3.6, John Wiley & Sons, N.Y. (1989).

In other embodiments, the arrays are used in conjunction with chemiluminescent detection technology. The following patents and patent applications, which are all hereby incorporated by reference, provide additional information pertaining to chemiluminescent detection. U.S. patent applications that describe chemiluminescent approaches for microarray detection: Ser. No. 10/620,332 and Ser. No. 10/620,333. U.S. patents that describe methods and compositions of dioxetane for performing chemiluminescent detection: U.S. Pat. Nos. 6,124,478; 6,107,024; 5,994,073; 5,981,768; 5,871,938; 5,843,681; 5,800,999 and 5,773,628. And the U.S. published application that discloses methods and compositions for microarray controls: US2002/0110828.

In one embodiment of the invention, a nucleic acid array can comprise an array of probes of about 15-25 nucleotides in length. In further embodiments, a nucleic acid array can comprise any number of probes, in which at least one probe is capable of detecting one or more SNPs disclosed in Table 1 and/or Table 2, and/or at least one probe comprises a fragment of one of the sequences selected from the group consisting of those disclosed in Table 1, Table 2, the Sequence Listing, and sequences complementary thereto, said fragment comprising at least about 8 consecutive nucleotides, preferably 10, 12, 15, 16, 18, 20, more preferably 22, 25, 30, 40, 47, 50, 55, 60, 65, 70, 80, 90, 100, or more consecutive nucleotides (or any other number in-between) and containing (or being complementary to) a novel SNP allele disclosed in Table 1 and/or Table 2. In some embodiments, the nucleotide complementary to the SNP site is within 5, 4, 3, 2, or 1 nucleotide from the center of the probe, more preferably at the center of said probe.

A polynucleotide probe can be synthesized on the surface of the substrate by using a chemical coupling procedure and an ink jet application apparatus, as described in PCT application WO95/251116 (Baldeschweiler et al.) which is incorporated herein in its entirety by reference. In another aspect, a "gridded" array analogous to a dot (or slot) blot may be used to arrange and link cDNA fragments or oligonucleotides to the surface of a substrate using a vacuum system, thermal, UV, mechanical or chemical bonding procedures. An array, such as those described above, may be produced by hand or by using available devices (slot blot or dot blot apparatus), materials (any suitable solid support), and machines (including robotic instruments), and may contain 8, 24, 96, 384, 1536, 6144 or more polynucleotides, or any other number which lends itself to the efficient use of commercially available instrumentation.

Using such arrays or other kits/systems, the present invention provides methods of identifying the SNPs disclosed herein in a test sample. Such methods typically involve incubating a test sample of nucleic acids with an array comprising one or more probes corresponding to at least one SNP position of the present invention, and assaying for binding of a nucleic acid from the test sample with one or more of the probes. Conditions for incubating a SNP detection reagent (or a kit/system that employs one or more such SNP detection reagents) with a test sample vary. Incubation conditions depend on such factors as the format employed in the assay, the detection methods employed, and the type and nature of the detection reagents used in the assay. One skilled in the art will recognize that any one of the commonly available hybridization, amplification and array assay formats can readily be adapted to detect the SNPs disclosed herein.

A SNP detection kit/system of the present invention may include components that are used to prepare nucleic acids from a test sample for the subsequent amplification and/or detection of a SNP-containing nucleic acid molecule. Such sample preparation components can be used to produce nucleic acid extracts (including DNA and/or RNA), proteins or membrane extracts from any bodily fluids (such as blood, serum, plasma, urine, saliva, phlegm, gastric juices, semen, tears, sweat, etc.), skin, hair, cells (especially nucleated cells) such as buccal cells (e.g., as obtained by buccal swabs), biopsies, or tissue specimens. The test samples used in the above-described methods will vary based on such factors as the assay format, nature of the detection method, and the specific tissues, cells or extracts used as the test sample to be assayed. Methods of preparing nucleic acids, proteins, and cell extracts are well known in the art and can be readily adapted to obtain a sample that is compatible with the system utilized. Automated sample preparation systems for extracting nucleic acids from a test sample are commercially available, and examples are Qiagen's BioRobot 9600, Applied Biosystems' PRISM™ 6700 sample preparation system, and Roche Molecular Systems' COBAS AmpliPrep System.

Another form of kit contemplated by the present invention is a compartmentalized kit. A compartmentalized kit includes any kit in which reagents are contained in separate containers. Such containers include, for example, small glass containers, plastic containers, strips of plastic, glass or paper, or arraying material such as silica. Such containers allow one to efficiently transfer reagents from one compartment to another compartment such that the test samples and reagents are not cross-contaminated, or from one container to another vessel not included in the kit, and the agents or solutions of each container can be added in a quantitative fashion from one compartment to another or to another vessel. Such containers may include, for example, one or more containers which will accept the test sample, one or more containers which contain at least one probe or other SNP detection reagent for detecting one or more SNPs of the present invention, one or more containers which contain wash reagents (such as phosphate buffered saline, Tris-buffers, etc.), and one or more containers which contain the reagents used to reveal the presence of the bound probe or other SNP detection reagents. The kit can optionally further comprise compartments and/or reagents for, for example, nucleic acid amplification or other enzymatic reactions such as primer extension reactions, hybridization, ligation, electrophoresis (preferably capillary electrophoresis), mass spectrometry, and/or laser-induced fluorescent detection. The kit may also include instructions for using the kit. Exemplary compartmentalized kits include microfluidic devices known in the art. See, e.g., Weigl et al., "Lab-on-a-chip for drug development," *Adv Drug Deliv Rev* 55(3): 349-77 (February 2003). In such microfluidic devices, the containers may be referred to as, for example, microfluidic "compartments," "chambers," or "channels."

Microfluidic devices, which may also be referred to as "lab-on-a-chip" systems, biomedical micro-electro-mechanical systems (bioMEMs), or multicomponent integrated systems, are exemplary kits/systems of the present invention for analyzing SNPs. Such systems miniaturize and compartmentalize processes such as probe/target hybridization, nucleic acid amplification, and capillary electrophoresis reactions in a single functional device. Such microfluidic devices typically utilize detection reagents in at least one aspect of the system, and such detection reagents may be used to detect one or more SNPs of the present invention. One example of a microfluidic system is disclosed in U.S. Pat. No. 5,589,136, which describes the integration of PCR amplification and capillary electrophoresis in chips. Exemplary microfluidic systems comprise a pattern of microchannels designed onto a glass, silicon, quartz, or plastic wafer included on a microchip. The movements of the samples may be controlled by electric, electroosmotic or hydrostatic forces applied across different areas of the microchip to create functional microscopic valves and pumps with no moving parts. Varying the voltage can be used as a means to control the liquid flow at intersections between the micro-machined channels and to change the liquid flow rate for pumping across different sections of the microchip. See, for example, U.S. Pat. No. 6,153,073, Dubrow et al., and U.S. Pat. No. 6,156,181, Parce et al.

For genotyping SNPs, an exemplary microfluidic system may integrate, for example, nucleic acid amplification, primer extension, capillary electrophoresis, and a detection method such as laser induced fluorescence detection. In a first step of an exemplary process for using such an exemplary system, nucleic acid samples are amplified, preferably by PCR. Then, the amplification products are subjected to automated primer extension reactions using ddNTPs (specific fluorescence for each ddNTP) and the appropriate oligonucleotide primers to carry out primer extension reactions which hybridize just upstream of the targeted SNP. Once the extension at the 3' end is completed, the primers are separated from the unincorporated fluorescent ddNTPs by capillary electrophoresis. The separation medium used in capillary electrophoresis can be, for example, polyacrylamide, polyethyleneglycol or dextran. The incorporated ddNTPs in the single nucleotide primer extension products are identified by laser-induced fluorescence detection. Such an exemplary microchip can be used to process, for example, at least 96 to 384 samples, or more, in parallel.

Uses of Nucleic Acid Molecules

The nucleic acid molecules of the present invention have a variety of uses, particularly for predicting whether an individual will benefit from statin treatment by reducing their risk for CVD (particularly CHD, such as MI) in response to the statin treatment, as well as for the diagnosis, prognosis, treatment, and prevention of CVD (particularly CHD, such as MI). For example, the nucleic acid molecules of the invention are useful for determining the likelihood of an individual who currently or previously has or has had CVD (such as an individual who has previously had an MI) or who is at increased risk for developing CVD (such as an individual who has not yet had an MI but is at increased risk for having an MI in the future) of responding to treatment (or prevention) of CVD with statins (such as by reducing their risk of developing primary or recurrent CVD, such as MI, in the future), predicting the likelihood that the individual will experience toxicity or other undesirable side effects from the statin treatment, predicting an individual's risk for developing CVD (particularly the risk for CHD such as MI), etc. For example, the nucleic acid molecules are useful as hybridization probes, such as for genotyping SNPs in messenger RNA, transcript, cDNA, genomic DNA, amplified DNA or other nucleic acid molecules, and for isolating full-length cDNA and genomic clones encoding the variant peptides disclosed in Table 1 as well as their orthologs.

A probe can hybridize to any nucleotide sequence along the entire length of a nucleic acid molecule referred to in Table 1 and/or Table 2. Preferably, a probe of the present invention hybridizes to a region of a target sequence that encompasses a SNP position indicated in Table 1 and/or Table 2. More preferably, a probe hybridizes to a SNP-containing target sequence in a sequence-specific manner such that it distinguishes the target sequence from other nucleotide sequences which vary from the target sequence only by which nucleotide is present at the SNP site. Such a probe is particularly useful for detecting the presence of a SNP-containing nucleic acid in a test sample, or for determining which nucleotide (allele) is present at a particular SNP site (i.e., genotyping the SNP site).

A nucleic acid hybridization probe may be used for determining the presence, level, form, and/or distribution of nucleic acid expression. The nucleic acid whose level is determined can be DNA or RNA. Accordingly, probes specific for the SNPs described herein can be used to assess the presence, expression and/or gene copy number in a given cell, tissue, or organism. These uses are relevant for diagnosis of disorders involving an increase or decrease in gene expression relative to normal levels. In vitro techniques for detection of mRNA include, for example, Northern blot hybridizations and in situ hybridizations. In vitro techniques for detecting DNA include Southern blot hybridizations and in situ hybridizations. Sambrook and Russell, *Molecular Cloning: A Laboratory Manual*, Cold Spring Harbor Press, N.Y. (2000).

Probes can be used as part of a diagnostic test kit for identifying cells or tissues in which a variant protein is expressed, such as by measuring the level of a variant protein-encoding nucleic acid (e.g., mRNA) in a sample of cells from a subject or determining if a polynucleotide contains a SNP of interest.

Thus, the nucleic acid molecules of the invention can be used as hybridization probes to detect the SNPs disclosed herein, thereby determining the likelihood that an individual will respond positively to statin treatment for reducing the risk of CVD (particularly CHD such as MI), or whether an individual with the polymorphism(s) is at risk for developing CVD (or has already developed early stage CVD). Detection of a SNP associated with a disease phenotype provides a diagnostic tool for an active disease and/or genetic predisposition to the disease.

Furthermore, the nucleic acid molecules of the invention are therefore useful for detecting a gene (gene information is disclosed in Table 2, for example) which contains a SNP disclosed herein and/or products of such genes, such as expressed mRNA transcript molecules (transcript information is disclosed in Table 1, for example), and are thus useful for detecting gene expression. The nucleic acid molecules can optionally be implemented in, for example, an array or kit format for use in detecting gene expression.

The nucleic acid molecules of the invention are also useful as primers to amplify any given region of a nucleic acid molecule, particularly a region containing a SNP identified in Table 1 and/or Table 2.

The nucleic acid molecules of the invention are also useful for constructing recombinant vectors (described in greater detail below). Such vectors include expression vectors that express a portion of, or all of, any of the variant peptide sequences referred to in Table 1. Vectors also include insertion vectors, used to integrate into another nucleic acid molecule sequence, such as into the cellular genome, to alter in situ expression of a gene and/or gene product. For example, an endogenous coding sequence can be replaced via homologous recombination with all or part of the coding region containing one or more specifically introduced SNPs.

The nucleic acid molecules of the invention are also useful for expressing antigenic portions of the variant proteins, particularly antigenic portions that contain a variant amino acid sequence (e.g., an amino acid substitution) caused by a SNP disclosed in Table 1 and/or Table 2.

The nucleic acid molecules of the invention are also useful for constructing vectors containing a gene regulatory region of the nucleic acid molecules of the present invention.

The nucleic acid molecules of the invention are also useful for designing ribozymes corresponding to all, or a part, of an mRNA molecule expressed from a SNP-containing nucleic acid molecule described herein.

The nucleic acid molecules of the invention are also useful for constructing host cells expressing a part, or all, of the nucleic acid molecules and variant peptides.

The nucleic acid molecules of the invention are also useful for constructing transgenic animals expressing all, or a part, of the nucleic acid molecules and variant peptides. The production of recombinant cells and transgenic animals having nucleic acid molecules which contain the SNPs disclosed in Table 1 and/or Table 2 allows, for example, effective clinical design of treatment compounds and dosage regimens.

The nucleic acid molecules of the invention are also useful in assays for drug screening to identify compounds that, for example, modulate nucleic acid expression.

The nucleic acid molecules of the invention are also useful in gene therapy in patients whose cells have aberrant gene expression. Thus, recombinant cells, which include a patient's cells that have been engineered ex vivo and returned to the patient, can be introduced into an individual where the recombinant cells produce the desired protein to treat the individual.

SNP Genotyping Methods

The process of determining which nucleotide(s) is/are present at each of one or more SNP positions (such as a SNP position disclosed in Table 1 and/or Table 2), for either or both alleles, may be referred to by such phrases as SNP genotyping, determining the "identity" of a SNP, determining the "content" of a SNP, or determining which nucleotide(s)/allele(s) is/are present at a SNP position. Thus, these terms can refer to detecting a single allele (nucleotide) at a SNP position or can encompass detecting both alleles (nucleotides) at a SNP position (such as to determine the homozygous or heterozygous state of a SNP position). Furthermore, these terms may also refer to detecting an amino acid residue encoded by a SNP (such as alternative amino acid residues that are encoded by different codons created by alternative nucleotides at a missense SNP position, for example).

The present invention provides methods of SNP genotyping, such as for use in implementing a preventive or treatment regimen for an individual based on that individual having an increased susceptibility for developing CVD (e.g., increased risk for CHD, such as MI) and/or an increased likelihood of benefiting from statin treatment for reducing the risk of CVD, in evaluating an individual's likelihood of responding to statin treatment (particularly for treating or preventing CVD), in selecting a treatment or preventive regimen (e.g., in deciding whether or not to administer statin treatment to an individual having CVD, or who is at increased risk for developing CVD, such as MI, in the future), or in formulating or selecting a particular statin-based treatment or preventive regimen such as dosage and/or frequency of administration of statin treatment or choosing which form/type of statin to be administered, such as a particular pharmaceutical composition or compound, etc.), determining the likelihood of experiencing toxicity or other undesirable side effects from statin treatment, or selecting individuals for a clinical trial of a statin (e.g., selecting individuals to participate in the trial who are most likely to respond positively from the statin treatment and/or excluding individuals from the trial who are unlikely to respond positively from the statin treatment based on their SNP genotype(s), or selecting individuals who are unlikely to respond positively to statins based on their SNP genotype(s) to participate in a clinical trial of another type of drug that may benefit them), etc. The SNP genotyping methods of the invention can also be useful for evaluating an individual's risk for developing CVD (particularly CHD, such as MI) and for predicting the likelihood that an individual who has previously had CVD will have a recurrence of CVD again in the future (e.g., recurrent MI).

Nucleic acid samples can be genotyped to determine which allele(s) is/are present at any given genetic region (e.g., SNP position) of interest by methods well known in the art. The neighboring sequence can be used to design SNP detection reagents such as oligonucleotide probes, which may optionally be implemented in a kit format. Exemplary SNP genotyping methods are described in Chen et al., "Single nucleotide polymorphism genotyping: biochemistry, protocol, cost and throughput," *Pharmacogenomics J* 3(2): 77-96 (2003); Kwok et al., "Detection of single nucleotide polymorphisms," *Curr Issues Mol Biol* 5(2):43-60 (April 2003); Shi, "Technologies for individual genotyping: detection of genetic polymorphisms in drug targets and disease genes," *Am J Pharmacogenomics* 2(3):197-205 (2002); and Kwok, "Methods for genotyping single nucleotide polymorphisms," *Annu Rev Genomics Hum Genet* 2:235-58 (2001). Exemplary techniques for high-throughput SNP genotyping are described in Marnellos, "High-throughput SNP analysis for genetic association studies," *Curr Opin Drug Discov Devel* 6(3):317-21 (May 2003). Common SNP genotyping methods include, but are not limited to, TaqMan assays, molecular beacon assays, nucleic acid arrays, allele-specific primer extension, allele-specific PCR, arrayed primer extension, homogeneous primer extension assays, primer extension with detection by mass spectrometry, pyrosequencing, multiplex primer extension sorted on genetic arrays, ligation with rolling circle amplification, homogeneous ligation, OLA (U.S. Pat. No. 4,988,167), multiplex ligation reaction sorted on genetic arrays, restriction-fragment length polymorphism, single base extension-tag assays, and the Invader assay. Such methods may be used in combination with detection mechanisms such as, for example, luminescence or chemiluminescence detection, fluorescence detection, time-resolved fluorescence detection, fluorescence resonance energy transfer, fluorescence polarization, mass spectrometry, and electrical detection.

Various methods for detecting polymorphisms include, but are not limited to, methods in which protection from cleavage agents is used to detect mismatched bases in RNA/RNA or RNA/DNA duplexes (Myers et al., *Science* 230:1242 (1985); Cotton et al., *PNAS* 85:4397 (1988); and Saleeba et al., *Meth. Enzymol* 217:286-295 (1992)), comparison of the electrophoretic mobility of variant and wild type nucleic acid molecules (Orita et al., *PNAS* 86:2766 (1989); Cotton et al., *Mutat Res* 285:125-144 (1993); and Hayashi et al., *Genet Anal Tech Appl* 9:73-79 (1992)), and assaying the movement of polymorphic or wild-type fragments in polyacrylamide gels containing a gradient of denaturant using denaturing gradient gel electrophoresis (DGGE) (Myers et al., *Nature* 313:495 (1985)). Sequence variations at specific locations can also be assessed by nuclease protection assays such as RNase and S1 protection or chemical cleavage methods.

In a preferred embodiment, SNP genotyping is performed using the TaqMan assay, which is also known as the 5' nuclease assay (U.S. Pat. Nos. 5,210,015 and 5,538,848). The TaqMan assay detects the accumulation of a specific amplified product during PCR. The TaqMan assay utilizes an oligonucleotide probe labeled with a fluorescent reporter dye and a quencher dye. The reporter dye is excited by irradiation at an appropriate wavelength, it transfers energy to the quencher dye in the same probe via a process called fluorescence resonance energy transfer (FRET). When attached to the probe, the excited reporter dye does not emit a signal. The proximity of the quencher dye to the reporter dye in the intact probe maintains a reduced fluorescence for the reporter. The reporter dye and quencher dye may be at the 5' most and the 3' most ends, respectively, or vice versa. Alternatively, the reporter dye may be at the 5' or 3' most end while the quencher dye is attached to an internal nucleotide, or vice versa. In yet another embodiment, both the reporter and the quencher may be attached to internal nucleotides at a distance from each other such that fluorescence of the reporter is reduced.

During PCR, the 5' nuclease activity of DNA polymerase cleaves the probe, thereby separating the reporter dye and the quencher dye and resulting in increased fluorescence of the reporter. Accumulation of PCR product is detected directly by monitoring the increase in fluorescence of the reporter dye. The DNA polymerase cleaves the probe between the reporter dye and the quencher dye only if the probe hybridizes to the target SNP-containing template which is amplified during PCR, and the probe is designed to hybridize to the target SNP site only if a particular SNP allele is present.

Preferred TaqMan primer and probe sequences can readily be determined using the SNP and associated nucleic acid sequence information provided herein. A number of computer programs, such as Primer Express (Applied Biosystems, Foster City, Calif.), can be used to rapidly obtain optimal primer/probe sets. It will be apparent to one of skill in the art that such primers and probes for detecting the SNPs of the present invention are useful in, for example, screening individuals for their likelihood of responding to statin treatment (i.e., benefiting from statin treatment), particularly individuals who have or are susceptible to CVD (particularly CHD, such as MI), or in screening for individuals who are susceptible to developing CVD. These probes and primers can be readily incorporated into a kit format. The present invention also includes modifications of the Taqman assay well known in the art such as the use of Molecular Beacon probes (U.S. Pat. Nos. 5,118,801 and 5,312,728) and other variant formats (U.S. Pat. Nos. 5,866,336 and 6,117,635).

Another preferred method for genotyping the SNPs of the present invention is the use of two oligonucleotide probes in an OLA (see, e.g., U.S. Pat. No. 4,988,617). In this method, one probe hybridizes to a segment of a target nucleic acid with its 3' most end aligned with the SNP site. A second probe hybridizes to an adjacent segment of the target nucleic acid molecule directly 3' to the first probe. The two juxtaposed probes hybridize to the target nucleic acid molecule, and are ligated in the presence of a linking agent such as a ligase if there is perfect complementarity between the 3' most nucleotide of the first probe with the SNP site. If there is a mismatch, ligation would not occur. After the reaction, the ligated probes are separated from the target nucleic acid molecule, and detected as indicators of the presence of a SNP.

The following patents, patent applications, and published international patent applications, which are all hereby incorporated by reference, provide additional information pertaining to techniques for carrying out various types of OLA. The following U.S. patents describe OLA strategies for performing SNP detection: U.S. Pat. Nos. 6,027,889; 6,268,148; 5,494,810; 5,830,711 and 6,054,564. WO 97/31256 and WO 00/56927 describe OLA strategies for performing SNP detection using universal arrays, wherein a zipcode sequence can be introduced into one of the hybridization probes, and the resulting product, or amplified product, hybridized to a universal zip code array. U.S. application US01/17329 (and Ser. No. 09/584,905) describes OLA (or LDR) followed by PCR, wherein zipcodes are incorporated into OLA probes, and amplified PCR products are determined by electrophoretic or universal zipcode array readout. U.S. applications 60/427,818, 60/445,636, and 60/445,494 describe SNPlex methods and software for multiplexed SNP detection using OLA followed by PCR, wherein zipcodes are incorporated into OLA probes, and amplified PCR products are hybridized with a zipchute reagent, and the identity of the SNP determined from electrophoretic readout of the zipchute. In some embodiments, OLA is carried out prior to PCR (or another method of nucleic acid amplification). In other embodiments, PCR (or another method of nucleic acid amplification) is carried out prior to OLA.

Another method for SNP genotyping is based on mass spectrometry. Mass spectrometry takes advantage of the unique mass of each of the four nucleotides of DNA. SNPs can be unambiguously genotyped by mass spectrometry by measuring the differences in the mass of nucleic acids having alternative SNP alleles. MALDI-TOF (Matrix Assisted Laser Desorption Ionization—Time of Flight) mass spectrometry technology is preferred for extremely precise determinations of molecular mass, such as SNPs. Numerous approaches to SNP analysis have been developed based on mass spectrometry. Preferred mass spectrometry-based methods of SNP genotyping include primer extension assays, which can also be utilized in combination with other approaches, such as traditional gel-based formats and microarrays.

Typically, the primer extension assay involves designing and annealing a primer to a template PCR amplicon upstream (5') from a target SNP position. A mix of dideoxynucleotide triphosphates (ddNTPs) and/or deoxynucleotide triphosphates (dNTPs) are added to a reaction mixture containing template (e.g., a SNP-containing nucleic acid molecule which has typically been amplified, such as by PCR), primer, and DNA polymerase. Extension of the primer terminates at the first position in the template where a nucleotide complementary to one of the ddNTPs in the mix occurs. The primer can be either immediately adjacent (i.e., the nucleotide at the 3' end of the primer hybridizes to the nucleotide next to the target SNP site) or two or more nucleotides removed from the SNP position. If the primer is several nucleotides removed from the target SNP position, the only limitation is that the template sequence between the 3' end of the primer and the SNP position cannot contain a nucleotide of the same type as the one to be detected, or this will cause premature termination of the extension primer. Alternatively, if all four ddNTPs alone, with no dNTPs, are added to the reaction mixture, the primer will always be extended by only one nucleotide, corresponding to the target SNP position. In this instance, primers are designed to bind one nucleotide upstream from the SNP position (i.e., the nucleotide at the 3' end of the primer hybridizes to the nucleotide that is immediately adjacent to the target SNP site on the 5' side of the target SNP site). Extension by only one nucleotide is preferable, as it minimizes the overall mass of the extended primer, thereby increasing the resolution of mass differences between alternative SNP nucleotides. Furthermore, mass-tagged ddNTPs can be employed in the primer extension reactions in place of unmodified ddNTPs. This increases the mass difference between primers extended with these ddNTPs, thereby providing increased sensitivity and accuracy, and is particularly useful for typing heterozygous base positions. Mass-tagging also alleviates the need for intensive sample-preparation procedures and decreases the necessary resolving power of the mass spectrometer.

The extended primers can then be purified and analyzed by MALDI-TOF mass spectrometry to determine the identity of the nucleotide present at the target SNP position. In one method of analysis, the products from the primer extension reaction are combined with light absorbing crystals that form a matrix. The matrix is then hit with an energy source such as a laser to ionize and desorb the nucleic acid molecules into the gas-phase. The ionized molecules are then ejected into a flight tube and accelerated down the tube towards a detector. The time between the ionization event, such as a laser pulse, and collision of the molecule with the detector is the time of flight of that molecule. The time of flight is precisely correlated with the mass-to-charge ratio (m/z) of the ionized molecule. Ions with smaller m/z travel down the tube faster than ions with larger m/z and therefore the lighter ions reach the detector before the heavier ions. The time-of-flight is then converted into a corresponding, and highly precise, m/z. In this manner, SNPs can be identified based on the slight differences in mass, and the corresponding time of flight differences, inherent in nucleic acid molecules having different nucleotides at a single base position. For further information regarding the use of primer extension assays in conjunction with MALDI-TOF mass spectrometry for SNP genotyping, see, e.g., Wise et al., "A standard protocol for single nucleotide primer extension in the human genome using matrix-assisted laser desorption/ionization time-of-flight mass spectrometry," *Rapid Commun Mass Spectrom* 17(11):1195-202 (2003).

The following references provide further information describing mass spectrometry-based methods for SNP genotyping: Bocker, "SNP and mutation discovery using base-specific cleavage and MALDI-TOF mass spectrometry," *Bioinformatics* 19 Suppl 1:144-153 (July 2003); Storm et al., "MALDI-TOF mass spectrometry-based SNP genotyping," *Methods Mol Biol* 212:241-62 (2003); Jurinke et al., "The use of Mass ARRAY technology for high throughput genotyping," *Adv Biochem Eng Biotechnol* 77:57-74 (2002); and Jurinke et al., "Automated genotyping using the DNA MassArray technology," *Methods Mol Biol* 187:179-92 (2002).

SNPs can also be scored by direct DNA sequencing. A variety of automated sequencing procedures can be utilized (e.g. *Biotechniques* 19:448 (1995)), including sequencing by mass spectrometry. See, e.g., PCT International Publication No. WO 94/16101; Cohen et al., *Adv Chromatogr* 36:127-162 (1996); and Griffin et al., *Appl Biochem Biotechnol* 38:147-159 (1993). The nucleic acid sequences of the present invention enable one of ordinary skill in the art to readily design sequencing primers for such automated sequencing procedures. Commercial instrumentation, such as the Applied Biosystems 377, 3100, 3700, 3730, and 3730xl DNA Analyzers (Foster City, Calif.), is commonly used in the art for automated sequencing.

Other methods that can be used to genotype the SNPs of the present invention include single-strand conformational polymorphism (SSCP), and denaturing gradient gel electrophoresis (DGGE). Myers et al., *Nature* 313:495 (1985). SSCP identifies base differences by alteration in electrophoretic migration of single stranded PCR products, as described in Orita et al., *Proc. Nat. Acad.* Single-stranded PCR products can be generated by heating or otherwise denaturing double stranded PCR products. Single-stranded nucleic acids may refold or form secondary structures that are partially dependent on the base sequence. The different electrophoretic mobilities of single-stranded amplification products are related to base-sequence differences at SNP positions. DGGE differentiates SNP alleles based on the different sequence-dependent stabilities and melting properties inherent in polymorphic DNA and the corresponding differences in electrophoretic migration patterns in a denaturing gradient gel. PCR Technology: *Principles and Applications for DNA Amplification* Chapter 7, Erlich, ed., W. H. Freeman and Co, N.Y. (1992).

Sequence-specific ribozymes (U.S. Pat. No. 5,498,531) can also be used to score SNPs based on the development or loss of a ribozyme cleavage site. Perfectly matched sequences can be distinguished from mismatched sequences by nuclease cleavage digestion assays or by differences in melting temperature. If the SNP affects a restriction enzyme cleavage site, the SNP can be identified by alterations in restriction enzyme digestion patterns, and the corresponding changes in nucleic acid fragment lengths determined by gel electrophoresis.

SNP genotyping can include the steps of, for example, collecting a biological sample from a human subject (e.g., sample of tissues, cells, fluids, secretions, etc.), isolating nucleic acids (e.g., genomic DNA, mRNA or both) from the cells of the sample, contacting the nucleic acids with one or more primers which specifically hybridize to a region of the isolated nucleic acid containing a target SNP under conditions such that hybridization and amplification of the target nucleic acid region occurs, and determining the nucleotide present at the SNP position of interest, or, in some assays, detecting the presence or absence of an amplification product (assays can be designed so that hybridization and/or amplification will only occur if a particular SNP allele is present or absent). In some assays, the size of the amplification product is detected and compared to the length of a control sample; for example, deletions and insertions can be detected by a change in size of the amplified product compared to a normal genotype.

SNP genotyping is useful for numerous practical applications, as described below. Examples of such applications include, but are not limited to, SNP-disease association analysis, disease predisposition screening, disease diagnosis, disease prognosis, disease progression monitoring, determining therapeutic strategies based on an individual's genotype ("pharmacogenomics"), developing therapeutic agents based on SNP genotypes associated with a disease or likelihood of responding to a drug, stratifying patient populations for clinical trials of a therapeutic, preventive, or diagnostic agent, and predicting the likelihood that an individual will experience toxic side effects from a therapeutic agent.

Analysis of Genetic Associations between SNPs and Phenotypic Traits

SNP genotyping for disease diagnosis, disease predisposition screening, disease prognosis, determining drug responsiveness (pharmacogenomics), drug toxicity screening, and other uses described herein, typically relies on initially establishing a genetic association between one or more specific SNPs and the particular phenotypic traits of interest.

Different study designs may be used for genetic association studies. *Modern Epidemiology* 609-622, Lippincott, Williams & Wilkins (1998). Observational studies are most frequently carried out in which the response of the patients is not interfered with. The first type of observational study identifies a sample of persons in whom the suspected cause of the disease is present and another sample of persons in whom the suspected cause is absent, and then the frequency of development of disease in the two samples is compared. These sampled populations are called cohorts, and the study is a prospective study. The other type of observational study is case-control or a retrospective study. In typical case-control studies, samples are collected from individuals with the phenotype of interest (cases) such as certain manifestations of a disease, and from individuals without the phenotype (controls) in a population (target population) that conclusions are to be drawn from. Then the possible causes of the disease are investigated retrospectively. As the time and costs of collecting samples in case-control studies are considerably less than those for prospective studies, case-control studies are the more commonly used study design in genetic association studies, at least during the exploration and discovery stage.

Case-only studies are an alternative to case-control studies when gene-environment interaction is the association of interest (Piegorsch et al., "Non-hierarchical logistic models and case-only designs for assessing susceptibility in population-based case-control studies", *Statistics in Medicine* 13 (1994) pp 153-162). In a typical case-only study of gene-environment interaction, genotypes are obtained only from cases who are often selected from an existing cohort study. The association between genotypes and the environmental factor is then assessed and a significant association implies that the effect of the environmental factor on the endpoint of interest (the case definition) differs by genotype. The primary assumption underlying the test of association in case-only studies is that the environmental effect of interest is independent of genotype (e.g., allocation to statin therapy is independent of genotype) and it has been shown that the case-only design has more power than the case-control design to detect gene-environment interaction when this assumption is true in the population (Yang et al., "Sample Size Requirements in Case-Only Designs to Detect Gene-Environment Interaction", *American Journal of Epidemiology* 146:9 (1997) pp 713-720). Selecting cases from a randomized clinical trial may be an ideal setting in which to perform a case-only study since genotypes will be independent of treatment by design.

In observational studies, there may be potential confounding factors that should be taken into consideration. Confounding factors are those that are associated with both the real cause(s) of the disease and the disease itself, and they include demographic information such as age, gender, ethnicity as well as environmental factors. When confounding factors are not matched in cases and controls in a study, and are not controlled properly, spurious association results can arise. If potential confounding factors are identified, they should be controlled for by analysis methods explained below.

In a genetic association study, the cause of interest to be tested is a certain allele or a SNP or a combination of alleles or a haplotype from several SNPs. Thus, tissue specimens (e.g., whole blood) from the sampled individuals may be collected and genomic DNA genotyped for the SNP(s) of interest. In addition to the phenotypic trait of interest, other information such as demographic (e.g., age, gender, ethnicity, etc.), clinical, and environmental information that may influence the outcome of the trait can be collected to further characterize and define the sample set. In many cases, these factors are known to be associated with diseases and/or SNP allele frequencies. There are likely gene-environment and/or gene-gene interactions as well. Analysis methods to address gene-environment and gene-gene interactions (for example, the effects of the presence of both susceptibility alleles at two different genes can be greater than the effects of the individual alleles at two genes combined) are discussed below.

After all the relevant phenotypic and genotypic information has been obtained, statistical analyses are carried out to determine if there is any significant correlation between the presence of an allele or a genotype with the phenotypic characteristics of an individual. Preferably, data inspection and cleaning are first performed before carrying out statistical tests for genetic association. Epidemiological and clinical data of the samples can be summarized by descriptive statistics with tables and graphs. Data validation is preferably performed to check for data completion, inconsistent entries, and outliers. Chi-squared tests and t-tests (Wilcoxon rank-sum tests if distributions are not normal) may then be used to check for significant differences between cases and controls for discrete and continuous variables, respectively. To ensure genotyping quality, Hardy-Weinberg disequilibrium tests can be performed on cases and controls separately. Significant deviation from Hardy-Weinberg equilibrium (HWE) in both cases and controls for individual markers can be indicative of genotyping errors. If HWE is violated in a majority of markers, it is indicative of population substructure that should be further investigated. Moreover, Hardy-Weinberg disequilibrium in cases only can indicate genetic association of the markers with the disease. B. Weir, *Genetic Data Analysis*, Sinauer (1990).

To test whether an allele of a single SNP is associated with the case or control status of a phenotypic trait, one skilled in the art can compare allele frequencies in cases and controls. Standard chi-squared tests and Fisher exact tests can be carried out on a 2×2 table (2 SNP alleles×2 outcomes in the categorical trait of interest). To test whether genotypes of a SNP are associated, chi-squared tests can be carried out on a 3×2 table (3 genotypes×2 outcomes). Score tests are also carried out for genotypic association to contrast the three genotypic frequencies (major homozygotes, heterozygotes and minor homozygotes) in cases and controls, and to look for trends using 3 different modes of inheritance, namely dominant (with contrast coefficients 2, −1, −1), additive or allelic (with contrast coefficients 1, 0, −1) and recessive (with contrast coefficients 1, 1, −2). Odds ratios for minor versus major alleles, and odds ratios for heterozygote and homozygote variants versus the wild type genotypes are calculated with the desired confidence limits, usually 95%.

In order to control for confounders and to test for interaction and effect modifiers, stratified analyses may be performed using stratified factors that are likely to be confounding, including demographic information such as age, ethnicity, and gender, or an interacting element or effect modifier, such as a known major gene (e.g., APOE for Alzheimer's disease or HLA genes for autoimmune diseases), or environmental factors such as smoking in lung cancer. Stratified association tests may be carried out using Cochran-Mantel-Haenszel tests that take into account the ordinal nature of genotypes with 0, 1, and 2 variant alleles. Exact tests by StatXact may also be performed when computationally possible. Another way to adjust for confounding effects and test for interactions is to perform stepwise multiple logistic regression analysis using statistical packages such as SAS or R. Logistic regression is a model-building technique in which the best fitting and most parsimonious model is built to describe the relation between the dichotomous outcome (for instance, getting a certain disease or not) and a set of independent variables (for instance, genotypes of different associated genes, and the associated demographic and environmental factors). The most common model is one in which the logit transformation of the odds ratios is expressed as a linear combination of the variables (main effects) and their cross-product terms (interactions). Hosmer and Lemeshow, *Applied Logistic Regression*, Wiley (2000). To test whether a certain variable or interaction is significantly associated with the outcome, coefficients in the model are first estimated and then tested for statistical significance of their departure from zero.

In addition to performing association tests one marker at a time, haplotype association analysis may also be performed to study a number of markers that are closely linked together. Haplotype association tests can have better power than genotypic or allelic association tests when the tested markers are not the disease-causing mutations themselves but are in linkage disequilibrium with such mutations. The test will even be more powerful if the disease is indeed caused by a combination of alleles on a haplotype (e.g., APOE is a haplotype formed by 2 SNPs that are very close to each other). In order to perform haplotype association effectively, marker-marker linkage disequilibrium measures, both D' and $r^2$, are typically calculated for the markers within a gene to elucidate the haplotype structure. Recent studies in linkage disequilibrium indicate that SNPs within a gene are organized in block pattern, and a high degree of linkage disequilibrium exists within blocks and very little linkage disequilibrium exists between blocks. Daly et al, *Nature Genetics* 29:232-235 (2001). Haplotype association with the disease status can be performed using such blocks once they have been elucidated.

Haplotype association tests can be carried out in a similar fashion as the allelic and genotypic association tests. Each haplotype in a gene is analogous to an allele in a multi-allelic marker. One skilled in the art can either compare the haplotype frequencies in cases and controls or test genetic association with different pairs of haplotypes. It has been proposed that score tests can be done on haplotypes using the program "haplo.score." Schaid et al, *Am J Hum Genet* 70:425-434 (2002). In that method, haplotypes are first inferred by EM algorithm and score tests are carried out with a generalized linear model (GLM) framework that allows the adjustment of other factors.

An important decision in the performance of genetic association tests is the determination of the significance level at which significant association can be declared when the P value of the tests reaches that level. In an exploratory analysis where positive hits will be followed up in subsequent confirmatory testing, an unadjusted P value<0.2 (a significance level on the lenient side), for example, may be used for generating hypotheses for significant association of a SNP with certain phenotypic characteristics of a disease. It is preferred that a p-value<0.05 (a significance level traditionally used in the art) is achieved in order for a SNP to be considered to have an association with a disease. It is more preferred that a p-value<0.01 (a significance level on the stringent side) is achieved for an association to be declared. When hits are followed up in confirmatory analyses in more samples of the same source or in different samples from different sources, adjustment for multiple testing will be performed as to avoid excess number of hits while maintaining the experiment-wide error rates at 0.05. While there are different methods to adjust for multiple testing to control for different kinds of error rates, a commonly used but rather conservative method is Bonferroni correction to control the experiment-wise or family-wise error rate. Westfall et al., *Multiple comparisons and multiple tests*, SAS Institute (1999). Permutation tests to control for the false discovery rates, FDR, can be more powerful. Benjamini and Hochberg, *Journal of the Royal Statistical Society, Series B* 57:1289-1300 (1995); Westfall and Young, *Resampling-based Multiple Testing*, Wiley (1993). Such methods to control for multiplicity would be preferred when the tests are dependent and controlling for false discovery rates is sufficient as opposed to controlling for the experiment-wise error rates.

In replication studies using samples from different populations after statistically significant markers have been identified in the exploratory stage, meta-analyses can then be performed by combining evidence of different studies. *Modern Epidemiology* 643-673, Lippincott, Williams & Wilkins (1998). If available, association results known in the art for the same SNPs can be included in the meta-analyses.

Since both genotyping and disease status classification can involve errors, sensitivity analyses may be performed to see how odds ratios and p-values would change upon various estimates on genotyping and disease classification error rates.

It has been well known that subpopulation-based sampling bias between cases and controls can lead to spurious results in case-control association studies when prevalence of the disease is associated with different subpopulation groups. Ewens and Spielman, *Am J Hum Genet* 62:450-458 (1995). Such bias can also lead to a loss of statistical power in genetic association studies. To detect population stratification, Pritchard and Rosenberg suggested typing markers that are unlinked to the disease and using results of association tests on those markers to determine whether there is any population stratification. Pritchard et al., *Am J Hum Gen* 65:220-228 (1999). When stratification is detected, the genomic control (GC) method as proposed by Devlin and Roeder can be used to adjust for the inflation of test statistics due to population stratification. Devlin et al., *Biometrics* 55:997-1004 (1999). The GC method is robust to changes in population structure levels as well as being applicable to DNA pooling designs. Devlin et al., *Genet Epidem* 21:273-284 (2001).

While Pritchard's method recommended using 15-20 unlinked microsatellite markers, it suggested using more than 30 biallelic markers to get enough power to detect population stratification. For the GC method, it has been shown that about 60-70 biallelic markers are sufficient to estimate the inflation factor for the test statistics due to population stratification. Bacanu et al., *Am J Hum Genet* 66:1933-1944 (2000). Hence, 70 intergenic SNPs can be chosen in unlinked regions as indicated in a genome scan. Kehoe et al., *Hum Mol Genet* 8:237-245 (1999).

Once individual risk factors, genetic or non-genetic, have been found for the predisposition to disease, the next step is to set up a classification/prediction scheme to predict the category (for instance, disease or no-disease) that an individual will be in depending on his genotypes of associated SNPs and other non-genetic risk factors. Logistic regression for discrete trait and linear regression for continuous trait are standard techniques for such tasks. Draper and Smith, *Applied Regression Analysis*, Wiley (1998). Moreover, other techniques can also be used for setting up classification. Such techniques include, but are not limited to, MART, CART, neural network, and discriminant analyses that are suitable for use in comparing the performance of different methods. *The Elements of Statistical Learning*, Hastie, Tibshirani & Friedman, Springer (2002).

For further information about genetic association studies, see Balding, "A tutorial on statistical methods for population association studies", *Nature Reviews Genetics* 7, 781 (2006).

Disease Diagnosis and Predisposition Screening

Information on association/correlation between genotypes and disease-related phenotypes can be exploited in several ways. For example, in the case of a highly statistically significant association between one or more SNPs with predisposition to a disease for which treatment is available, detection of such a genotype pattern in an individual may justify immediate administration of treatment, or at least the institution of regular monitoring of the individual. Detection of the susceptibility alleles associated with serious disease in a couple contemplating having children may also be valuable to the couple in their reproductive decisions. In the case of a weaker but still statistically significant association between a SNP and a human disease, immediate therapeutic intervention or monitoring may not be justified after detecting the susceptibility allele or SNP. Nevertheless, the subject can be motivated to begin simple life-style changes (e.g., diet, exercise) that can be accomplished at little or no cost to the individual but would confer potential benefits in reducing the risk of developing conditions for which that individual may have an increased risk by virtue of having the risk allele(s).

The SNPs of the invention may contribute to responsiveness of an individual to statin treatment, or to the development of CVD (e.g., CHD, such as MI), in different ways. Some polymorphisms occur within a protein coding sequence and contribute to disease phenotype by affecting protein structure. Other polymorphisms occur in noncoding regions but may exert phenotypic effects indirectly via influence on, for example, replication, transcription, and/or translation. A single SNP may affect more than one phenotypic trait. Likewise, a single phenotypic trait may be affected by multiple SNPs in different genes.

As used herein, the terms "diagnose," "diagnosis," and "diagnostics" include, but are not limited to, any of the following: detection of CVD (e.g., CHD, such as MI) that an individual may presently have, predisposition/susceptibility/predictive screening (i.e., determining whether an individual has an increased or decreased risk of developing CVD in the future), predicting recurrence of CVD (e.g., recurrent MI) in an individual, determining a particular type or subclass of CVD in an individual who currently or previously had CVD, confirming or reinforcing a previously made diagnosis of CVD, evaluating an individual's likelihood of responding positively to a particular treatment or therapeutic agent (i.e., benefiting) such as statin treatment (particularly treatment or prevention of CVD, especially CHD such as MI, using statins), determining or selecting a therapeutic or preventive strategy that an individual is most likely to positively respond to (e.g., selecting a particular therapeutic agent such as a statin, or combination of therapeutic agents, or selecting a particular statin from among other statins, or determining a dosing regimen or selecting a dosage formulation, etc.), classifying (or confirming/reinforcing) an individual as a responder/non-responder (or determining a particular subtype of responder/non-responder) with respect to the individual's response to a drug treatment such as statin treatment, and predicting whether a patient is likely to experience toxic effects from a particular treatment or therapeutic compound. Such diagnostic uses can be based on the SNPs individually or a unique combination or SNPs disclosed herein, as well as SNP haplotypes.

Haplotypes are particularly useful in that, for example, fewer SNPs can be genotyped to determine if a particular genomic region harbors a locus that influences a particular phenotype, such as in linkage disequilibrium-based SNP association analysis.

Linkage disequilibrium (LD) refers to the co-inheritance of alleles (e.g., alternative nucleotides) at two or more different SNP sites at frequencies greater than would be expected from the separate frequencies of occurrence of each allele in a given population. The expected frequency of co-occurrence of two alleles that are inherited independently is the frequency of the first allele multiplied by the frequency of the second allele. Alleles that co-occur at expected frequencies are said to be in "linkage equilibrium." In contrast, LD refers to any non-random genetic association between allele(s) at two or more different SNP sites, which is generally due to the physical proximity of the two loci along a chromosome. LD can occur when two or more SNPs sites are in close physical proximity to each other on a given chromosome and therefore alleles at these SNP sites will tend to remain unseparated for multiple generations with the consequence that a particular nucleotide (allele) at one SNP site will show a non-random association with a particular nucleotide (allele) at a different SNP site located nearby. Hence, genotyping one of the SNP sites will give almost the same information as genotyping the other SNP site that is in LD.

Various degrees of LD can be encountered between two or more SNPs with the result being that some SNPs are more closely associated (i.e., in stronger LD) than others. Furthermore, the physical distance over which LD extends along a chromosome differs between different regions of the genome, and therefore the degree of physical separation between two or more SNP sites necessary for LD to occur can differ between different regions of the genome.

For diagnostic purposes and similar uses, if a particular SNP site is found to be useful for, for example, predicting an individual's response to statin treatment or an individual's susceptibility to CVD, then the skilled artisan would recognize that other SNP sites which are in LD with this SNP site would also be useful for the same purposes. Thus, polymorphisms (e.g., SNPs and/or haplotypes) that are not the actual disease-causing (causative) polymorphisms, but are in LD with such causative polymorphisms, are also useful. In such instances, the genotype of the polymorphism(s) that is/are in LD with the causative polymorphism is predictive of the genotype of the causative polymorphism and, consequently, predictive of the phenotype (e.g., response to statin treatment or risk for developing CVD) that is influenced by the causative SNP(s). Therefore, polymorphic markers that are in LD with causative polymorphisms are useful as diagnostic markers, and are particularly useful when the actual causative polymorphism(s) is/are unknown.

Examples of polymorphisms that can be in LD with one or more causative polymorphisms (and/or in LD with one or more polymorphisms that have a significant statistical association with a condition) and therefore useful for diagnosing the same condition that the causative/associated SNP(s) is used to diagnose, include other SNPs in the same gene, protein-coding, or mRNA transcript-coding region as the causative/associated SNP, other SNPs in the same exon or same intron as the causative/associated SNP, other SNPs in the same haplotype block as the causative/associated SNP, other SNPs in the same intergenic region as the causative/associated SNP, SNPs that are outside but near a gene (e.g., within 6 kb on either side, 5' or 3', of a gene boundary) that harbors a causative/associated SNP, etc. Such useful LD SNPs can be selected from among the SNPs disclosed in Table 3, for example.

Linkage disequilibrium in the human genome is reviewed in Wall et al., "Haplotype blocks and linkage disequilibrium in the human genome," *Nat Rev Genet* 4(8):587-97 (August 2003); Garner et al., "On selecting markers for association studies: patterns of linkage disequilibrium between two and three diallelic loci," *Genet Epidemiol* 24(1):57-67 (January 2003); Ardlie et al., "Patterns of linkage disequilibrium in the human genome," *Nat Rev Genet* 3(4):299-309 (April 2002); erratum in *Nat Rev Genet* 3(7):566 (July 2002); and Remm et al., "High-density genotyping and linkage disequilibrium in the human genome using chromosome 22 as a model," *Curr Opin Chem Biol* 6(1):24-30 (February 2002); J. B. S. Haldane, "The combination of linkage values, and the calculation of distances between the loci of linked factors," *J Genet* 8:299-309 (1919); G. Mendel, *Versuche über Pflanzen-Hybriden. Verhandlungen des naturforschenden Vereines in Brünn* (*Proceedings of the Natural History Society of Brünn*) (1866); *Genes IV*, B. Lewin, ed., Oxford University Press, N.Y. (1990); D. L. Hartl and A. G. Clark *Principles of Population Genetics* $2^{nd}$ ed., Sinauer Associates, Inc., Mass. (1989); J. H. Gillespie *Population Genetics: A Concise Guide.* $2^{nd}$ ed., Johns Hopkins University Press (2004); R. C. Lewontin, "The interaction of selection and linkage. I. General considerations; heterotic models," *Genetics* 49:49-67 (1964); P. G. Hoel, *Introduction to Mathematical Statistics* $2^{nd}$ed., John Wiley & Sons, Inc., N.Y. (1954); R. R. Hudson, "Two-locus sampling distributions and their application," *Genetics* 159:1805-1817 (2001); A. P. Dempster, N. M. Laird, D. B. Rubin, "Maximum likelihood from incomplete data via the EM algorithm," *J R Stat Soc* 39:1-38 (1977); L. Excoffier, M. Slatkin, "Maximum-likelihood estimation of molecular haplotype frequencies in a diploid population," *Mol Biol Evol* 12(5):921-927 (1995); D. A. Tregouet, S. Escolano, L. Tiret, A. Mallet, J. L. Golmard, "A new algorithm for haplotype-based association analysis: the Stochastic-EM algorithm," *Ann Hum Genet* 68(Pt 2):165-177 (2004); A. D. Long and C. H. Langley C H, "The power of association studies to detect the contribution of candidate genetic loci to variation in complex traits," *Genome Research* 9:720-731 (1999); A. Agresti, *Categorical Data Analysis*, John Wiley & Sons, Inc., N.Y. (1990); K. Lange, *Mathematical and Statistical Methods for Genetic Analysis*, Springer-Verlag New York, Inc., N.Y. (1997); The International HapMap Consortium, "The International HapMap Project," *Nature* 426:789-796 (2003); The International HapMap Consortium, "A haplotype map of the human genome," *Nature* 437:1299-1320 (2005); G. A. Thorisson, A. V. Smith, L. Krishnan, L. D. Stein, "The International HapMap Project Web Site," *Genome Research* 15:1591-1593 (2005); G. McVean, C. C. A. Spencer, R. Chaix, "Perspectives on human genetic variation from the HapMap project," *PLoS Genetics* 1(4):413-418 (2005); J. N. Hirschhorn, M. J. Daly, "Genome-wide association studies for common diseases and complex traits," *Nat Genet* 6:95-108 (2005); S. J. Schrodi, "A probabilistic approach to large-scale association scans: a semi-Bayesian method to detect disease-predisposing alleles," *SAGMB* 4(1):31 (2005); W. Y. S. Wang, B. J. Barratt, D. G. Clayton, J. A. Todd, "Genome-wide association studies: theoretical and practical concerns," *Nat Rev Genet* 6:109-118 (2005); J. K. Pritchard, M. Przeworski, "Linkage disequilibrium in humans: models and data," *Am J Hum Genet* 69:1-14 (2001).

As discussed above, an aspect of the present invention relates to SNPs that are in LD with an interrogated SNP and which can also be used as valid markers for determining an individual's likelihood of benefiting from statin treatment, or whether an individual has an increased or decreased risk of having or developing CVD. As used herein, the term "interrogated SNP" refers to SNPs that have been found to be associated with statin response, particularly for reducing CVD risk, using genotyping results and analysis, or other appropriate experimental method as exemplified in the working examples described in this application. As used herein, the term "LD SNP" refers to a SNP that has been characterized as a SNP associated with statin response or an increased or decreased risk of CVD due to their being in LD with the "interrogated SNP" under the methods of calculation described in the application. Below, applicants describe the methods of calculation with which one of ordinary skilled in the art may determine if a particular SNP is in LD with an interrogated SNP. The parameter $r^2$ is commonly used in the genetics art to characterize the extent of linkage disequilibrium between markers (Hudson, 2001). As used herein, the term "in LD with" refers to a particular SNP that is measured at above the threshold of a parameter such as $r^2$ with an interrogated SNP.

It is now common place to directly observe genetic variants in a sample of chromosomes obtained from a population. Suppose one has genotype data at two genetic markers located on the same chromosome, for the markers A and B. Further suppose that two alleles segregate at each of these two markers such that alleles $A_1$ and $A_2$ can be found at marker A and alleles $B_1$ and $B_2$ at marker B. Also assume that these two markers are on a human autosome. If one is to examine a specific individual and find that they are heterozygous at both markers, such that their two-marker genotype is $A_1A_2B_1B_2$, then there are two possible configurations: the individual in question could have the alleles $A_1B_1$ on one chromosome and $A_2B_2$ on the remaining chromosome; alternatively, the individual could have alleles $A_1B_2$ on one chromosome and $A_2B$, on the other. The arrangement of alleles on a chromosome is called a haplotype. In this illustration, the individual could have haplotypes $A_1B_1/A_2B_2$ or $A_1B_2/A_2B_1$ (see Hartl and Clark (1989) for a more complete description). The concept of linkage equilibrium relates the frequency of haplotypes to the allele frequencies.

Assume that a sample of individuals is selected from a larger population. Considering the two markers described above, each having two alleles, there are four possible haplotypes: $A_1B_1$, $A_1B_2$, $A_2B_1$ and $A_2B_2$. Denote the frequencies of these four haplotypes with the following notation.

$$P_{11} = \text{freq}(A_1B_1) \tag{1}$$

$$P_{12} = \text{freq}(A_1B_2) \tag{2}$$

$$P_{21} = \text{freq}(A_2B_1) \tag{3}$$

$$P_{22} = \text{freq}(A_2B_2) \tag{4}$$

The allele frequencies at the two markers are then the sum of different haplotype frequencies, it is straightforward to write down a similar set of equations relating single-marker allele frequencies to two-marker haplotype frequencies:

$$p_1 = \text{freq}(A_1) = P_{11} + P_{12} \tag{5}$$

$$p_2 = \text{freq}(A_2) = P_{21} + P_{22} \tag{6}$$

$$q_1 = \text{freq}(B_1) = P_{11} + P_{12} \tag{7}$$

$$q_2 = \text{freq}(B_2) = P_{12} + P_{22} \tag{8}$$

Note that the four haplotype frequencies and the allele frequencies at each marker must sum to a frequency of 1.

$$P_{11} + P_{12} + P_{22} = 1 \tag{9}$$

$$p_1 + p_2 = 1 \tag{10}$$

$$q_1 + q_2 = 1 \tag{11}$$

If there is no correlation between the alleles at the two markers, one would expect that the frequency of the haplotypes would be approximately the product of the composite alleles. Therefore, $$P_{11} \approx p_1 q_1 \tag{12}$$

$$P_{12} \approx p_1 q_2 \tag{13}$$

$$P_{21} \approx p_2 q_1 \tag{14}$$

$$P_{22} \approx p_2 q_2 \tag{15}$$

These approximating equations (12)-(15) represent the concept of linkage equilibrium where there is independent assortment between the two markers—the alleles at the two markers occur together at random. These are represented as approximations because linkage equilibrium and linkage disequilibrium are concepts typically thought of as properties of a sample of chromosomes; and as such they are susceptible to stochastic fluctuations due to the sampling process. Empirically, many pairs of genetic markers will be in linkage equilibrium, but certainly not all pairs.

Having established the concept of linkage equilibrium above, applicants can now describe the concept of linkage disequilibrium (LD), which is the deviation from linkage equilibrium. Since the frequency of the $A_1B_1$ haplotype is approximately the product of the allele frequencies for $A_1$ and $B_1$ under the assumption of linkage equilibrium as stated mathematically in (12), a simple measure for the amount of departure from linkage equilibrium is the difference in these two quantities, D, $$D = P_{11} - p_1 q_1 \tag{16}$$

D=0 indicates perfect linkage equilibrium. Substantial departures from D=0 indicates LD in the sample of chromosomes examined. Many properties of D are discussed in Lewontin (1964) including the maximum and minimum values that D can take. Mathematically, using basic algebra, it can be shown that D can also be written solely in terms of haplotypes:

$$D = P_{11}P_{22} - P_{12}P_{21} \tag{17}$$

If one transforms D by squaring it and subsequently dividing by the product of the allele frequencies of $A_1$, $A_2$, $B$, and $B_2$, the resulting quantity, called $r^2$, is equivalent to the square of the Pearson's correlation coefficient commonly used in statistics (e.g., Hoel, 1954).

$$r^2 = \frac{D^2}{p_1 p_2 q_1 q_2} \tag{18}$$

As with D, values of $r^2$ close to 0 indicate linkage equilibrium between the two markers examined in the sample set. As values of $r^2$ increase, the two markers are said to be in linkage disequilibrium. The range of values that $r^2$ can take are from 0 to 1. $r^2=1$ when there is a perfect correlation between the alleles at the two markers.

In addition, the quantities discussed above are sample-specific. And as such, it is necessary to formulate notation specific to the samples studied. In the approach discussed here, three types of samples are of primary interest: (i) a sample of chromosomes from individuals affected by a disease-related phenotype (cases), (ii) a sample of chromosomes obtained from individuals not affected by the disease-related phenotype (controls), and (iii) a standard sample set used for the construction of haplotypes and calculation pairwise linkage disequilibrium. For the allele frequencies used in the development of the method described below, an additional subscript will be added to denote either the case or control sample sets.

$$p_{1,cs} = \text{freq}(A_1 \text{ in cases}) \tag{19}$$

$$p_{2,cs} = \text{freq}(A_2 \text{ in cases}) \tag{20}$$

$$q_{1,cs} = \text{freq}(B_1 \text{ in cases}) \tag{21}$$

$$q_{2,cs} = \text{freq}(B_2 \text{ in cases}) \tag{22}$$

Similarly, $$p_{1,ct} = \text{freq}(A_1 \text{ in cases}) \tag{23}$$

$$p_{2,ct} = \text{freq}(A_2 \text{ in cases}) \tag{24}$$

$$q_{1,ct} = \text{freq}(B_1 \text{ in cases}) \tag{25}$$

$$q_{2,ct} = \text{freq}(B_2 \text{ in cases}) \tag{26}$$

As a well-accepted sample set is necessary for robust linkage disequilibrium calculations, data obtained from the International HapMap project (The International HapMap Consortium 2003, 2005; Thorisson et al, 2005; McVean et al, 2005) can be used for the calculation of pairwise $r^2$ values. Indeed, the samples genotyped for the International HapMap Project were selected to be representative examples from various human sub-populations with sufficient numbers of chromosomes examined to draw meaningful and robust conclusions from the patterns of genetic variation observed. The International HapMap project website (hapmap.org) contains a description of the project, methods utilized and samples examined. It is useful to examine empirical data to get a sense of the patterns present in such data.

Haplotype frequencies were explicit arguments in equation (18) above. However, knowing the 2-marker haplotype frequencies requires that phase to be determined for doubly heterozygous samples. When phase is unknown in the data examined, various algorithms can be used to infer phase from the genotype data. This issue was discussed earlier where the doubly heterozygous individual with a 2-SNP genotype of $A_1A_2B_1B_2$ could have one of two different sets of chromosomes: $A_1B_1/A_2B_2$ or $A_1B_2/A_2B_1$. One such algorithm to estimate haplotype frequencies is the expectation-maximization (EM) algorithm first formalized by Dempster et al. (1977). This algorithm is often used in genetics to infer haplotype frequencies from genotype data (e.g. Excoffier and Slatkin (1995); Tregouet et al. (2004)). It should be noted that for the two-SNP case explored here, EM algorithms have very little error provided that the allele frequencies and sample sizes are not too small. The impact on $r^2$ values is typically negligible.

As correlated genetic markers share information, interrogation of SNP markers in LD with a disease-associated SNP marker can also have sufficient power to detect disease association (Long and Langley (1999)). The relationship between the power to directly find disease-associated alleles and the power to indirectly detect disease-association was investigated by Pritchard and Przeworski (2001). In a straight-forward derivation, it can be shown that the power to detect disease association indirectly at a marker locus in linkage disequilibrium with a disease-association locus is approximately the same as the power to detect disease-association directly at the disease-association locus if the sample size is increased by a factor of $$\frac{1}{r^2}$$

(the reciprocal of equation 18) at the marker in comparison with the disease-association locus.

Therefore, if one calculated the power to detect disease-association indirectly with an experiment having N samples, then equivalent power to directly detect disease-association (at the actual disease-susceptibility locus) would necessitate an experiment using approximately $r^2N$ samples. This elementary relationship between power, sample size and linkage disequilibrium can be used to derive an $r^2$ threshold value useful in determining whether or not genotyping markers in linkage disequilibrium with a SNP marker directly associated with disease status has enough power to indirectly detect disease-association.

To commence a derivation of the power to detect disease-associated markers through an indirect process, define the effective chromosomal sample size as $$n = \frac{4N_{cs}N_{ct}}{N_{cs} + N_{ct}}; \qquad (27)$$

where $N_{cs}$ and $N_{ct}$ are the numbers of diploid cases and controls, respectively. This is necessary to handle situations where the numbers of cases and controls are not equivalent.

For equal case and control sample sizes, $N_{cs}=N_{ct}=N$, the value of the effective number of chromosomes is simply n=2N—as expected. Let power be calculated for a significance level α (such that traditional P-values below α will be deemed statistically significant). Define the standard Gaussian distribution function as $\Phi(\cdot)$. Mathematically, $$\Phi(x) = \frac{1}{\sqrt{2\pi}} \int_{-\infty}^{x} e^{-\frac{\theta^2}{2}} d\theta \qquad (28)$$

Alternatively, the following error function notation (Erf) may also be used, $$\Phi(x) = \frac{1}{2}\left[1 + \text{Erf}\left(\frac{x}{\sqrt{2}}\right)\right] \qquad (29)$$

For example, $\Phi(1.644854)=0.95$. The value of $r^2$ may be derived to yield a pre-specified minimum amount of power to detect disease association though indirect interrogation. Noting that the LD SNP marker could be the one that is carrying the disease-association allele, therefore that this approach constitutes a lower-bound model where all indirect power results are expected to be at least as large as those interrogated.

Denote by β the error rate for not detecting truly disease-associated markers. Therefore, 1−β is the classical definition of statistical power. Substituting the Pritchard-Pzreworski result into the sample size, the power to detect disease association at a significance level of α is given by the approximation $$1 - \beta \cong \Phi\left[\frac{|q_{1,cs} - q_{1,ct}|}{\sqrt{\frac{q_{1,cs}(1 - q_{1,cs}) + q_{1,ct}(1 - q_{1,ct})}{r^2 n}}} - Z_{1-\frac{\alpha}{2}}\right]; \qquad (30)$$

where $Z_u$ is the inverse of the standard normal cumulative distribution evaluated at $u (u \in (0,1))$. $Z_u=\Phi^{-1}(u)$, where $\Phi(\Phi^{-1}(u))=\Phi^{-1}((u))=u$. For example, setting α=0.05, and therefore 1−α/2=0.975, one obtains $Z_{0.975}$=1.95996. Next, setting power equal to a threshold of a minimum power of T, $$T = \Phi\left[\frac{|q_{1,cs} - q_{1,ct}|}{\sqrt{\frac{q_{1,cs}(1 - q_{1,cs}) + q_{1,ct}(1 - q_{1,ct})}{r^2 n}}} - Z_{1-\frac{\alpha}{2}}\right]; \qquad (31)$$

and solving for $r^2$, the following threshold $r^2$ is obtained:

$$r_T^2 = \frac{[q_{1,cs}(1 - q_{1,cs}) + q_{1,ct}(1 - q_{1,ct})]}{n(q_{1,cs} - q_{1,ct})^2}\left[\Phi^{-1}(T) + Z_{1-\frac{\alpha}{2}}\right]^2 \qquad (32)$$

$$r_T^2 = \frac{\left(Z_T + Z_{1-\frac{\alpha}{2}}\right)^2}{n}\left[\frac{q_{1,cs} - (q_{1,cs})^2 + q_{1,ct} - (q_{1,ct})^2}{(q_{1,cs} - q_{1,ct})^2}\right] \qquad (33)$$

Suppose that $r^2$ is calculated between an interrogated SNP and a number of other SNPs with varying levels of LD with the interrogated SNP. The threshold value $r_T^2$ is the minimum value of linkage disequilibrium between the interrogated SNP and the potential LD SNPs such that the LD SNP still retains a power greater or equal to T for detecting disease-association. For example, suppose that SNP rs200 is genotyped in a case-control disease-association study and it is found to be associated with a disease phenotype. Further suppose that the minor allele frequency in 1,000 case chromosomes was found to be 16% in contrast with a minor allele frequency of 10% in 1,000 control chromosomes. Given those measurements one could have predicted, prior to the experiment, that the power to detect disease association at a significance level of 0.05 was quite high—approximately 98% using a test of allelic association. Applying equation (32) one can calculate a minimum value of $r^2$ to indirectly assess disease association assuming that the minor allele at SNP rs200 is truly disease-predisposing for a threshold level of power. If one sets the threshold level of power to be 80%, then $r^2=0.489$ given the same significance level and chromosome numbers as above. Hence, any SNP with a pairwise $r^2$ value with rs200 greater than 0.489 is expected to have greater than 80% power to detect the disease association. Further, this is assuming the conservative model where the LD SNP is disease-associated only through linkage disequilibrium with the interrogated SNP rs200.

Imputation

Genotypes of SNPs can be imputed without actually having to be directly genotyped (referred to as "imputation"), by using known haplotype information. Imputation is a process to provide "missing" data, either missing individual genotypes (alleles) or missing SNPs and concomitant genotypes, which have not been directly genotyped (i.e., assayed). Imputation is particularly useful for identifying disease associations for specific ungenotyped SNPs by inferring the missing genotypes to these ungenotyped SNPs. Although the process uses similar information to LD, since the phasing and imputation process uses information from multiple SNPs at the same time, the phased haplotype, it is able to infer the genotype and achieve high identifiable accuracy. Genotype information (such as from the HapMap project by The International HapMap Consortium, NCBI, NLM, NIH) can be used to infer haplotype phase and impute genotypes for SNPs that are not directly genotyped in a given individual or sample set (such as for a disease association study). In general, imputation uses a reference dataset in which the genotypes of potential SNPs that are to be tested for disease association have been determined in multiple individuals (such as in HapMap); the individuals in the reference dataset are then haplotype phased. This phasing can be done with independent programs such as fastPHASE (Sheet and Stephens, *Am J Hum Genet* (2006) 76: 629-644) or a combination program such as BEAGLE which does both the phasing and the imputation. The reference phased haplotypes and process can be checked using the children of the HapMap individual parents, among other mechanisms. Once the reference phased haplotypes have been created, the imputation of additional individuals for SNPs genotyped or complete sets of SNPs that have not been directly genotyped can then proceed. The HapMap dataset is particularly useful as the reference dataset, however other datasets can be used. Since the imputation creates new concomitant phased haplotypes for individuals in the association study and these contain other SNPs within the genomic region, these ungenotyped but imputed SNPs can also be tested for disease associations (or other traits). Certain exemplary methods for haplotype phase inference and imputation of missing genotypes utilize the BEAGLE genetic analysis program, (Browning, *Hum Genet* (2008) 124:439-450).

Thus, SNPs for which genotypes are imputed can be tested for association with a disease or other trait even though these SNPs are not directly genotyped. The SNPs for which genotypes are imputed have genotype data available in the reference dataset, e.g. HapMap individuals, but they are not directly genotyped in a particular individual or sample set (such as in a particular disease association study).

In addition to using a reference dataset (e.g., HapMap) to impute genotypes of SNPs that are not directly genotyped in a study, imputation can provide genotypes of SNPs that were directly genotyped in a study but for which the genotypes are missing in some or most of the individuals for some reason, such as because they failed to pass quality control. Imputation can also be used to combine genotyping results from multiple studies in which different sets of SNPs were genotyped to construct a complete meta-analysis. For example, genotyped and imputed genotyped SNP results from multiple different studies can be combined, and the overlapping SNP genotypes (e.g., genotyped in one study, imputed in another study or imputed in both or genotyped in both) can be analyzed across all of the studies (Browning, *Hum Genet* (2008) 124:439-450).

For a review of imputation (as well as the BEAGLE program), see Browning, "Missing data imputation and haplotype phase inference for genome-wide association studies", *Hum Genet* (2008) 124:439-450 and Browning et al. "A unified approach to genotype imputation and haplotype-phase inference for large data sets of trios and unrelated individuals", *Am J Hum Genet*. (2009) February; 84(2):210-23, each of which is incorporated herein by reference in its entirety.

The contribution or association of particular SNPs with statin response or disease phenotypes, such as CVD, enables the SNPs of the present invention to be used to develop superior diagnostic tests capable of identifying individuals who express a detectable trait, such as reduced risk for CVD (particularly CHD, such as MI) in response to statin treatment, as the result of a specific genotype, or individuals whose genotype places them at an increased or decreased risk of developing a detectable trait at a subsequent time as compared to individuals who do not have that genotype. As described herein, diagnostics may be based on a single SNP or a group of SNPs. Combined detection of a plurality of SNPs (for example, 2, 3, 4, 5, 6, 7, 8, 9, 10, 11, 12, 13, 14, 15, 16, 17, 18, 19, 20, 24, 25, 30, 32, 48, 50, 64, 96, 100, or any other number in-between, or more, of the SNPs provided in Table 1 and/or Table 2) typically increases the probability of an accurate diagnosis. For example, the presence of a single SNP known to correlate with CVD might indicate a probability of 20% that an individual has or is at risk of developing CVD, whereas detection of five SNPs, each of which correlates with CVD, might indicate a probability of 80% that an individual has or is at risk of developing CVD. To further increase the accuracy of diagnosis or predisposition screening, analysis of the SNPs of the present invention can be combined with that of other polymorphisms or other risk factors of CVD, such as disease symptoms, pathological characteristics, family history, diet, environmental factors, or lifestyle factors.

It will be understood by practitioners skilled in the treatment or diagnosis of CVD that the present invention generally does not intend to provide an absolute identification of individuals who benefit from statin treatment or individuals who are at risk (or less at risk) of developing CVD, but rather to indicate a certain increased (or decreased) degree or likelihood of responding to statin therapy or developing CVD based on statistically significant association results. However, this information is extremely valuable as it can be used to, for example, encourage individuals to comply with their statin regimens as prescribed by their doctors (even though the benefit of maintaining statin therapy may not be overtly apparent, which often leads to lack of compliance with prescribed statin treatment), to initiate preventive treatments or to allow an individual carrying one or more significant SNPs or SNP haplotypes to foresee warning signs such as minor clinical symptoms, or to have regularly scheduled physical exams to monitor for appearance of a condition in order to identify and begin treatment of the condition at an early stage. Particularly with diseases that are extremely debilitating or fatal if not treated on time, the knowledge of a potential predisposition, even if this predisposition is not absolute, would likely contribute in a very significant manner to treatment efficacy.

The diagnostic techniques of the present invention may employ a variety of methodologies to determine whether a test subject has a SNP or combination of SNPs associated with an increased or decreased risk of developing a detectable trait or whether the individual suffers from a detectable trait as a result of a particular polymorphism/mutation, including, for example, methods which enable the analysis of individual chromosomes for haplotyping, family studies, single sperm DNA analysis, or somatic hybrids. The trait analyzed using the diagnostics of the invention may be any detectable trait that is commonly observed in pathologies and disorders related to CVD or drug response.

Another aspect of the present invention relates to a method of determining whether an individual is at risk (or less at risk) of developing one or more traits or whether an individual expresses one or more traits as a consequence of possessing a particular trait-causing or trait-influencing allele. These methods generally involve obtaining a nucleic acid sample from an individual and assaying the nucleic acid sample to determine which nucleotide(s) is/are present at one or more SNP positions, wherein the assayed nucleotide(s) is/are indicative of an increased or decreased risk of developing the trait or indicative that the individual expresses the trait as a result of possessing a particular trait-causing or trait-influencing allele.

In another embodiment, the SNP detection reagents of the present invention are used to determine whether an individual has one or more SNP allele(s) affecting the level (e.g., the concentration of mRNA or protein in a sample, etc.) or pattern (e.g., the kinetics of expression, rate of decomposition, stability profile, Km, Vmax, etc.) of gene expression (collectively, the "gene response" of a cell or bodily fluid). Such a determination can be accomplished by screening for mRNA or protein expression (e.g., by using nucleic acid arrays, RT-PCR, TaqMan assays, or mass spectrometry), identifying genes having altered expression in an individual, genotyping SNPs disclosed in Table 1 and/or Table 2 that could affect the expression of the genes having altered expression (e.g., SNPs that are in and/or around the gene(s) having altered expression, SNPs in regulatory/control regions, SNPs in and/or around other genes that are involved in pathways that could affect the expression of the gene(s) having altered expression, or all SNPs could be genotyped), and correlating SNP genotypes with altered gene expression. In this manner, specific SNP alleles at particular SNP sites can be identified that affect gene expression.

Therapeutics, Pharmacogenomics, and Drug Development

Therapeutic Methods and Compositions

In certain aspects of the invention, there are provided methods of assaying (i.e., testing) one or more SNPs provided by the present invention in an individual's nucleic acids, and administering a therapeutic or preventive agent to the individual based on the allele(s) present at the SNP(s) having indicated that the individual can benefit from the therapeutic or preventive agent.

In further aspects of the invention, there are provided methods of assaying one or more SNPs provided by the present invention in an individual's nucleic acids, and administering a diagnostic agent (e.g., an imaging agent), or otherwise carrying out further diagnostic procedures on the individual, based on the allele(s) present at the SNP(s) having indicated that the diagnostic agents or diagnostics procedures are justified in the individual.

In yet other aspects of the invention, there is provided a pharmaceutical pack comprising a therapeutic agent (e.g., a small molecule drug, antibody, peptide, antisense or RNAi nucleic acid molecule, etc.) and a set of instructions for administration of the therapeutic agent to an individual who has been tested for one or more SNPs provided by the present invention.

Pharmacogenomics

The present invention provides methods for assessing the pharmacogenomics of a subject harboring particular SNP alleles or haplotypes to a particular therapeutic agent or pharmaceutical compound, or to a class of such compounds. Pharmacogenomics deals with the roles which clinically significant hereditary variations (e.g., SNPs) play in the response to drugs due to altered drug disposition and/or abnormal action in affected persons. See, e.g., Roses, *Nature* 405, 857-865 (2000); Gould Rothberg, *Nature Biotechnology* 19, 209-211 (2001); Eichelbaum, *Clin Exp Pharmacol Physiol* 23(10-11):983-985 (1996); and Linder, *Clin Chem* 43(2):254-266 (1997). The clinical outcomes of these variations can result in severe toxicity of therapeutic drugs in certain individuals or therapeutic failure of drugs in certain individuals as a result of individual variation in metabolism. Thus, the SNP genotype of an individual can determine the way a therapeutic compound acts on the body or the way the body metabolizes the compound. For example, SNPs in drug metabolizing enzymes can affect the activity of these enzymes, which in turn can affect both the intensity and duration of drug action, as well as drug metabolism and clearance.

The discovery of SNPs in drug metabolizing enzymes, drug transporters, proteins for pharmaceutical agents, and other drug targets has explained why some patients do not obtain the expected drug effects, show an exaggerated drug effect, or experience serious toxicity from standard drug dosages. SNPs can be expressed in the phenotype of the extensive metabolizer and in the phenotype of the poor metabolizer. Accordingly, SNPs may lead to allelic variants of a protein in which one or more of the protein functions in one population are different from those in another population. SNPs and the encoded variant peptides thus provide targets to ascertain a genetic predisposition that can affect treatment modality. For example, in a ligand-based treatment, SNPs may give rise to amino terminal extracellular domains and/or other ligand-binding regions of a receptor that are more or less active in ligand binding, thereby affecting subsequent protein activation. Accordingly, ligand dosage would necessarily be modified to maximize the therapeutic effect within a given population containing particular SNP alleles or haplotypes.

As an alternative to genotyping, specific variant proteins containing variant amino acid sequences encoded by alternative SNP alleles could be identified. Thus, pharmacogenomic characterization of an individual permits the selection of effective compounds and effective dosages of such compounds for prophylactic or therapeutic uses based on the individual's SNP genotype, thereby enhancing and optimizing the effectiveness of the therapy. Furthermore, the production of recombinant cells and transgenic animals containing particular SNPs/haplotypes allow effective clinical design and testing of treatment compounds and dosage regimens. For example, transgenic animals can be produced that differ only in specific SNP alleles in a gene that is orthologous to a human disease susceptibility gene.

Pharmacogenomic uses of the SNPs of the present invention provide several significant advantages for patient care, particularly in predicting an individual's responsiveness to statin treatment (particularly for reducing the risk of CVD, especially CHD such as MI) and in predicting an individual's predisposition to CVD (e.g., CHD such as MI). Pharmacogenomic characterization of an individual, based on an individual's SNP genotype, can identify those individuals unlikely to respond to treatment with a particular medication and thereby allows physicians to avoid prescribing the ineffective medication to those individuals. On the other hand, SNP genotyping of an individual may enable physicians to select the appropriate medication and dosage regimen that will be most effective based on an individual's SNP genotype. This information increases a physician's confidence in prescribing medications and motivates patients to comply with their drug regimens. Furthermore, pharmacogenomics may identify patients predisposed to toxicity and adverse reactions to particular drugs or drug dosages. Adverse drug reactions lead to more than 100,000 avoidable deaths per year in the United States alone and therefore represent a significant cause of hospitalization and death, as well as a significant economic burden on the healthcare system (Pfost et al., *Trends in Biotechnology*, August 2000.). Thus, pharmacogenomics based on the SNPs disclosed herein has the potential to both save lives and reduce healthcare costs substantially.

Pharmacogenomics in general is discussed further in Rose et al., "Pharmacogenetic analysis of clinically relevant genetic polymorphisms," *Methods Mol Med* 85:225-37 (2003). Pharmacogenomics as it relates to Alzheimer's disease and other neurodegenerative disorders is discussed in Cacabelos, "Pharmacogenomics for the treatment of dementia," *Ann Med* 34(5):357-79 (2002); Maimone et al., "Pharmacogenomics of neurodegenerative diseases," *Eur J Pharmacol* 413(1):11-29 (February 2001); and Poirier, "Apolipoprotein E: a pharmacogenetic target for the treatment of Alzheimer's disease," *Mol Diagn* 4(4):335-41 (December 1999). Pharmacogenomics as it relates to cardiovascular disorders is discussed in Siest et al., "Pharmacogenomics of drugs affecting the cardiovascular system," *Clin Chem Lab Med* 41(4):590-9 (April 2003); Mukherjee et al., "Pharmacogenomics in cardiovascular diseases," *Prog Cardiovasc Dis* 44(6):479-98 (May-June 2002); and Mooser et al., "Cardiovascular pharmacogenetics in the SNP era," *J Thromb Haemost* 1(7):1398-402 (July 2003). Pharmacogenomics as it relates to cancer is discussed in McLeod et al., "Cancer pharmacogenomics: SNPs, chips, and the individual patient," *Cancer Invest* 21(4):630-40 (2003); and Watters et al., "Cancer pharmacogenomics: current and future applications," *Biochim Biophys Acta* 1603(2):99-111 (March 2003).

Clinical Trials

In certain aspects of the invention, there are provided methods of using the SNPs disclosed herein to identify or stratify patient populations for clinical trials of a therapeutic, preventive, or diagnostic agent.

For instance, an aspect of the present invention includes selecting individuals for clinical trials based on their SNP genotype, such as selecting individuals for inclusion in a clinical trial and/or assigning individuals to a particular group within a clinical trial (e.g., an "arm" of the trial). For example, individuals with SNP genotypes that indicate that they are likely to positively respond to a drug can be included in the trials, whereas those individuals whose SNP genotypes indicate that they are less likely to or would not respond to the drug, or who are at risk for suffering toxic effects or other adverse reactions, can be excluded from the clinical trials. This not only can improve the safety of clinical trials, but also can enhance the chances that the trial will demonstrate statistically significant efficacy. Further, one can stratify a prospective trial with patients with different SNP variants to determine the impact of differential drug treatment.

Thus, certain embodiments of the invention provide methods for conducting a clinical trial of a therapeutic agent in which a human is selected for inclusion in the clinical trial and/or assigned to a particular group within a clinical trial based on the presence or absence of one or more SNPs disclosed herein. In certain embodiments, the therapeutic agent is a statin.

In certain exemplary embodiments, SNPs of the invention can be used to select individuals who are unlikely to respond positively to a particular therapeutic agent (or class of therapeutic agents) based on their SNP genotype(s) to participate in a clinical trial of another type of drug that may benefit them. Thus, in certain embodiments, the SNPs of the invention can be used to identify patient populations who do not adequately respond to current treatments and are therefore in need of new therapies. This not only benefits the patients themselves, but also benefits organizations such as pharmaceutical companies by enabling the identification of populations that represent markets for new drugs, and enables the efficacy of these new drugs to be tested during clinical trials directly in individuals within these markets.

The SNP-containing nucleic acid molecules of the present invention are also useful for monitoring the effectiveness of modulating compounds on the expression or activity of a variant gene, or encoded product, particularly in a treatment regimen or in clinical trials. Thus, the gene expression pattern can serve as an indicator for the continuing effectiveness of treatment with the compound, particularly with compounds to which a patient can develop resistance, as well as an indicator for toxicities. The gene expression pattern can also serve as a marker indicative of a physiological response of the affected cells to the compound. Accordingly, such monitoring would allow either increased administration of the compound or the administration of alternative compounds to which the patient has not become resistant.

Furthermore, the SNPs of the present invention may have utility in determining why certain previously developed drugs performed poorly in clinical trials and may help identify a subset of the population that would benefit from a drug that had previously performed poorly in clinical trials, thereby "rescuing" previously developed drugs, and enabling the drug to be made available to a particular patient population (e.g., particular CVD patients) that can benefit from it.

Identification, Screening, and Use of Therapeutic Agents

The SNPs of the present invention also can be used to identify novel therapeutic targets for CVD, particularly CHD, such as MI, or stroke. For example, genes containing the disease-associated variants ("variant genes") or their products, as well as genes or their products that are directly or indirectly regulated by or interacting with these variant genes or their products, can be targeted for the development of therapeutics that, for example, treat the disease or prevent or delay disease onset. The therapeutics may be composed of, for example, small molecules, proteins, protein fragments or peptides, antibodies, nucleic acids, or their derivatives or mimetics which modulate the functions or levels of the target genes or gene products.

The invention further provides methods for identifying a compound or agent that can be used to treat CVD, particularly CHD such as MI. The SNPs disclosed herein are useful as targets for the identification and/or development of therapeutic agents. A method for identifying a therapeutic agent or compound typically includes assaying the ability of the agent or compound to modulate the activity and/or expression of a SNP-containing nucleic acid or the encoded product and thus identifying an agent or a compound that can be used to treat a disorder characterized by undesired activity or expression of the SNP-containing nucleic acid or the encoded product. The assays can be performed in cell-based and cell-free systems. Cell-based assays can include cells naturally expressing the nucleic acid molecules of interest or recombinant cells genetically engineered to express certain nucleic acid molecules.

Variant gene expression in a CVD patient can include, for example, either expression of a SNP-containing nucleic acid sequence (for instance, a gene that contains a SNP can be transcribed into an mRNA transcript molecule containing the SNP, which can in turn be translated into a variant protein) or altered expression of a normal/wild-type nucleic acid sequence due to one or more SNPs (for instance, a regulatory/control region can contain a SNP that affects the level or pattern of expression of a normal transcript).

Assays for variant gene expression can involve direct assays of nucleic acid levels (e.g., mRNA levels), expressed protein levels, or of collateral compounds involved in a signal pathway. Further, the expression of genes that are up- or down-regulated in response to the signal pathway can also be assayed. In this embodiment, the regulatory regions of these genes can be operably linked to a reporter gene such as luciferase.

Modulators of variant gene expression can be identified in a method wherein, for example, a cell is contacted with a candidate compound/agent and the expression of mRNA determined. The level of expression of mRNA in the presence of the candidate compound is compared to the level of expression of mRNA in the absence of the candidate compound. The candidate compound can then be identified as a modulator of variant gene expression based on this comparison and be used to treat a disorder such as CVD that is characterized by variant gene expression (e.g., either expression of a SNP-containing nucleic acid or altered expression of a normal/wild-type nucleic acid molecule due to one or more SNPs that affect expression of the nucleic acid molecule) due to one or more SNPs of the present invention. When expression of mRNA is statistically significantly greater in the presence of the candidate compound than in its absence, the candidate compound is identified as a stimulator of nucleic acid expression. When nucleic acid expression is statistically significantly less in the presence of the candidate compound than in its absence, the candidate compound is identified as an inhibitor of nucleic acid expression.

The invention further provides methods of treatment, with the SNP or associated nucleic acid domain (e.g., catalytic domain, ligand/substrate-binding domain, regulatory/control region, etc.) or gene, or the encoded mRNA transcript, as a target, using a compound identified through drug screening as a gene modulator to modulate variant nucleic acid expression. Modulation can include either up-regulation (i.e., activation or agonization) or down-regulation (i.e., suppression or antagonization) of nucleic acid expression.

Expression of mRNA transcripts and encoded proteins, either wild type or variant, may be altered in individuals with a particular SNP allele in a regulatory/control element, such as a promoter or transcription factor binding domain, that regulates expression. In this situation, methods of treatment and compounds can be identified, as discussed herein, that regulate or overcome the variant regulatory/control element, thereby generating normal, or healthy, expression levels of either the wild type or variant protein.

Pharmaceutical Compositions and Administration Thereof

Any of the statin response-associated proteins, and encoding nucleic acid molecules, disclosed herein can be used as therapeutic targets (or directly used themselves as therapeutic compounds) for treating or preventing CVD, and the present disclosure enables therapeutic compounds (e.g., small molecules, antibodies, therapeutic proteins, RNAi and antisense molecules, etc.) to be developed that target (or are comprised of) any of these therapeutic targets.

In general, a therapeutic compound will be administered in a therapeutically effective amount by any of the accepted modes of administration for agents that serve similar utilities. The actual amount of the therapeutic compound of this invention, i.e., the active ingredient, will depend upon numerous factors such as the severity of the disease to be treated, the age and relative health of the subject, the potency of the compound used, the route and form of administration, and other factors.

Therapeutically effective amounts of therapeutic compounds may range from, for example, approximately 0.01-50 mg per kilogram body weight of the recipient per day; preferably about 0.1-20 mg/kg/day. Thus, as an example, for administration to a 70-kg person, the dosage range would most preferably be about 7 mg to 1.4 g per day.

In general, therapeutic compounds will be administered as pharmaceutical compositions by any one of the following routes: oral, systemic (e.g., transdermal, intranasal, or by suppository), or parenteral (e.g., intramuscular, intravenous, or subcutaneous) administration. The preferred manner of administration is oral or parenteral using a convenient daily dosage regimen, which can be adjusted according to the degree of affliction. Oral compositions can take the form of tablets, pills, capsules, semisolids, powders, sustained release formulations, solutions, suspensions, elixirs, aerosols, or any other appropriate compositions.

The choice of formulation depends on various factors such as the mode of drug administration (e.g., for oral administration, formulations in the form of tablets, pills, or capsules are preferred) and the bioavailability of the drug substance. Recently, pharmaceutical formulations have been developed especially for drugs that show poor bioavailability based upon the principle that bioavailability can be increased by increasing the surface area, i.e., decreasing particle size. For example, U.S. Pat. No. 4,107,288 describes a pharmaceutical formulation having particles in the size range from 10 to 1,000 nm in which the active material is supported on a cross-linked matrix of macromolecules. U.S. Pat. No. 5,145,684 describes the production of a pharmaceutical formulation in which the drug substance is pulverized to nanoparticles (average particle size of 400 nm) in the presence of a surface modifier and then dispersed in a liquid medium to give a pharmaceutical formulation that exhibits remarkably high bioavailability.

Pharmaceutical compositions are comprised of, in general, a therapeutic compound in combination with at least one pharmaceutically acceptable excipient. Acceptable excipients are non-toxic, aid administration, and do not adversely affect the therapeutic benefit of the therapeutic compound. Such excipients may be any solid, liquid, semi-solid or, in the case of an aerosol composition, gaseous excipient that is generally available to one skilled in the art.

Solid pharmaceutical excipients include starch, cellulose, talc, glucose, lactose, sucrose, gelatin, malt, rice, flour, chalk, silica gel, magnesium stearate, sodium stearate, glycerol monostearate, sodium chloride, dried skim milk and the like. Liquid and semisolid excipients may be selected from glycerol, propylene glycol, water, ethanol and various oils, including those of petroleum, animal, vegetable or synthetic origin, e.g., peanut oil, soybean oil, mineral oil, sesame oil, etc. Preferred liquid carriers, particularly for injectable solutions, include water, saline, aqueous dextrose, and glycols.

Compressed gases may be used to disperse a compound of this invention in aerosol form. Inert gases suitable for this purpose are nitrogen, carbon dioxide, etc.

Other suitable pharmaceutical excipients and their formulations are described in *Remington's Pharmaceutical Sciences* 18$^{th}$ ed., E. W. Martin, ed., Mack Publishing Company (1990).

The amount of the therapeutic compound in a formulation can vary within the full range employed by those skilled in the art. Typically, the formulation will contain, on a weight percent (wt %) basis, from about 0.01-99.99 wt % of the therapeutic compound based on the total formulation, with the balance being one or more suitable pharmaceutical excipients. Preferably, the compound is present at a level of about 1-80% wt.

Therapeutic compounds can be administered alone or in combination with other therapeutic compounds or in combination with one or more other active ingredient(s). For example, an inhibitor or stimulator of a CVD-associated protein can be administered in combination with another agent that inhibits or stimulates the activity of the same or a different CVD-associated protein to thereby counteract the effects of CVD.

For further information regarding pharmacology, see *Current Protocols in Pharmacology*, John Wiley & Sons, Inc., N.Y.

Nucleic Acid-Based Therapeutic Agents

The SNP-containing nucleic acid molecules disclosed herein, and their complementary nucleic acid molecules, may be used as antisense constructs to control gene expression in cells, tissues, and organisms. Antisense technology is well established in the art and extensively reviewed in *Antisense Drug Technology: Principles, Strategies, and Applications*, Crooke, ed., Marcel Dekker, Inc., N.Y. (2001). An antisense nucleic acid molecule is generally designed to be complementary to a region of mRNA expressed by a gene so that the antisense molecule hybridizes to the mRNA and thereby blocks translation of mRNA into protein. Various classes of antisense oligonucleotides are used in the art, two of which are cleavers and blockers. Cleavers, by binding to target RNAs, activate intracellular nucleases (e.g., RNaseH or RNase L) that cleave the target RNA. Blockers, which also bind to target RNAs, inhibit protein translation through steric hindrance of ribosomes. Exemplary blockers include peptide nucleic acids, morpholinos, locked nucleic acids, and methylphosphonates. See, e.g., Thompson, *Drug Discovery Today* 7(17): 912-917 (2002). Antisense oligonucleotides are directly useful as therapeutic agents, and are also useful for determining and validating gene function (e.g., in gene knock-out or knock-down experiments).

Antisense technology is further reviewed in: Lavery et al., "Antisense and RNAi: powerful tools in drug target discovery and validation," *Curr Opin Drug Discov Devel* 6(4): 561-9 (July 2003); Stephens et al., "Antisense oligonucleotide therapy in cancer," *Curr Opin Mol Ther* 5(2):118-22 (April 2003); Kurreck, "Antisense technologies. Improvement through novel chemical modifications," *Eur J Biochem* 270(8):1628-44 (April 2003); Dias et al., "Antisense oligonucleotides: basic concepts and mechanisms," *Mol Cancer Ther* 1(5):347-55 (March 2002); Chen, "Clinical development of antisense oligonucleotides as anti-cancer therapeutics," *Methods Mol Med* 75:621-36 (2003); Wang et al., "Antisense anticancer oligonucleotide therapeutics," *Curr Cancer Drug Targets* 1(3):177-96 (November 2001); and Bennett, "Efficiency of antisense oligonucleotide drug discovery," Antisense *Nucleic Acid Drug Dev* 12(3):215-24 (June 2002).

The SNPs of the present invention are particularly useful for designing antisense reagents that are specific for particular nucleic acid variants. Based on the SNP information disclosed herein, antisense oligonucleotides can be produced that specifically target mRNA molecules that contain one or more particular SNP nucleotides. In this manner, expression of mRNA molecules that contain one or more undesired polymorphisms (e.g., SNP nucleotides that lead to a defective protein such as an amino acid substitution in a catalytic domain) can be inhibited or completely blocked. Thus, antisense oligonucleotides can be used to specifically bind a particular polymorphic form (e.g., a SNP allele that encodes a defective protein), thereby inhibiting translation of this form, but which do not bind an alternative polymorphic form (e.g., an alternative SNP nucleotide that encodes a protein having normal function).

Antisense molecules can be used to inactivate mRNA in order to inhibit gene expression and production of defective proteins. Accordingly, these molecules can be used to treat a disorder, such as CVD, characterized by abnormal or undesired gene expression or expression of certain defective proteins. This technique can involve cleavage by means of ribozymes containing nucleotide sequences complementary to one or more regions in the mRNA that attenuate the ability of the mRNA to be translated. Possible mRNA regions include, for example, protein-coding regions and particularly protein-coding regions corresponding to catalytic activities, substrate/ligand binding, or other functional activities of a protein.

The SNPs of the present invention are also useful for designing RNA interference reagents that specifically target nucleic acid molecules having particular SNP variants. RNA interference (RNAi), also referred to as gene silencing, is based on using double-stranded RNA (dsRNA) molecules to turn genes off. When introduced into a cell, dsRNAs are processed by the cell into short fragments (generally about 21, 22, or 23 nucleotides in length) known as small interfering RNAs (siRNAs) which the cell uses in a sequence-specific manner to recognize and destroy complementary RNAs. Thompson, *Drug Discovery Today* 7(17): 912-917 (2002). Accordingly, an aspect of the present invention specifically contemplates isolated nucleic acid molecules that are about 18-26 nucleotides in length, preferably 19-25 nucleotides in length, and more preferably 20, 21, 22, or 23 nucleotides in length, and the use of these nucleic acid molecules for RNAi. Because RNAi molecules, including siRNAs, act in a sequence-specific manner, the SNPs of the present invention can be used to design RNAi reagents that recognize and destroy nucleic acid molecules having specific SNP alleles/nucleotides (such as deleterious alleles that lead to the production of defective proteins), while not affecting nucleic acid molecules having alternative SNP alleles (such as alleles that encode proteins having normal function). As with antisense reagents, RNAi reagents may be directly useful as therapeutic agents (e.g., for turning off defective, disease-causing genes), and are also useful for characterizing and validating gene function (e.g., in gene knock-out or knock-down experiments).

The following references provide a further review of RNAi: Reynolds et al., "Rational siRNA design for RNA interference," *Nat Biotechnol* 22(3):326-30 (March 2004); Epub Feb. 1, 2004; Chi et al., "Genomewide view of gene silencing by small interfering RNAs," *PNAS* 100(11):6343-6346 (2003); Vickers et al., "Efficient Reduction of Target RNAs by Small Interfering RNA and RNase H-dependent Antisense Agents," *J Biol Chem* 278:7108-7118 (2003); Agami, "RNAi and related mechanisms and their potential use for therapy," *Curr Opin Chem Biol* 6(6):829-34 (December 2002); Lavery et al., "Antisense and RNAi: powerful tools in drug target discovery and validation," *Curr Opin Drug Discov Devel* 6(4):561-9 (July 2003); Shi, "Mammalian RNAi for the masses," *Trends Genet* 19(1):9-12 (January 2003); Shuey et al., "RNAi: gene-silencing in therapeutic intervention," *Drug Discovery Today* 7(20):1040-1046 (October 2002); McManus et al., *Nat Rev Genet* 3(10):737-47 (October 2002); Xia et al., *Nat Biotechnol* 20(10):1006-10 (October 2002); Plasterk et al., *Curr Opin Genet Dev* 10(5):562-7 (October 2000); Bosher et al., *Nat Cell Biol* 2(2):E31-6 (February 2000); and Hunter, *Curr Biol* 17; 9(12):R440-2 (June 1999).

Other Therapeutic Aspects

SNPs have many important uses in drug discovery, screening, and development, and thus the SNPs of the present invention are useful for improving many different aspects of the drug development process.

For example, a high probability exists that, for any gene/protein selected as a potential drug target, variants of that gene/protein will exist in a patient population. Thus, determining the impact of gene/protein variants on the selection and delivery of a therapeutic agent should be an integral aspect of the drug discovery and development process. Jazwinska, *A Trends Guide to Genetic Variation and Genomic Medicine* S30-S36 (March 2002).

Knowledge of variants (e.g., SNPs and any corresponding amino acid polymorphisms) of a particular therapeutic target (e.g., a gene, mRNA transcript, or protein) enables parallel screening of the variants in order to identify therapeutic candidates (e.g., small molecule compounds, antibodies, antisense or RNAi nucleic acid compounds, etc.) that demonstrate efficacy across variants. Rothberg, *Nat Biotechnol* 19(3):209-11 (March 2001). Such therapeutic candidates would be expected to show equal efficacy across a larger segment of the patient population, thereby leading to a larger potential market for the therapeutic candidate.

Furthermore, identifying variants of a potential therapeutic target enables the most common form of the target to be used for selection of therapeutic candidates, thereby helping to ensure that the experimental activity that is observed for the selected candidates reflects the real activity expected in the largest proportion of a patient population. Jazwinska, *A Trends Guide to Genetic Variation and Genomic Medicine* S30-S36 (March 2002).

Additionally, screening therapeutic candidates against all known variants of a target can enable the early identification of potential toxicities and adverse reactions relating to particular variants. For example, variability in drug absorption, distribution, metabolism and excretion (ADME) caused by, for example, SNPs in therapeutic targets or drug metabolizing genes, can be identified, and this information can be utilized during the drug development process to minimize variability in drug disposition and develop therapeutic agents that are safer across a wider range of a patient population. The SNPs of the present invention, including the variant proteins and encoding polymorphic nucleic acid molecules provided in Tables 1 and 2, are useful in conjunction with a variety of toxicology methods established in the art, such as those set forth in *Current Protocols in Toxicology*, John Wiley & Sons, Inc., N.Y.

Furthermore, therapeutic agents that target any art-known proteins (or nucleic acid molecules, either RNA or DNA) may cross-react with the variant proteins (or polymorphic nucleic acid molecules) disclosed in Table 1, thereby significantly affecting the pharmacokinetic properties of the drug. Consequently, the protein variants and the SNP-containing nucleic acid molecules disclosed in Tables 1 and 2 are useful in developing, screening, and evaluating therapeutic agents that target corresponding art-known protein forms (or nucleic acid molecules). Additionally, as discussed above, knowledge of all polymorphic forms of a particular drug target enables the design of therapeutic agents that are effective against most or all such polymorphic forms of the drug target.

A subject suffering from a pathological condition ascribed to a SNP, such as CVD, may be treated so as to correct the genetic defect. See Kren et al., *Proc Natl Acad Sci USA* 96:10349-10354 (1999). Such a subject can be identified by any method that can detect the polymorphism in a biological sample drawn from the subject. Such a genetic defect may be permanently corrected by administering to such a subject a nucleic acid fragment incorporating a repair sequence that supplies the normal/wild-type nucleotide at the position of the SNP. This site-specific repair sequence can encompass an RNA/DNA oligonucleotide that operates to promote endogenous repair of a subject's genomic DNA. The site-specific repair sequence is administered in an appropriate vehicle, such as a complex with polyethylenimine, encapsulated in anionic liposomes, a viral vector such as an adenovirus, or other pharmaceutical composition that promotes intracellular uptake of the administered nucleic acid. A genetic defect leading to an inborn pathology may then be overcome, as the chimeric oligonucleotides induce incorporation of the normal sequence into the subject's genome. Upon incorporation, the normal gene product is expressed, and the replacement is propagated, thereby engendering a permanent repair and therapeutic enhancement of the clinical condition of the subject.

In cases in which a cSNP results in a variant protein that is ascribed to be the cause of, or a contributing factor to, a pathological condition, a method of treating such a condition can include administering to a subject experiencing the pathology the wild-type/normal cognate of the variant protein. Once administered in an effective dosing regimen, the wild-type cognate provides complementation or remediation of the pathological condition.

Variant Proteins, Antibodies, Vectors, Host Cells, & Uses Thereof

Variant Proteins Encoded by SNP-Containing Nucleic Acid Molecules

The present invention provides SNP-containing nucleic acid molecules, many of which encode proteins having variant amino acid sequences as compared to the art-known (i.e., wild-type) proteins. Amino acid sequences encoded by the polymorphic nucleic acid molecules of the present invention are referred to as SEQ ID NOS: 52-102 in Table 1 and provided in the Sequence Listing. These variants will generally be referred to herein as variant proteins/peptides/polypeptides, or polymorphic proteins/peptides/polypeptides of the present invention. The terms "protein," "peptide," and "polypeptide" are used herein interchangeably.

A variant protein of the present invention may be encoded by, for example, a nonsynonymous nucleotide substitution at any one of the cSNP positions disclosed herein. In addition, variant proteins may also include proteins whose expression, structure, and/or function is altered by a SNP disclosed herein, such as a SNP that creates or destroys a stop codon, a SNP that affects splicing, and a SNP in control/regulatory elements, e.g. promoters, enhancers, or transcription factor binding domains.

As used herein, a protein or peptide is said to be "isolated" or "purified" when it is substantially free of cellular material or chemical precursors or other chemicals. The variant proteins of the present invention can be purified to homogeneity or other lower degrees of purity. The level of purification will be based on the intended use. The key feature is that the preparation allows for the desired function of the variant protein, even if in the presence of considerable amounts of other components.

As used herein, "substantially free of cellular material" includes preparations of the variant protein having less than about 30% (by dry weight) other proteins (i.e., contaminating protein), less than about 20% other proteins, less than about 10% other proteins, or less than about 5% other proteins. When the variant protein is recombinantly produced, it can also be substantially free of culture medium, i.e., culture medium represents less than about 20% of the volume of the protein preparation.

The language "substantially free of chemical precursors or other chemicals" includes preparations of the variant protein in which it is separated from chemical precursors or other chemicals that are involved in its synthesis. In one embodiment, the language "substantially free of chemical precursors or other chemicals" includes preparations of the variant protein having less than about 30% (by dry weight) chemical precursors or other chemicals, less than about 20% chemical precursors or other chemicals, less than about 10% chemical precursors or other chemicals, or less than about 5% chemical precursors or other chemicals.

An isolated variant protein may be purified from cells that naturally express it, purified from cells that have been altered to express it (recombinant host cells), or synthesized using known protein synthesis methods. For example, a nucleic acid molecule containing SNP(s) encoding the variant protein can be cloned into an expression vector, the expression vector introduced into a host cell, and the variant protein expressed in the host cell. The variant protein can then be isolated from the cells by any appropriate purification scheme using standard protein purification techniques. Examples of these techniques are described in detail below. Sambrook and Russell, *Molecular Cloning: A Laboratory Manual*, Cold Spring Harbor Laboratory Press, N.Y. (2000).

The present invention provides isolated variant proteins that comprise, consist of or consist essentially of amino acid sequences that contain one or more variant amino acids encoded by one or more codons that contain a SNP of the present invention.

Accordingly, the present invention provides variant proteins that consist of amino acid sequences that contain one or more amino acid polymorphisms (or truncations or extensions due to creation or destruction of a stop codon, respectively) encoded by the SNPs provided in Table 1 and/or Table 2. A protein consists of an amino acid sequence when the amino acid sequence is the entire amino acid sequence of the protein.

The present invention further provides variant proteins that consist essentially of amino acid sequences that contain one or more amino acid polymorphisms (or truncations or extensions due to creation or destruction of a stop codon, respectively) encoded by the SNPs provided in Table 1 and/or Table 2. A protein consists essentially of an amino acid sequence when such an amino acid sequence is present with only a few additional amino acid residues in the final protein.

The present invention further provides variant proteins that comprise amino acid sequences that contain one or more amino acid polymorphisms (or truncations or extensions due to creation or destruction of a stop codon, respectively) encoded by the SNPs provided in Table 1 and/or Table 2. A protein comprises an amino acid sequence when the amino acid sequence is at least part of the final amino acid sequence of the protein. In such a fashion, the protein may contain only the variant amino acid sequence or have additional amino acid residues, such as a contiguous encoded sequence that is naturally associated with it or heterologous amino acid residues. Such a protein can have a few additional amino acid residues or can comprise many more additional amino acids. A brief description of how various types of these proteins can be made and isolated is provided below.

The variant proteins of the present invention can be attached to heterologous sequences to form chimeric or fusion proteins. Such chimeric and fusion proteins comprise a variant protein operatively linked to a heterologous protein having an amino acid sequence not substantially homologous to the variant protein. "Operatively linked" indicates that the coding sequences for the variant protein and the heterologous protein are ligated in-frame. The heterologous protein can be fused to the N-terminus or C-terminus of the variant protein. In another embodiment, the fusion protein is encoded by a fusion polynucleotide that is synthesized by conventional techniques including automated DNA synthesizers. Alternatively, PCR amplification of gene fragments can be carried out using anchor primers which give rise to complementary overhangs between two consecutive gene fragments which can subsequently be annealed and re-amplified to generate a chimeric gene sequence. See Ausubel et al., *Current Protocols in Molecular Biology* (1992). Moreover, many expression vectors are commercially available that already encode a fusion moiety (e.g., a GST protein). A variant protein-encoding nucleic acid can be cloned into such an expression vector such that the fusion moiety is linked in-frame to the variant protein.

In many uses, the fusion protein does not affect the activity of the variant protein. The fusion protein can include, but is not limited to, enzymatic fusion proteins, for example, beta-galactosidase fusions, yeast two-hybrid GAL fusions, poly-His fusions, MYC-tagged, HI-tagged and Ig fusions. Such fusion proteins, particularly poly-His fusions, can facilitate their purification following recombinant expression. In certain host cells (e.g., mammalian host cells), expression and/or secretion of a protein can be increased by using a heterologous signal sequence. Fusion proteins are further described in, for example, Terpe, "Overview of tag protein fusions: from molecular and biochemical fundamentals to commercial systems," *Appl Microbiol Biotechnol* 60(5):523-33 (January 2003); Epub Nov. 7, 2002; Graddis et al., "Designing proteins that work using recombinant technologies," *Curr Pharm Biotechnol* 3(4):285-97 (December 2002); and Nilsson et al., "Affinity fusion strategies for detection, purification, and immobilization of recombinant proteins," *Protein Expr Purif* 11(1):1-16 (October 1997).

In certain embodiments, novel compositions of the present invention also relate to further obvious variants of the variant polypeptides of the present invention, such as naturally-occurring mature forms (e.g., allelic variants), non-naturally occurring recombinantly-derived variants, and orthologs and paralogs of such proteins that share sequence homology. Such variants can readily be generated using art-known techniques in the fields of recombinant nucleic acid technology and protein biochemistry.

Further variants of the variant polypeptides disclosed in Table 1 can comprise an amino acid sequence that shares at least 70-80%, 80-85%, 85-90%, 91%, 92%, 93%, 94%, 95%, 96%, 97%, 98%, or 99% sequence identity with an amino acid sequence disclosed in Table 1 (or a fragment thereof) and that includes a novel amino acid residue (allele) disclosed in Table 1 (which is encoded by a novel SNP allele). Thus, an aspect of the present invention that is specifically contemplated are polypeptides that have a certain degree of sequence variation compared with the polypeptide sequences shown in Table 1, but that contain a novel amino acid residue (allele) encoded by a novel SNP allele disclosed herein. In other words, as long as a polypeptide contains a novel amino acid residue disclosed herein, other portions of the polypeptide that flank the novel amino acid residue can vary to some degree from the polypeptide sequences shown in Table 1.

Full-length pre-processed forms, as well as mature processed forms, of proteins that comprise one of the amino acid sequences disclosed herein can readily be identified as having complete sequence identity to one of the variant proteins of the present invention as well as being encoded by the same genetic locus as the variant proteins provided herein.

Orthologs of a variant peptide can readily be identified as having some degree of significant sequence homology/identity to at least a portion of a variant peptide as well as being encoded by a gene from another organism. Preferred orthologs will be isolated from non-human mammals, preferably primates, for the development of human therapeutic targets and agents. Such orthologs can be encoded by a nucleic acid sequence that hybridizes to a variant peptide-encoding nucleic acid molecule under moderate to stringent conditions depending on the degree of relatedness of the two organisms yielding the homologous proteins.

Variant proteins include, but are not limited to, proteins containing deletions, additions and substitutions in the amino acid sequence caused by the SNPs of the present invention. One class of substitutions is conserved amino acid substitutions in which a given amino acid in a polypeptide is substituted for another amino acid of like characteristics. Typical conservative substitutions are replacements, one for another, among the aliphatic amino acids Ala, Val, Leu, and Ile; interchange of the hydroxyl residues Ser and Thr; exchange of the acidic residues Asp and Glu; substitution between the amide residues Asn and Gln; exchange of the basic residues Lys and Arg; and replacements among the aromatic residues Phe and Tyr. Guidance concerning which amino acid changes are likely to be phenotypically silent are found, for example, in Bowie et al., *Science* 247:1306-1310 (1990).

Variant proteins can be fully functional or can lack function in one or more activities, e.g. ability to bind another molecule, ability to catalyze a substrate, ability to mediate signaling, etc. Fully functional variants typically contain only conservative variations or variations in non-critical residues or in non-critical regions. Functional variants can also contain substitution of similar amino acids that result in no change or an insignificant change in function. Alternatively, such substitutions may positively or negatively affect function to some degree. Non-functional variants typically contain one or more non-conservative amino acid substitutions, deletions, insertions, inversions, truncations or extensions, or a substitution, insertion, inversion, or deletion of a critical residue or in a critical region.

Amino acids that are essential for function of a protein can be identified by methods known in the art, such as site-directed mutagenesis or alanine-scanning mutagenesis, particularly using the amino acid sequence and polymorphism information provided in Table 1. Cunningham et al., *Science* 244:1081-1085 (1989). The latter procedure introduces single alanine mutations at every residue in the molecule. The resulting mutant molecules are then tested for biological activity such as enzyme activity or in assays such as an in vitro proliferative activity. Sites that are critical for binding partner/substrate binding can also be determined by structural analysis such as crystallization, nuclear magnetic resonance or photoaffinity labeling. Smith et al., *J Mol Biol* 224:899-904 (1992); de Vos et al., *Science* 255:306-312 (1992).

Polypeptides can contain amino acids other than the 20 amino acids commonly referred to as the 20 naturally occurring amino acids. Further, many amino acids, including the terminal amino acids, may be modified by natural processes, such as processing and other post-translational modifications, or by chemical modification techniques well known in the art. Accordingly, the variant proteins of the present invention also encompass derivatives or analogs in which a substituted amino acid residue is not one encoded by the genetic code, in which a substituent group is included, in which the mature polypeptide is fused with another compound, such as a compound to increase the half-life of the polypeptide (e.g., polyethylene glycol), or in which additional amino acids are fused to the mature polypeptide, such as a leader or secretory sequence or a sequence for purification of the mature polypeptide or a pro-protein sequence.

Known protein modifications include, but are not limited to, acetylation, acylation, ADP-ribosylation, amidation, covalent attachment of flavin, covalent attachment of a heme moiety, covalent attachment of a nucleotide or nucleotide derivative, covalent attachment of a lipid or lipid derivative, covalent attachment of phosphotidylinositol, cross-linking, cyclization, disulfide bond formation, demethylation, formation of covalent crosslinks, formation of cystine, formation of pyroglutamate, formylation, gamma carboxylation, glycosylation, GPI anchor formation, hydroxylation, iodination, methylation, myristoylation, oxidation, proteolytic processing, phosphorylation, prenylation, racemization, selenoylation, sulfation, transfer-RNA mediated addition of amino acids to proteins such as arginylation, and ubiquitination.

Such protein modifications are well known to those of skill in the art and have been described in great detail in the scientific literature. Particularly common modifications, for example glycosylation, lipid attachment, sulfation, gamma-carboxylation of glutamic acid residues, hydroxylation and ADP-ribosylation, are described in most basic texts, such as *Proteins—Structure and Molecular Properties* 2nd Ed., T. E. Creighton, W. H. Freeman and Company, N.Y. (1993); F. Wold, *Posttranslational Covalent Modification of Proteins*

1-12, B. C. Johnson, ed., Academic Press, N.Y. (1983); Seifter et al., *Meth Enzymol* 182:626-646 (1990); and Rattan et al., *Ann NY Acad Sci* 663:48-62 (1992).

The present invention further provides fragments of the variant proteins in which the fragments contain one or more amino acid sequence variations (e.g., substitutions, or truncations or extensions due to creation or destruction of a stop codon) encoded by one or more SNPs disclosed herein. The fragments to which the invention pertains, however, are not to be construed as encompassing fragments that have been disclosed in the prior art before the present invention.

As used herein, a fragment may comprise at least about 4, 8, 10, 12, 14, 16, 18, 20, 25, 30, 50, 100 (or any other number in-between) or more contiguous amino acid residues from a variant protein, wherein at least one amino acid residue is affected by a SNP of the present invention, e.g., a variant amino acid residue encoded by a nonsynonymous nucleotide substitution at a cSNP position provided by the present invention. The variant amino acid encoded by a cSNP may occupy any residue position along the sequence of the fragment. Such fragments can be chosen based on the ability to retain one or more of the biological activities of the variant protein or the ability to perform a function, e.g., act as an immunogen. Particularly important fragments are biologically active fragments. Such fragments will typically comprise a domain or motif of a variant protein of the present invention, e.g., active site, transmembrane domain, or ligand/substrate binding domain. Other fragments include, but are not limited to, domain or motif-containing fragments, soluble peptide fragments, and fragments containing immunogenic structures. Predicted domains and functional sites are readily identifiable by computer programs well known to those of skill in the art (e.g., PROSITE analysis). *Current Protocols in Protein Science*, John Wiley & Sons, N.Y. (2002).

Uses of Variant Proteins

The variant proteins of the present invention can be used in a variety of ways, including but not limited to, in assays to determine the biological activity of a variant protein, such as in a panel of multiple proteins for high-throughput screening; to raise antibodies or to elicit another type of immune response; as a reagent (including the labeled reagent) in assays designed to quantitatively determine levels of the variant protein (or its binding partner) in biological fluids; as a marker for cells or tissues in which it is preferentially expressed (either constitutively or at a particular stage of tissue differentiation or development or in a disease state); as a target for screening for a therapeutic agent; and as a direct therapeutic agent to be administered into a human subject. Any of the variant proteins disclosed herein may be developed into reagent grade or kit format for commercialization as research products. Methods for performing the uses listed above are well known to those skilled in the art. See, e.g., *Molecular Cloning: A Laboratory Manual*, Sambrook and Russell, Cold Spring Harbor Laboratory Press, N.Y. (2000), and *Methods in Enzymology: Guide to Molecular Cloning Techniques*, S. L. Berger and A. R. Kimmel, eds., Academic Press (1987).

In a specific embodiment of the invention, the methods of the present invention include detection of one or more variant proteins disclosed herein. Variant proteins are disclosed in Table 1 and in the Sequence Listing as SEQ ID NOS: 52-102. Detection of such proteins can be accomplished using, for example, antibodies, small molecule compounds, aptamers, ligands/substrates, other proteins or protein fragments, or other protein-binding agents. Preferably, protein detection agents are specific for a variant protein of the present invention and can therefore discriminate between a variant protein of the present invention and the wild-type protein or another variant form. This can generally be accomplished by, for example, selecting or designing detection agents that bind to the region of a protein that differs between the variant and wild-type protein, such as a region of a protein that contains one or more amino acid substitutions that is/are encoded by a non-synonymous cSNP of the present invention, or a region of a protein that follows a nonsense mutation-type SNP that creates a stop codon thereby leading to a shorter polypeptide, or a region of a protein that follows a read-through mutation-type SNP that destroys a stop codon thereby leading to a longer polypeptide in which a portion of the polypeptide is present in one version of the polypeptide but not the other.

In another aspect of the invention, variant proteins of the present invention can be used as targets for predicting an individual's response to statin treatment (particularly for reducing the risk of CVD, especially CHD such as MI), for determining predisposition to CVD (particularly CHD, such as MI), for diagnosing CVD, or for treating and/or preventing CVD, etc. Accordingly, the invention provides methods for detecting the presence of, or levels of, one or more variant proteins of the present invention in a cell, tissue, or organism. Such methods typically involve contacting a test sample with an agent (e.g., an antibody, small molecule compound, or peptide) capable of interacting with the variant protein such that specific binding of the agent to the variant protein can be detected. Such an assay can be provided in a single detection format or a multi-detection format such as an array, for example, an antibody or aptamer array (arrays for protein detection may also be referred to as "protein chips"). The variant protein of interest can be isolated from a test sample and assayed for the presence of a variant amino acid sequence encoded by one or more SNPs disclosed by the present invention. The SNPs may cause changes to the protein and the corresponding protein function/activity, such as through non-synonymous substitutions in protein coding regions that can lead to amino acid substitutions, deletions, insertions, and/or rearrangements; formation or destruction of stop codons; or alteration of control elements such as promoters. SNPs may also cause inappropriate post-translational modifications.

One preferred agent for detecting a variant protein in a sample is an antibody capable of selectively binding to a variant form of the protein (antibodies are described in greater detail in the next section). Such samples include, for example, tissues, cells, and biological fluids isolated from a subject, as well as tissues, cells and fluids present within a subject.

In vitro methods for detection of the variant proteins associated with statin response that are disclosed herein and fragments thereof include, but are not limited to, enzyme linked immunosorbent assays (ELISAs), radioimmunoassays (RIA), Western blots, immunoprecipitations, immunofluorescence, and protein arrays/chips (e.g., arrays of antibodies or aptamers). For further information regarding immunoassays and related protein detection methods, see *Current Protocols in Immunology*, John Wiley & Sons, N.Y., and Hage, "Immunoassays," *Anal Chem* 15; 71(12):294R-304R (June 1999).

Additional analytic methods of detecting amino acid variants include, but are not limited to, altered electrophoretic mobility, altered tryptic peptide digest, altered protein activity in cell-based or cell-free assay, alteration in ligand or antibody-binding pattern, altered isoelectric point, and direct amino acid sequencing.

Alternatively, variant proteins can be detected in vivo in a subject by introducing into the subject a labeled antibody (or other type of detection reagent) specific for a variant protein. For example, the antibody can be labeled with a radioactive marker whose presence and location in a subject can be detected by standard imaging techniques.

Other uses of the variant peptides of the present invention are based on the class or action of the protein. For example, proteins isolated from humans and their mammalian orthologs serve as targets for identifying agents (e.g., small molecule drugs or antibodies) for use in therapeutic applications, particularly for modulating a biological or pathological response in a cell or tissue that expresses the protein. Pharmaceutical agents can be developed that modulate protein activity.

As an alternative to modulating gene expression, therapeutic compounds can be developed that modulate protein function. For example, many SNPs disclosed herein affect the amino acid sequence of the encoded protein (e.g., non-synonymous cSNPs and nonsense mutation-type SNPs). Such alterations in the encoded amino acid sequence may affect protein function, particularly if such amino acid sequence variations occur in functional protein domains, such as catalytic domains, ATP-binding domains, or ligand/substrate binding domains. It is well established in the art that variant proteins having amino acid sequence variations in functional domains can cause or influence pathological conditions. In such instances, compounds (e.g., small molecule drugs or antibodies) can be developed that target the variant protein and modulate (e.g., up- or down-regulate) protein function/activity.

The therapeutic methods of the present invention further include methods that target one or more variant proteins of the present invention. Variant proteins can be targeted using, for example, small molecule compounds, antibodies, aptamers, ligands/substrates, other proteins, or other protein-binding agents. Additionally, the skilled artisan will recognize that the novel protein variants (and polymorphic nucleic acid molecules) disclosed in Table 1 may themselves be directly used as therapeutic agents by acting as competitive inhibitors of corresponding art-known proteins (or nucleic acid molecules such as mRNA molecules).

The variant proteins of the present invention are particularly useful in drug screening assays, in cell-based or cell-free systems. Cell-based systems can utilize cells that naturally express the protein, a biopsy specimen, or cell cultures. In one embodiment, cell-based assays involve recombinant host cells expressing the variant protein. Cell-free assays can be used to detect the ability of a compound to directly bind to a variant protein or to the corresponding SNP-containing nucleic acid fragment that encodes the variant protein.

A variant protein of the present invention, as well as appropriate fragments thereof, can be used in high-throughput screening assays to test candidate compounds for the ability to bind and/or modulate the activity of the variant protein. These candidate compounds can be further screened against a protein having normal function (e.g., a wild-type/non-variant protein) to further determine the effect of the compound on the protein activity. Furthermore, these compounds can be tested in animal or invertebrate systems to determine in vivo activity/effectiveness. Compounds can be identified that activate (agonists) or inactivate (antagonists) the variant protein, and different compounds can be identified that cause various degrees of activation or inactivation of the variant protein.

Further, the variant proteins can be used to screen a compound for the ability to stimulate or inhibit interaction between the variant protein and a target molecule that normally interacts with the protein. The target can be a ligand, a substrate or a binding partner that the protein normally interacts with (for example, epinephrine or nor-epinephrine). Such assays typically include the steps of combining the variant protein with a candidate compound under conditions that allow the variant protein, or fragment thereof, to interact with the target molecule, and to detect the formation of a complex between the protein and the target or to detect the biochemical consequence of the interaction with the variant protein and the target, such as any of the associated effects of signal transduction.

Candidate compounds include, for example, 1) peptides such as soluble peptides, including Ig-tailed fusion peptides and members of random peptide libraries (see, e.g., Lam et al., Nature 354:82-84 (1991); Houghten et al., Nature 354:84-86 (1991)) and combinatorial chemistry-derived molecular libraries made of D- and/or L-configuration amino acids; 2) phosphopeptides (e.g., members of random and partially degenerate, directed phosphopeptide libraries, see, e.g., Songyang et al., Cell 72:767-778 (1993)); 3) antibodies (e.g., polyclonal, monoclonal, humanized, anti-idiotypic, chimeric, and single chain antibodies as well as Fab, $F(ab')_2$, Fab expression library fragments, and epitope-binding fragments of antibodies); and 4) small organic and inorganic molecules (e.g., molecules obtained from combinatorial and natural product libraries).

One candidate compound is a soluble fragment of the variant protein that competes for ligand binding. Other candidate compounds include mutant proteins or appropriate fragments containing mutations that affect variant protein function and thus compete for ligand. Accordingly, a fragment that competes for ligand, for example with a higher affinity, or a fragment that binds ligand but does not allow release, is encompassed by the invention.

The invention further includes other end point assays to identify compounds that modulate (stimulate or inhibit) variant protein activity. The assays typically involve an assay of events in the signal transduction pathway that indicate protein activity. Thus, the expression of genes that are up or down-regulated in response to the variant protein dependent signal cascade can be assayed. In one embodiment, the regulatory region of such genes can be operably linked to a marker that is easily detectable, such as luciferase. Alternatively, phosphorylation of the variant protein, or a variant protein target, could also be measured. Any of the biological or biochemical functions mediated by the variant protein can be used as an endpoint assay. These include all of the biochemical or biological events described herein, in the references cited herein, incorporated by reference for these endpoint assay targets, and other functions known to those of ordinary skill in the art.

Binding and/or activating compounds can also be screened by using chimeric variant proteins in which an amino terminal extracellular domain or parts thereof, an entire transmembrane domain or subregions, and/or the carboxyl terminal intracellular domain or parts thereof, can be replaced by heterologous domains or subregions. For example, a substrate-binding region can be used that interacts with a different substrate than that which is normally recognized by a variant protein. Accordingly, a different set of signal transduction components is available as an endpoint assay for activation. This allows for assays to be performed in other than the specific host cell from which the variant protein is derived.

The variant proteins are also useful in competition binding assays in methods designed to discover compounds that interact with the variant protein. Thus, a compound can be exposed to a variant protein under conditions that allow the compound to bind or to otherwise interact with the variant protein. A binding partner, such as ligand, that normally interacts with the variant protein is also added to the mixture. If the test compound interacts with the variant protein or its binding partner, it decreases the amount of complex formed or activity from the variant protein. This type of assay is particularly useful in screening for compounds that interact with specific regions of the variant protein. Hodgson, *Bio/technology*, 10(9), 973-80 (September 1992).

To perform cell-free drug screening assays, it is sometimes desirable to immobilize either the variant protein or a fragment thereof, or its target molecule, to facilitate separation of complexes from uncomplexed forms of one or both of the proteins, as well as to accommodate automation of the assay. Any method for immobilizing proteins on matrices can be used in drug screening assays. In one embodiment, a fusion protein containing an added domain allows the protein to be bound to a matrix. For example, glutathione-S-transferase/$^{125}$I fusion proteins can be adsorbed onto glutathione sepharose beads (Sigma Chemical, St. Louis, Mo.) or glutathione derivatized microtitre plates, which are then combined with the cell lysates (e.g., $^{35}$S-labeled) and a candidate compound, such as a drug candidate, and the mixture incubated under conditions conducive to complex formation (e.g., at physiological conditions for salt and pH). Following incubation, the beads can be washed to remove any unbound label, and the matrix immobilized and radiolabel determined directly, or in the supernatant after the complexes are dissociated. Alternatively, the complexes can be dissociated from the matrix, separated by SDS-PAGE, and the level of bound material found in the bead fraction quantitated from the gel using standard electrophoretic techniques.

Either the variant protein or its target molecule can be immobilized utilizing conjugation of biotin and streptavidin. Alternatively, antibodies reactive with the variant protein but which do not interfere with binding of the variant protein to its target molecule can be derivatized to the wells of the plate, and the variant protein trapped in the wells by antibody conjugation. Preparations of the target molecule and a candidate compound are incubated in the variant protein-presenting wells and the amount of complex trapped in the well can be quantitated. Methods for detecting such complexes, in addition to those described above for the GST-immobilized complexes, include immunodetection of complexes using antibodies reactive with the protein target molecule, or which are reactive with variant protein and compete with the target molecule, and enzyme-linked assays that rely on detecting an enzymatic activity associated with the target molecule.

Modulators of variant protein activity identified according to these drug screening assays can be used to treat a subject with a disorder mediated by the protein pathway, such as CVD. These methods of treatment typically include the steps of administering the modulators of protein activity in a pharmaceutical composition to a subject in need of such treatment.

The variant proteins, or fragments thereof, disclosed herein can themselves be directly used to treat a disorder characterized by an absence of, inappropriate, or unwanted expression or activity of the variant protein. Accordingly, methods for treatment include the use of a variant protein disclosed herein or fragments thereof.

In yet another aspect of the invention, variant proteins can be used as "bait proteins" in a two-hybrid assay or three-hybrid assay to identify other proteins that bind to or interact with the variant protein and are involved in variant protein activity. See, e.g., U.S. Pat. No. 5,283,317; Zervos et al., *Cell* 72:223-232 (1993); Madura et al., *J Biol Chem* 268: 12046-12054 (1993); Bartel et al., *Biotechniques* 14:920-924 (1993); Iwabuchi et al., *Oncogene* 8:1693-1696 (1993); and Brent, WO 94/10300. Such variant protein-binding proteins are also likely to be involved in the propagation of signals by the variant proteins or variant protein targets as, for example, elements of a protein-mediated signaling pathway. Alternatively, such variant protein-binding proteins are inhibitors of the variant protein.

The two-hybrid system is based on the modular nature of most transcription factors, which typically consist of separable DNA-binding and activation domains. Briefly, the assay typically utilizes two different DNA constructs. In one construct, the gene that codes for a variant protein is fused to a gene encoding the DNA binding domain of a known transcription factor (e.g., GAL-4). In the other construct, a DNA sequence, from a library of DNA sequences, that encodes an unidentified protein ("prey" or "sample") is fused to a gene that codes for the activation domain of the known transcription factor. If the "bait" and the "prey" proteins are able to interact, in vivo, forming a variant protein-dependent complex, the DNA-binding and activation domains of the transcription factor are brought into close proximity. This proximity allows transcription of a reporter gene (e.g., LacZ) that is operably linked to a transcriptional regulatory site responsive to the transcription factor. Expression of the reporter gene can be detected, and cell colonies containing the functional transcription factor can be isolated and used to obtain the cloned gene that encodes the protein that interacts with the variant protein.

Antibodies Directed to Variant Proteins

The present invention also provides antibodies that selectively bind to the variant proteins disclosed herein and fragments thereof. Such antibodies may be used to quantitatively or qualitatively detect the variant proteins of the present invention. As used herein, an antibody selectively binds a target variant protein when it binds the variant protein and does not significantly bind to non-variant proteins, i.e., the antibody does not significantly bind to normal, wild-type, or art-known proteins that do not contain a variant amino acid sequence due to one or more SNPs of the present invention (variant amino acid sequences may be due to, for example, nonsynonymous cSNPs, nonsense SNPs that create a stop codon, thereby causing a truncation of a polypeptide or SNPs that cause read-through mutations resulting in an extension of a polypeptide).

As used herein, an antibody is defined in terms consistent with that recognized in the art: they are multi-subunit proteins produced by an organism in response to an antigen challenge. The antibodies of the present invention include both monoclonal antibodies and polyclonal antibodies, as well as antigen-reactive proteolytic fragments of such antibodies, such as Fab, F(ab)'$_2$, and Fv fragments. In addition, an antibody of the present invention further includes any of a variety of engineered antigen-binding molecules such as a chimeric antibody (U.S. Pat. Nos. 4,816,567 and 4,816,397; Morrison et al., *Proc Natl Acad Sci USA* 81:6851 (1984); Neuberger et al., *Nature* 312:604 (1984)), a humanized antibody (U.S. Pat. Nos. 5,693,762; 5,585,089 and 5,565, 332), a single-chain Fv (U.S. Pat. No. 4,946,778; Ward et al., *Nature* 334:544 (1989)), a bispecific antibody with two binding specificities (Segal et al., *J Immunol Methods* 248:1

(2001); Carter, *J Immunol Methods* 248:7 (2001)), a diabody, a triabody, and a tetrabody (Todorovska et al., *J Immunol Methods* 248:47 (2001)), as well as a Fab conjugate (dimer or trimer), and a minibody.

Many methods are known in the art for generating and/or identifying antibodies to a given target antigen. Harlow, Antibodies, Cold Spring Harbor Press, N.Y. (1989). In general, an isolated peptide (e.g., a variant protein of the present invention) is used as an immunogen and is administered to a mammalian organism, such as a rat, rabbit, hamster or mouse. Either a full-length protein, an antigenic peptide fragment (e.g., a peptide fragment containing a region that varies between a variant protein and a corresponding wild-type protein), or a fusion protein can be used. A protein used as an immunogen may be naturally-occurring, synthetic or recombinantly produced, and may be administered in combination with an adjuvant, including but not limited to, Freund's (complete and incomplete), mineral gels such as aluminum hydroxide, surface active substance such as lysolecithin, pluronic polyols, polyanions, peptides, oil emulsions, keyhole limpet hemocyanin, dinitrophenol, and the like.

Monoclonal antibodies can be produced by hybridoma technology, which immortalizes cells secreting a specific monoclonal antibody. Kohler and Milstein, *Nature* 256:495 (1975). The immortalized cell lines can be created in vitro by fusing two different cell types, typically lymphocytes, and tumor cells. The hybridoma cells may be cultivated in vitro or in vivo. Additionally, fully human antibodies can be generated by transgenic animals. He et al., *J Immunol* 169:595 (2002). Fd phage and Fd phagemid technologies may be used to generate and select recombinant antibodies in vitro. Hoogenboom and Chames, *Immunol Today* 21:371 (2000); Liu et al., *J Mol Biol* 315:1063 (2002). The complementarity-determining regions of an antibody can be identified, and synthetic peptides corresponding to such regions may be used to mediate antigen binding. U.S. Pat. No. 5,637,677.

Antibodies are preferably prepared against regions or discrete fragments of a variant protein containing a variant amino acid sequence as compared to the corresponding wild-type protein (e.g., a region of a variant protein that includes an amino acid encoded by a nonsynonymous cSNP, a region affected by truncation caused by a nonsense SNP that creates a stop codon, or a region resulting from the destruction of a stop codon due to read-through mutation caused by a SNP). Furthermore, preferred regions will include those involved in function/activity and/or protein/binding partner interaction. Such fragments can be selected on a physical property, such as fragments corresponding to regions that are located on the surface of the protein, e.g., hydrophilic regions, or can be selected based on sequence uniqueness, or based on the position of the variant amino acid residue(s) encoded by the SNPs provided by the present invention. An antigenic fragment will typically comprise at least about 8-10 contiguous amino acid residues in which at least one of the amino acid residues is an amino acid affected by a SNP disclosed herein. The antigenic peptide can comprise, however, at least 12, 14, 16, 20, 25, 50, 100 (or any other number in-between) or more amino acid residues, provided that at least one amino acid is affected by a SNP disclosed herein.

Detection of an antibody of the present invention can be facilitated by coupling (i.e., physically linking) the antibody or an antigen-reactive fragment thereof to a detectable substance. Detectable substances include, but are not limited to, various enzymes, prosthetic groups, fluorescent materials, luminescent materials, bioluminescent materials, and radioactive materials. Examples of suitable enzymes include horseradish peroxidase, alkaline phosphatase, (3-galactosidase, or acetylcholinesterase; examples of suitable prosthetic group complexes include streptavidin/biotin and avidin/biotin; examples of suitable fluorescent materials include umbelliferone, fluorescein, fluorescein isothiocyanate, rhodamine, dichlorotriazinylamine fluorescein, dansyl chloride or phycoerythrin; an example of a luminescent material includes luminol; examples of bioluminescent materials include luciferase, luciferin, and aequorin, and examples of suitable radioactive material include $^{125}$I, $^{131}$I, $^{35}$S or $^{3}$H.

Antibodies, particularly the use of antibodies as therapeutic agents, are reviewed in: Morgan, "Antibody therapy for Alzheimer's disease," *Expert Rev Vaccines* (1):53-9 (February 2003); Ross et al., "Anticancer antibodies," *Am J Clin Pathol* 119(4):472-85 (April 2003); Goldenberg, "Advancing role of radiolabeled antibodies in the therapy of cancer," *Cancer Immunol Immunother* 52(5):281-96 (May 2003); Epub Mar. 11, 2003; Ross et al., "Antibody-based therapeutics in oncology," *Expert Rev Anticancer Ther* 3(1):107-21 (February 2003); Cao et al., "Bispecific antibody conjugates in therapeutics," *Adv Drug Deliv Rev* 55(2):171-97 (February 2003); von Mehren et al., "Monoclonal antibody therapy for cancer," *Annu Rev Med* 54:343-69 (2003); Epub Dec. 3, 2001; Hudson et al., "Engineered antibodies," *Nat Med* 9(1):129-34 (January 2003); Brekke et al., "Therapeutic antibodies for human diseases at the dawn of the twenty-first century," *Nat Rev Drug Discov* 2(1):52-62 (January 2003); Erratum in: *Nat Rev Drug Discov* 2(3):240 (March 2003); Houdebine, "Antibody manufacture in transgenic animals and comparisons with other systems," *Curr Opin Biotechnol* 13(6):625-9 (December 2002); Andreakos et al., "Monoclonal antibodies in immune and inflammatory diseases," *Curr Opin Biotechnol* 13(6):615-20 (December 2002); Kellermann et al., "Antibody discovery: the use of transgenic mice to generate human monoclonal antibodies for therapeutics," *Curr Opin Biotechnol* 13(6):593-7 (December 2002); Pini et al., "Phage display and colony filter screening for high-throughput selection of antibody libraries," *Comb Chem High Throughput Screen* 5(7):503-10 (November 2002); Batra et al., "Pharmacokinetics and biodistribution of genetically engineered antibodies," *Curr Opin Biotechnol* 13(6): 603-8 (December 2002); and Tangri et al., "Rationally engineered proteins or antibodies with absent or reduced immunogenicity," *Curr Med Chem* 9(24):2191-9 (December 2002).

Uses of Antibodies

Antibodies can be used to isolate the variant proteins of the present invention from a natural cell source or from recombinant host cells by standard techniques, such as affinity chromatography or immunoprecipitation. In addition, antibodies are useful for detecting the presence of a variant protein of the present invention in cells or tissues to determine the pattern of expression of the variant protein among various tissues in an organism and over the course of normal development or disease progression. Further, antibodies can be used to detect variant protein in situ, in vitro, in a bodily fluid, or in a cell lysate or supernatant in order to evaluate the amount and pattern of expression. Also, antibodies can be used to assess abnormal tissue distribution, abnormal expression during development, or expression in an abnormal condition, such as in CVD, or during statin treatment. Additionally, antibody detection of circulating fragments of the full-length variant protein can be used to identify turnover.

Antibodies to the variant proteins of the present invention are also useful in pharmacogenomic analysis. Thus, antibodies against variant proteins encoded by alternative SNP alleles can be used to identify individuals that require modified treatment modalities.

Further, antibodies can be used to assess expression of the variant protein in disease states such as in active stages of the disease or in an individual with a predisposition to a disease related to the protein's function, such as CVD, or during the course of a treatment regime, such as during statin treatment. Antibodies specific for a variant protein encoded by a SNP-containing nucleic acid molecule of the present invention can be used to assay for the presence of the variant protein, such as to determine an individual's response to statin treatment (particularly for reducing their risk for CVD, particularly CHD, such as MI, or stroke) or to diagnose CVD or predisposition/susceptibility to CVD, as indicated by the presence of the variant protein.

Antibodies are also useful as diagnostic tools for evaluating the variant proteins in conjunction with analysis by electrophoretic mobility, isoelectric point, tryptic peptide digest, and other physical assays well known in the art.

Antibodies are also useful for tissue typing. Thus, where a specific variant protein has been correlated with expression in a specific tissue, antibodies that are specific for this protein can be used to identify a tissue type.

Antibodies can also be used to assess aberrant subcellular localization of a variant protein in cells in various tissues. The diagnostic uses can be applied, not only in genetic testing, but also in monitoring a treatment modality. Accordingly, where treatment is ultimately aimed at correcting the expression level or the presence of variant protein or aberrant tissue distribution or developmental expression of a variant protein, antibodies directed against the variant protein or relevant fragments can be used to monitor therapeutic efficacy.

The antibodies are also useful for inhibiting variant protein function, for example, by blocking the binding of a variant protein to a binding partner. These uses can also be applied in a therapeutic context in which treatment involves inhibiting a variant protein's function. An antibody can be used, for example, to block or competitively inhibit binding, thus modulating (agonizing or antagonizing) the activity of a variant protein. Antibodies can be prepared against specific variant protein fragments containing sites required for function or against an intact variant protein that is associated with a cell or cell membrane. For in vivo administration, an antibody may be linked with an additional therapeutic payload such as a radionuclide, an enzyme, an immunogenic epitope, or a cytotoxic agent. Suitable cytotoxic agents include, but are not limited to, bacterial toxin such as diphtheria, and plant toxin such as ricin. The in vivo half-life of an antibody or a fragment thereof may be lengthened by pegylation through conjugation to polyethylene glycol. Leong et al., *Cytokine* 16:106 (2001).

The invention also encompasses kits for using antibodies, such as kits for detecting the presence of a variant protein in a test sample. An exemplary kit can comprise antibodies such as a labeled or labelable antibody and a compound or agent for detecting variant proteins in a biological sample; means for determining the amount, or presence/absence of variant protein in the sample; means for comparing the amount of variant protein in the sample with a standard; and instructions for use.

Vectors and Host Cells

The present invention also provides vectors containing the SNP-containing nucleic acid molecules described herein. The term "vector" refers to a vehicle, preferably a nucleic acid molecule, which can transport a SNP-containing nucleic acid molecule. When the vector is a nucleic acid molecule, the SNP-containing nucleic acid molecule can be covalently linked to the vector nucleic acid. Such vectors include, but are not limited to, a plasmid, single or double stranded phage, a single or double stranded RNA or DNA viral vector, or artificial chromosome, such as a BAC, PAC, YAC, or MAC.

A vector can be maintained in a host cell as an extrachromosomal element where it replicates and produces additional copies of the SNP-containing nucleic acid molecules. Alternatively, the vector may integrate into the host cell genome and produce additional copies of the SNP-containing nucleic acid molecules when the host cell replicates.

The invention provides vectors for the maintenance (cloning vectors) or vectors for expression (expression vectors) of the SNP-containing nucleic acid molecules. The vectors can function in prokaryotic or eukaryotic cells or in both (shuttle vectors).

Expression vectors typically contain cis-acting regulatory regions that are operably linked in the vector to the SNP-containing nucleic acid molecules such that transcription of the SNP-containing nucleic acid molecules is allowed in a host cell. The SNP-containing nucleic acid molecules can also be introduced into the host cell with a separate nucleic acid molecule capable of affecting transcription. Thus, the second nucleic acid molecule may provide a trans-acting factor interacting with the cis-regulatory control region to allow transcription of the SNP-containing nucleic acid molecules from the vector. Alternatively, a trans-acting factor may be supplied by the host cell. Finally, a trans-acting factor can be produced from the vector itself. It is understood, however, that in some embodiments, transcription and/or translation of the nucleic acid molecules can occur in a cell-free system.

The regulatory sequences to which the SNP-containing nucleic acid molecules described herein can be operably linked include promoters for directing mRNA transcription. These include, but are not limited to, the left promoter from bacteriophage λ, the lac, TRP, and TAC promoters from *E. coli*, the early and late promoters from SV40, the CMV immediate early promoter, the adenovirus early and late promoters, and retrovirus long-terminal repeats.

In addition to control regions that promote transcription, expression vectors may also include regions that modulate transcription, such as repressor binding sites and enhancers. Examples include the SV40 enhancer, the cytomegalovirus immediate early enhancer, polyoma enhancer, adenovirus enhancers, and retrovirus LTR enhancers.

In addition to containing sites for transcription initiation and control, expression vectors can also contain sequences necessary for transcription termination and, in the transcribed region, a ribosome-binding site for translation. Other regulatory control elements for expression include initiation and termination codons as well as polyadenylation signals. A person of ordinary skill in the art would be aware of the numerous regulatory sequences that are useful in expression vectors. See, e.g., Sambrook and Russell, *Molecular Cloning: A Laboratory Manual*, Cold Spring Harbor Laboratory Press, N.Y. (2000).

A variety of expression vectors can be used to express a SNP-containing nucleic acid molecule. Such vectors include chromosomal, episomal, and virus-derived vectors, for example, vectors derived from bacterial plasmids, from bacteriophage, from yeast episomes, from yeast chromosomal elements, including yeast artificial chromosomes, from viruses such as baculoviruses, papovaviruses such as SV40, Vaccinia viruses, adenoviruses, poxviruses, pseudorabies viruses, and retroviruses. Vectors can also be derived from combinations of these sources such as those derived from plasmid and bacteriophage genetic elements, e.g., cosmids and phagemids. Appropriate cloning and expression vectors for prokaryotic and eukaryotic hosts are described in Sambrook and Russell, *Molecular Cloning: A Laboratory Manual*, Cold Spring Harbor Laboratory Press, N.Y. (2000).

The regulatory sequence in a vector may provide constitutive expression in one or more host cells (e.g., tissue specific expression) or may provide for inducible expression in one or more cell types such as by temperature, nutrient additive, or exogenous factor, e.g., a hormone or other ligand. A variety of vectors that provide constitutive or inducible expression of a nucleic acid sequence in prokaryotic and eukaryotic host cells are well known to those of ordinary skill in the art.

A SNP-containing nucleic acid molecule can be inserted into the vector by methodology well-known in the art. Generally, the SNP-containing nucleic acid molecule that will ultimately be expressed is joined to an expression vector by cleaving the SNP-containing nucleic acid molecule and the expression vector with one or more restriction enzymes and then ligating the fragments together. Procedures for restriction enzyme digestion and ligation are well known to those of ordinary skill in the art.

The vector containing the appropriate nucleic acid molecule can be introduced into an appropriate host cell for propagation or expression using well-known techniques. Bacterial host cells include, but are not limited to, *Escherichia coli*, *Streptomyces* spp., and *Salmonella typhimurium*. Eukaryotic host cells include, but are not limited to, yeast, insect cells such as *Drosophila* spp., animal cells such as COS and CHO cells, and plant cells.

As described herein, it may be desirable to express the variant peptide as a fusion protein. Accordingly, the invention provides fusion vectors that allow for the production of the variant peptides. Fusion vectors can, for example, increase the expression of a recombinant protein, increase the solubility of the recombinant protein, and aid in the purification of the protein by acting, for example, as a ligand for affinity purification. A proteolytic cleavage site may be introduced at the junction of the fusion moiety so that the desired variant peptide can ultimately be separated from the fusion moiety. Proteolytic enzymes suitable for such use include, but are not limited to, factor Xa, thrombin, and enterokinase. Typical fusion expression vectors include pGEX (Smith et al., *Gene* 67:31-40 (1988)), pMAL (New England Biolabs, Beverly, Mass.) and pRIT5 (Pharmacia, Piscataway, N.J.) which fuse glutathione S-transferase (GST), maltose E binding protein, or protein A, respectively, to the target recombinant protein. Examples of suitable inducible non-fusion *E. coli* expression vectors include pTrc (Amann et al., *Gene* 69:301-315 (1988)) and pET 11d (Studier et al., *Gene Expression Technology: Methods in Enzymology* 185:60-89 (1990)).

Recombinant protein expression can be maximized in a bacterial host by providing a genetic background wherein the host cell has an impaired capacity to proteolytically cleave the recombinant protein (S. Gottesman, *Gene Expression Technology: Methods in Enzymology* 185:119-128, Academic Press, Calif. (1990)). Alternatively, the sequence of the SNP-containing nucleic acid molecule of interest can be altered to provide preferential codon usage for a specific host cell, for example, *E. coli*. Wada et al., *Nucleic Acids Res* 20:2111-2118 (1992).

The SNP-containing nucleic acid molecules can also be expressed by expression vectors that are operative in yeast. Examples of vectors for expression in yeast (e.g., *S. cerevisiae*) include pYepSec1 (Baldari et al., *EMBO J* 6:229-234 (1987)), pMFa (Kurjan et al., *Cell* 30:933-943 (1982)), pJRY88 (Schultz et al., *Gene* 54:113-123 (1987)), and pYES2 (Invitrogen Corporation, San Diego, Calif.).

The SNP-containing nucleic acid molecules can also be expressed in insect cells using, for example, baculovirus expression vectors. Baculovirus vectors available for expression of proteins in cultured insect cells (e.g., Sf 9 cells) include the pAc series (Smith et al., *Mol Cell Biol* 3:2156-2165 (1983)) and the pVL series (Lucklow et al., *Virology* 170:31-39 (1989)).

In certain embodiments of the invention, the SNP-containing nucleic acid molecules described herein are expressed in mammalian cells using mammalian expression vectors. Examples of mammalian expression vectors include pCDM8 (B. Seed, *Nature* 329:840(1987)) and pMT2PC (Kaufman et al., *EMBO J* 6:187-195 (1987)).

The invention also encompasses vectors in which the SNP-containing nucleic acid molecules described herein are cloned into the vector in reverse orientation, but operably linked to a regulatory sequence that permits transcription of antisense RNA. Thus, an antisense transcript can be produced to the SNP-containing nucleic acid sequences described herein, including both coding and non-coding regions. Expression of this antisense RNA is subject to each of the parameters described above in relation to expression of the sense RNA (regulatory sequences, constitutive or inducible expression, tissue-specific expression).

The invention also relates to recombinant host cells containing the vectors described herein. Host cells therefore include, for example, prokaryotic cells, lower eukaryotic cells such as yeast, other eukaryotic cells such as insect cells, and higher eukaryotic cells such as mammalian cells.

The recombinant host cells can be prepared by introducing the vector constructs described herein into the cells by techniques readily available to persons of ordinary skill in the art. These include, but are not limited to, calcium phosphate transfection, DEAE-dextran-mediated transfection, cationic lipid-mediated transfection, electroporation, transduction, infection, lipofection, and other techniques such as those described in Sambrook and Russell, *Molecular Cloning: A Laboratory Manual*, Cold Spring Harbor Laboratory, Cold Spring Harbor Laboratory Press, N.Y. (2000).

Host cells can contain more than one vector. Thus, different SNP-containing nucleotide sequences can be introduced in different vectors into the same cell. Similarly, the SNP-containing nucleic acid molecules can be introduced either alone or with other nucleic acid molecules that are not related to the SNP-containing nucleic acid molecules, such as those providing trans-acting factors for expression vectors. When more than one vector is introduced into a cell, the vectors can be introduced independently, co-introduced, or joined to the nucleic acid molecule vector.

In the case of bacteriophage and viral vectors, these can be introduced into cells as packaged or encapsulated virus by standard procedures for infection and transduction. Viral vectors can be replication-competent or replication-defective. In the case in which viral replication is defective, replication can occur in host cells that provide functions that complement the defects.

Vectors generally include selectable markers that enable the selection of the subpopulation of cells that contain the recombinant vector constructs. The marker can be inserted in the same vector that contains the SNP-containing nucleic acid molecules described herein or may be in a separate vector. Markers include, for example, tetracycline or ampicillin-resistance genes for prokaryotic host cells, and dihydrofolate reductase or neomycin resistance genes for eukaryotic host cells. However, any marker that provides selection for a phenotypic trait can be effective.

While the mature variant proteins can be produced in bacteria, yeast, mammalian cells, and other cells under the control of the appropriate regulatory sequences, cell-free transcription and translation systems can also be used to produce these variant proteins using RNA derived from the DNA constructs described herein.

Where secretion of the variant protein is desired, which is difficult to achieve with multi-transmembrane domain containing proteins such as G-protein-coupled receptors (GPCRs), appropriate secretion signals can be incorporated into the vector. The signal sequence can be endogenous to the peptides or heterologous to these peptides.

Where the variant protein is not secreted into the medium, the protein can be isolated from the host cell by standard disruption procedures, including freeze/thaw, sonication, mechanical disruption, use of lysing agents, and the like. The variant protein can then be recovered and purified by well-known purification methods including, for example, ammonium sulfate precipitation, acid extraction, anion or cationic exchange chromatography, phosphocellulose chromatography, hydrophobic-interaction chromatography, affinity chromatography, hydroxylapatite chromatography, lectin chromatography, or high performance liquid chromatography.

It is also understood that, depending upon the host cell in which recombinant production of the variant proteins described herein occurs, they can have various glycosylation patterns, or may be non-glycosylated, as when produced in bacteria. In addition, the variant proteins may include an initial modified methionine in some cases as a result of a host-mediated process.

For further information regarding vectors and host cells, see *Current Protocols in Molecular Biology*, John Wiley & Sons, N.Y.

Uses of Vectors and Host Cells, and Transgenic Animals

Recombinant host cells that express the variant proteins described herein have a variety of uses. For example, the cells are useful for producing a variant protein that can be further purified into a preparation of desired amounts of the variant protein or fragments thereof. Thus, host cells containing expression vectors are useful for variant protein production.

Host cells are also useful for conducting cell-based assays involving the variant protein or variant protein fragments, such as those described above as well as other formats known in the art. Thus, a recombinant host cell expressing a variant protein is useful for assaying compounds that stimulate or inhibit variant protein function. Such an ability of a compound to modulate variant protein function may not be apparent from assays of the compound on the native/ wild-type protein, or from cell-free assays of the compound. Recombinant host cells are also useful for assaying functional alterations in the variant proteins as compared with a known function.

Genetically-engineered host cells can be further used to produce non-human transgenic animals. A transgenic animal is preferably a non-human mammal, for example, a rodent, such as a rat or mouse, in which one or more of the cells of the animal include a transgene. A transgene is exogenous DNA containing a SNP of the present invention which is integrated into the genome of a cell from which a transgenic animal develops and which remains in the genome of the mature animal in one or more of its cell types or tissues. Such animals are useful for studying the function of a variant protein in vivo, and identifying and evaluating modulators of variant protein activity. Other examples of transgenic animals include, but are not limited to, non-human primates, sheep, dogs, cows, goats, chickens, and amphibians. Transgenic non-human mammals such as cows and goats can be used to produce variant proteins which can be secreted in the animal's milk and then recovered.

A transgenic animal can be produced by introducing a SNP-containing nucleic acid molecule into the male pronuclei of a fertilized oocyte, e.g., by microinjection or retroviral infection, and allowing the oocyte to develop in a pseudopregnant female foster animal. Any nucleic acid molecules that contain one or more SNPs of the present invention can potentially be introduced as a transgene into the genome of a non-human animal.

Any of the regulatory or other sequences useful in expression vectors can form part of the transgenic sequence. This includes intronic sequences and polyadenylation signals, if not already included. A tissue-specific regulatory sequence(s) can be operably linked to the transgene to direct expression of the variant protein in particular cells or tissues.

Methods for generating transgenic animals via embryo manipulation and microinjection, particularly animals such as mice, have become conventional in the art and are described, for example, in U.S. Pat. Nos. 4,736,866 and 4,870,009, both by Leder et al.; U.S. Pat. No. 4,873,191 by Wagner et al., and in B. Hogan, *Manipulating the Mouse Embryo*, Cold Spring Harbor Laboratory Press, N.Y. (1986). Similar methods are used for production of other transgenic animals. A transgenic founder animal can be identified based upon the presence of the transgene in its genome and/or expression of transgenic mRNA in tissues or cells of the animals. A transgenic founder animal can then be used to breed additional animals carrying the transgene. Moreover, transgenic animals carrying a transgene can further be bred to other transgenic animals carrying other transgenes. A transgenic animal also includes a non-human animal in which the entire animal or tissues in the animal have been produced using the homologously recombinant host cells described herein.

In another embodiment, transgenic non-human animals can be produced which contain selected systems that allow for regulated expression of the transgene. One example of such a system is the cre/loxP recombinase system of bacteriophage P1. Lakso et al., *PNAS* 89:6232-6236 (1992). Another example of a recombinase system is the FLP recombinase system of *S. cerevisiae*. O'Gorman et al., *Science* 251:1351-1355 (1991). If a cre/loxP recombinase system is used to regulate expression of the transgene, animals containing transgenes encoding both the Cre recombinase and a selected protein are generally needed. Such animals can be provided through the construction of "double" transgenic animals, e.g., by mating two transgenic animals, one containing a transgene encoding a selected variant protein and the other containing a transgene encoding a recombinase.

Clones of the non-human transgenic animals described herein can also be produced according to the methods described, for example, in I. Wilmut et al., *Nature* 385:810-813 (1997) and PCT International Publication Nos. WO 97/07668 and WO 97/07669. In brief, a cell (e.g., a somatic cell) from the transgenic animal can be isolated and induced to exit the growth cycle and enter $G_o$ phase. The quiescent cell can then be fused, e.g., through the use of electrical pulses, to an enucleated oocyte from an animal of the same species from which the quiescent cell is isolated. The reconstructed oocyte is then cultured such that it develops to morula or blastocyst and then transferred to pseudopregnant female foster animal. The offspring born of this female foster animal will be a clone of the animal from which the cell (e.g., a somatic cell) is isolated.

Transgenic animals containing recombinant cells that express the variant proteins described herein are useful for conducting the assays described herein in an in vivo context. Accordingly, the various physiological factors that are present in vivo and that could influence ligand or substrate binding, variant protein activation, signal transduction, or other processes or interactions, may not be evident from in vitro cell-free or cell-based assays. Thus, non-human transgenic animals of the present invention may be used to assay in vivo variant protein function as well as the activities of a therapeutic agent or compound that modulates variant protein function/activity or expression. Such animals are also suitable for assessing the effects of null mutations (i.e., mutations that substantially or completely eliminate one or more variant protein functions).

For further information regarding transgenic animals, see Houdebine, "Antibody manufacture in transgenic animals and comparisons with other systems," *Curr Opin Biotechnol* 13(6):625-9 (December 2002); Petters et al., "Transgenic animals as models for human disease," *Transgenic Res* 9(4-5):347-51, discussion 345-6 (2000); Wolf et al., "Use of transgenic animals in understanding molecular mechanisms of toxicity," *J Pharm Pharmacol* 50(6):567-74 (June 1998); Echelard, "Recombinant protein production in transgenic animals," *Curr Opin Biotechnol* 7(5):536-40 (October 1996); Houdebine, "Transgenic animal bioreactors," *Transgenic Res* 9(4-5):305-20 (2000); Pirity et al., "Embryonic stem cells, creating transgenic animals," *Methods Cell Biol* 57:279-93 (1998); and Robl et al., "Artificial chromosome vectors and expression of complex proteins in transgenic animals," *Theriogenology* 59(1):107-13 (January 2003).

EXAMPLES

The following examples are offered to illustrate, but not limit, the claimed invention.

Example 1: SNPs Associated with Statin Response in CARE, WOSCOPS, and PROVE IT-TIMI 22

Overview

In the study described here in Example 1, cohort and case-only study designs were used to identify SNPs associated with response to statin treatment. The entire cohort (individuals with and without incident CHD or CVD events) or cases only (only individuals with an incident CHD or CVD event) were analyzed in sample sets from the CARE, WOSCOPS, and PROVE IT. Specifically, analyses were carried out using these three sample sets to identify SNPs associated with a reduction in the risk of CHD or CVD (CVD includes CHD and stroke), the results of which are provided in Tables 4-7 and Tables 9-18 (Tables 9-18 provide additional genotyped SNPs as well as imputed SNPs).

Tables 4-7 provide results of analyses of statin response for either CHD or CVD reduction, in three genetic models (dominant, recessive, and additive). Tables 4-7 provide SNPs that had a synergy index (odds ratio) with P value lower than $10^{-4}$ in a meta-analysis of CARE and WOSCOPS combined (Table 4-5) or in a meta-analysis of CARE, WOSCOPS, and PROVE-IT combined (Table 6-7), in any genetic model in either the CHD or CVD endpoint. Tables 4-5 provide meta-analyses of CARE and WOSCOPS combined, as well as logistic regression analysis of each sample set individually. Tables 6-7 provide meta-analyses of CARE, WOSCOPS, and PROVE-IT combined, as well as logistic regression analysis of each sample set individually.

Tables 5 and 7 provide analyses of certain LD SNPs in CARE and WOSCOPS (Table 5) and in CARE, WOSCOPS, and PROVE-IT (Table 7). For some SNPs, case-only data was available for a first SNP while cohort data was available for a SNP in LD with the first SNP (LD SNP), which occurred when a working kPCR assay could not be made for the first SNP. For these SNPs, the data for case-only analysis and the available data for the cohort is reported. The meta-analysis was performed with the cohort data when available. These SNPs are listed in Tables 5 and 7, with the two SNPs in LD listed one below the other, and the degree of LD ($r^2$) between each of these pairs of SNPs is provided in Table 8.

CARE, WOSCOPS, and PROVE IT-TIMI 22 Sample Sets

The CARE ("Cholesterol and Recurrent Events") and WOSCOPS ("West of Scotland Coronary Prevention Study") studies were prospective trials that assessed the effect of pravastatin (40 mg/day) on the prevention of MI and CHD. CARE was a secondary prevention trial and WOSCOPS was a primary prevention trial. The PROVE IT-TIMI 22 ("Pravastatin or Atorvastatin Evaluation and Infection Therapy: Thrombolysis in Myocardial Infarction 22"; which is interchangeably referred to herein as "PROVE-IT") trial evaluated the effectiveness of intensive therapy with high-dose atorvastatin (80 mg/day) versus moderate therapy with standard-dose pravastatin (40 mg/day, which was the dose used in the CARE and WOSCOPS trials) in preventing death or cardiovascular events in patients with a recent acute coronary syndrome.

These trials and the sample sets from these trials (such as the inclusion criteria for participants) are described in the following references. Those portions of each of the following references that pertain to the CARE, WOSCOPS, and PROVE-IT trials and sample sets are hereby incorporated by reference. CARE is described in Sacks et al., "Cholesterol and Recurrent Events Trial Investigators. The effect of pravastatin on coronary events after myocardial infarction in patients with average cholesterol levels", *N Engl J Med* 1996; 335:1001-9, and WOSCOPS is described in Shepherd et al., "West of Scotland Coronary Prevention Study Group. Prevention of coronary heart disease with pravastatin in men with hypercholesterolemia", *N Engl J Med* 1995; 333:1301-7. PROVE-IT is described in Iakoubova et al., Polymorphism in KIF6 gene and benefit from statins after acute coronary syndromes: results from the PROVE IT-TIMI 22 study", *J Am Coll Cardiol*. 2008 Jan. 29; 51(4):449-55 and Cannon et al., "Intensive versus moderate lipid lowering with statins after acute coronary syndromes", *N Engl J Med* 2004; 350:1495-504.

Endpoints

The endpoint definitions used in these analyses of CARE, WOSCOPS, and PROVE-IT (the results of which are provided in Tables 4-7) were as follows. The CHD endpoint was defined in the analyses herein of CARE as a composite endpoint of fatal CHD, definite non-fatal MI, or revascularization, and was defined in the analyses herein of WOSCOPS as a composite endpoint of death from CHD, nonfatal MI, or revascularization. In both the CARE and WOSCOPS analyses herein, the CVD endpoint was defined as a composite endpoint of CHD or stroke. The analyses herein of PROVE-IT analyzed the primary endpoint of PROVE-IT, which was a composite endpoint of revascularization (if performed at least 30 days after randomization), unstable angina requiring hospitalization, MI, all causes of death, or stroke. Thus, there was only one endpoint for PROVE-IT (the composite primary endpoint of the original PROVE-IT study, which includes some stroke cases), and this endpoint was used in the meta-analysis for both CHD and CVD provided in Tables 6-7. With respect to stroke, in the analyses herein of CARE and PROVE-IT, stroke was defined as stroke or transient ischemic attack (TIA), and in the analyses herein of WOSCOPS, stroke was defined as fatal or non-fatal stroke. Revascularization, which can include percutaneous transluminal coronary angioplasty (PTCA), stent placement, and coronary artery bypass graft (CABG), are medical interventions that indicate the presence of CHD.

Study Designs

Cohort and case-only study designs were used to identify SNPs associated with response to statin treatment. The entire cohort (individuals with and without incident CHD or CVD events; identified as "cohort" in the "Source" column of Tables 4-7) or only individuals with an incident CHD or CVD event (identified as "CaseOnly" in the "Source" column of Tables 4-7) were analyzed in sample sets from the CARE, WOSCOPS, and PROVE-IT trials to test whether the reduction of CHD/CVD events by statin therapy (for CARE and WOSCOPS studies), or by high dose atorvastatin therapy (for the PROVE IT study), differed according to genotype (a treatment by SNP interaction) for each SNP evaluated in the study.

For each SNP, a logistic regression model having treatment status as the dependent variable and SNP as the independent predictor variable was performed, with terms for age, sex and race included in the model as covariates. The anti-log of the regression coefficient corresponding to the SNP is an estimate of the synergy index (SI) (Davis et al., "Imputing gene-treatment interactions when the genotype distribution is unknown using case-only and putative placebo analyses-a new method for the Genetics of Hypertension Associated Treatment (GenHAT) study", Statistics in Medicine 23: (2004), pages 2413-2427). The SI is a ratio of odds ratios: for example in the CARE and WOSCOPS studies, the SI represents the factor by which the odds-ratio of statin treatment, compared with placebo, among major homozygous individuals is multiplied by in order to obtain the odds-ratio of treatment vs. placebo among heterozygous individuals; and multiplied by a second time to obtain the odds-ratio of treatment vs. placebo in minor homozygous individuals. The case-only study design results in a valid estimate of the SI under the assumption that genotype and treatment are independent in the population. In a randomized clinical trial, genotype and treatment are independent by design. The p-value for the regression coefficient corresponding to the SNP results from a test of the null hypothesis that the regression coefficient is equal to zero (SI is equal to one) and thus small p-values indicate the SI is unlikely equal to one and that the effect of treatment likely differs by genotype.

The logistic regression models were performed separately for each of CARE, WOSCOPS, and PROVE-IT in order to obtain study-specific results. A meta-analysis was then used to estimate the combined evidence for interaction when considering either the CARE and WOSCOPS studies (Tables 4-5), or all three studies (CARE, WOSCOPS, and PROVE-IT) (Tables 6-7). The meta-analysis used the inverse variance method (Rothman et al., 1998; Modern Epidemiology, 2nd edition, Lippincott Williams & Wilkins, Philadelphia, Pa., pages 660-661) to calculate the combined SI using a weighted average of the effects of the individual studies with weights equal to the inverse variance from each study.

The logistic regression and meta-analyses were performed using PLINK version 1.07 (Purcell et al. (2007), "PLINK: A tool set for whole-genome association and population-based linkage analyses", Am. J. Hum. Genet. 81, 559-575).

Regarding case-only study designs specifically, further information about these study designs is provided in Piegorsch et al., "Non-hierarchical logistic models and case-only designs for assessing susceptibility in population-based case-control studies", Statistics in Medicine 13 (1994) (pages 153-162); Khoury et al., "Nontraditional Epidemiologic Approaches in the Analysis of Gene-Environment Interaction: Case-Control Studies with No Controls!", American Journal of Epidemiology 144:3 (1996) (pages 207-213); Pierce et al., "Case-only genome-wide interaction study of disease risk, prognosis and treatment", Genet Epidemiol. 2010 January; 34(1):7-15; Begg et al., "Statistical analysis of molecular epidemiology studies employing case-series", Cancer Epidemiology Biomarkers and Prevention 3 (1994) pp 173-175; Yang et al., "Sample Size Requirements in Case-Only Designs to Detect Gene-Environment Interaction", American Journal of Epidemiology 146:9 (1997) pp 713-720; Albert et al., "Limitations of the Case-only Design for Identifying Gene-Environment Interactions", American Journal of Epidemiology 154:8 (2001) pp 687-693; and Wang et al., "Population Stratification Bias in the Case-Only Study for Gene-Environment Interactions", American Journal of Epidemiology 168:2 (2008) pp 197-201, each of which is incorporated herein by reference in its entirety. Further information about genome-wide association studies is provided in Wellcome Trust Case Control Consortium, "Genome-wide association study of 14,000 cases of seven common diseases and 3,000 shared controls", Nature. 2007 Jun. 7; 447(7145):661-78 and Ikram et al., "Genomewide association studies of stroke", N Engl J Med. 2009 Apr. 23; 360(17):1718-28.

Identification of Additional Statin Response-Associated SNPs by Imputation and Genotyping Additional genotyped and imputed SNPs were identified as being associated with statin response in the CARE, WOSCOPS, and PROVE-IT sample sets, and these additional SNPs are provided in Tables 9-18. The association of certain of these SNPs with statin response was identified by genotyping, whereas the association of certain other SNPs with statin response was identified by imputation. Imputation involves imputing the allele/genotype present at a SNP for each individual in the sample set (CARE, WOSCOPS, and PROVE-IT) rather than directly genotyping the SNP in a sample from the individual. Thus, Tables 9-18 include SNPs identified by imputation as well as SNPs identified by genotyping, and the column labeled "Source" in Tables 9-18 indicates whether each SNP was genotyped or imputed (all of the SNPs provided in Tables 4-7 were identified by genotyping).

Specifically, Tables 9-18 provide SNPs for which the p-value for a random effect was lower than $10^{-4}$ for either the meta-analysis of CARE and WOSCOPS combined or the meta-analysis of CARE, WOSCOPS, and PROVE-IT combined, for either the CHD or CVD endpoint, and for any genetic model (dominant, recessive, additive, or genotypic). Association interaction between statin response and either the CHD or CVD phenotype was performed. SNPs were either imputed or genotyped.

Imputation was carried out using the BEAGLE genetic analysis program to analyze genotyping data from the HapMap project (The International HapMap Consortium, NCBI, NLM, NIH). Imputation and the BEAGLE program (including the modeling algorithm that BEAGLE utilizes) are described in the following references: Browning, "Missing data imputation and haplotype phase inference for genome-wide association studies", *Hum Genet* (2008) 124:439-450 (which reviews imputation and BEAGLE); B L Browning and S R Browning (2009) "A unified approach to genotype imputation and haplotype phase inference for large data sets of trios and unrelated individuals". *Am J Hum Genet* 84:210-223 (which describes BEAGLE's methods for imputing ungenotyped markers and phasing parent-offspring trios); S R Browning and B L Browning (2007) "Rapid and accurate haplotype phasing and missing data inference for whole genome association studies using localized haplotype clustering". *Am J Hum Genet* 81:1084-1097 (which describes BEAGLE's methods for inferring haplotype phase or sporadic missing data in unrelated individuals); B L Browning and S R Browning (2007) "Efficient multilocus association mapping for whole genome association studies using localized haplotype clustering". *Genet Epidemiol* 31:365-375 (which describes BEAGLE's methods for association testing); S R Browning (2006) "Multilocus association mapping using variable-length Markov chains". *Am J Hum Genet* 78:903-13 (which describes BEAGLE's haplotype frequency model); and B L Browning and S R Browning (2008) "Haplotypic analysis of Wellcome Trust Case Control Consortium data". *Human Genetics* 123:273-280 (which describes an example in which BEAGLE was used to analyze a large genome-wide association study). Each of these references related to imputation and the BEAGLE program is incorporated herein by reference in its entirety.

Example 2: Polymorphism rs11556924 in the ZC3HC1 Gene is Associated with Differential CHD Risk Reduction by Statin Therapy in CARE and WOSCOPS A case-only study design was used to test whether the reduction of CHD events by statin therapy (for CARE and WOSCOPS studies) differed according to genotype (a treatment by SNP interaction) for each SNP evaluated in the study.

Herein in Example 2, SNPs previously reported to be associated with coronary artery disease (Schunkert et al., "Large-scale association analysis identifies 13 new susceptibility loci for coronary artery disease", *Nat Genet*. 2011 Mar. 6; and Peden et al., "A genome-wide association study in Europeans and South Asians identifies five new loci for coronary artery disease", *Nat Genet*. 2011 Mar. 6) were analyzed using the same methodology as described above in Example 1 in order to determine whether any of these SNP are associated with differential CHD risk reduction by statin therapy in a genome wide association study conducted among cases of CARE and WOSCOPS.

It was determined from this analysis that SNP rs11556924 (hCV31283062) in the ZC3HC1 gene is associated with differential reduction of CHD risk by pravastatin therapy in both CARE and WOSCOPS (see Table 19).

Example 3: SNPs Around Chromosomal Locations 9p21 and 12p13 (NINJ2 and B4GALNT3 Gene Region) Associated with Stroke Statin Response and/or Stroke Risk Example 3 relates to genetic polymorphisms that are associated with stroke risk and/or stroke statin response (reduction of stroke risk by statin treatment) (Tables 20-21) and CHD statin response (Table 22).

Table 20 provides SNPs associated with stroke risk and/or stroke statin response in the CARE sample set. For example, SNPs rs10757278 and rs1333049 at chromosomal location 9p21 were associated with a reduction of stroke events by statin treatment in CARE, particularly for heterozygotes (see Table 20). Furthermore, SNPs rs12425791 and rs11833579 at chromosomal location 12p13 near the NINJ2 gene were associated with stroke risk in the placebo arm of CARE (see Table 20). SNPs rs12425791 and rs11833579 were also associated with stroke statin response in that the homozygous and heterozygous carriers of either of these SNPs (i.e., carriers of the 'A' allele for either rs12425791 or rs11833579) had a greater reduction in stroke events with statin treatment compared with noncarriers (see Table 20). Consistent with the CARE trial, the stroke endpoint in the analysis for which the results are provided in Tables 20-21 included stroke as well as transient ischemic attack (TIA).

Fine-mapping at the chromosome 12p13 locus was carried out by selecting 77 tagging SNPs from a 400 kb region of the chromosome 12p13 locus which covered the NINJ2 gene and other genes, genotyping these 77 SNPs, and further imputing the genotypes of approximately 250 additional SNPs in this region, for individuals in the CARE study. Analyzing these fine-mapping SNPs for association with stroke risk in the placebo arm of CARE and for stroke statin response in CARE identified SNP rs873134 in the B4GALNT3 gene in the chromosome 12p13 region near NINJ2 (see Table 21).

Table 22 provides results of an analysis of CHD statin response in CARE. Table 22 shows that SNP rs873134 is associated with response to statin treatment for reducing the risk of CHD (as well as for reducing the risk of stroke, as shown in Table 21). Specifically, Table 22 shows that SNP rs873134 is associated with a reduced occurrence of recurrent MI in individuals in the CARE study who were treated with statins. Thus, SNP rs873134 is an example of a SNP that is associated with statin response for reducing risk for both stroke and CHD. In the analysis for which the results are provided in Table 22, the endpoint was recurrent MI, and the analysis was adjusted for age, gender, hypertension, diabetes, base LDL and HDL, and whether an individual was a current smoker.

Example 4: LD SNPs Associated with Statin Response and CVD

Another investigation was conducted to identify additional SNPs that are in high linkage disequilibrium (LD) with certain "interrogated SNPs" that have been found to be associated with response to statin treatment (particularly for reducing the risk of CVD, especially CHD such as MI). The "interrogated SNPs" were those SNPs provided in Tables 4-22 (the interrogated SNPs are shown in columns 1-2 of Table 3, which indicates the hCV and rs identification numbers of each interrogated SNP), and the LD SNPs which were identified as being in high LD are provided in Table 3 (in the columns labeled "LD SNP", which indicate the hCV and rs identification numbers of each LD SNP).

Specifically, Table 3 provides LD SNPs from the HapMap database (NCBI, NLM, NIH) that have linkage disequilibrium $r^2$ values of at least 0.9 (the threshold $r^2$ value, which may also be designated as $r_T^2$) with an interrogated SNP. Each of these LD SNPs from the HapMap database is within 500 kb of its respective interrogated SNP, and the $r^2$ values are calculated based on genotypes of HapMap Caucasian subjects. If an interrogated SNP is not in the HapMap database, then there will not be any LD SNPs listed in Table 3 for that interrogated SNP.

As an example in Table 3, the interrogated SNP rs688358 (hCV1056543) was calculated to be in LD with rs675163 (hCV1056544) at an $r^2$ value of 1 (which is above the threshold $r^2$ value of 0.9), thus establishing the latter SNP as a marker associated with statin response as well.

In this example, the threshold $r^2$ value was set at 0.9. However, the threshold $r^2$ value can be set at other values such that one of ordinary skill in the art would consider that any two SNPs having an $r^2$ value greater than or equal to the threshold $r^2$ value would be in sufficient LD with each other such that either SNP is useful for the same utilities, such as determining an individual's response to statin treatment. For example, in various embodiments, the threshold $r^2$ value used to classify SNPs as being in sufficient LD with an interrogated SNP (such that these LD SNPs can be used for the same utilities as the interrogated SNP, for example) can be set at, for example, 0.7, 0.75, 0.8, 0.85, 0.95, 0.96, 0.97, 0.98, 0.99, 1, etc. (or any other threshold $r^2$ value in-between these values). Threshold $r^2$ values may be utilized with or without considering power or other calculations.

Sequences, SNP information, and associated gene/transcript/protein information for each of the LD SNPs listed in Table 3 is provided in Tables 1-2. Thus, for any LD SNP listed in Table 3, sequence and allele information (or other information) can be found by searching Tables 1-2 using the hCV or rs identification number of the LD SNP of interest.

All publications and patents cited in this specification are herein incorporated by reference in their entirety. Modifications and variations of the described compositions, methods and systems of the invention will be apparent to those skilled in the art without departing from the scope and spirit of the invention. Although the invention has been described in connection with specific preferred embodiments and certain working examples, it should be understood that the invention as claimed should not be unduly limited to such specific embodiments. Indeed, various modifications of the above-described modes for carrying out the invention that are obvious to those skilled in the field of molecular biology, genetics and related fields are intended to be within the scope of the following claims.

TABLE 3

| Interrogated SNP (hCV #) | Interrogated SNP (rs #) | LD SNP (hCV #) | LD SNP (rs #) | Threshold $r^2$ | $r^2$ |
| --- | --- | --- | --- | --- | --- |
| hCV1056543 | rs688358 | hCV1056544 | rs675163 | 0.9 | 1 |
| hCV1056543 | rs688358 | hCV32014853 | rs11221097 | 0.9 | 1 |
| hCV1056543 | rs688358 | hCV767324 | rs687047 | 0.9 | 1 |
| hCV1056544 | rs675163 | hCV1056543 | rs688358 | 0.9 | 1 |
| hCV1056544 | rs675163 | hCV32014843 | rs11221075 | 0.9 | 1 |
| hCV1056544 | rs675163 | hCV32014853 | rs11221097 | 0.9 | 1 |
| hCV1056544 | rs675163 | hCV767324 | rs687047 | 0.9 | 1 |
| hCV11435810 | rs7808536 | hCV11435811 | rs2057903 | 0.9 | 1 |
| hCV11435810 | rs7808536 | hCV16010888 | rs2402516 | 0.9 | 0.9445 |
| hCV11435810 | rs7808536 | hCV16151622 | rs2896295 | 0.9 | 1 |
| hCV11435810 | rs7808536 | hCV2580015 | rs6973461 | 0.9 | 1 |
| hCV11435810 | rs7808536 | hCV26499740 | rs1344081 | 0.9 | 0.9396 |
| hCV11435810 | rs7808536 | hCV29630277 | rs7799541 | 0.9 | 1 |
| hCV11435810 | rs7808536 | hCV29720798 | rs10228725 | 0.9 | 1 |
| hCV11435810 | rs7808536 | hCV29738883 | rs10237648 | 0.9 | 1 |
| hCV11435810 | rs7808536 | hCV29865261 | rs10226287 | 0.9 | 1 |
| hCV11435810 | rs7808536 | hCV30243451 | rs10270624 | 0.9 | 1 |
| hCV11435810 | rs7808536 | hCV30441808 | rs10487413 | 0.9 | 0.9485 |
| hCV11435810 | rs7808536 | hCV31281599 | rs13438543 | 0.9 | 1 |
| hCV11544885 | rs1536506 | hCV16243612 | rs2478888 | 0.9 | 0.963 |
| hCV11544885 | rs1536506 | hCV16243614 | rs2478885 | 0.9 | 0.9587 |
| hCV11544885 | rs1536506 | hCV16252195 | rs2504709 | 0.9 | 1 |
| hCV11544885 | rs1536506 | hCV16252196 | rs2504710 | 0.9 | 1 |
| hCV11544885 | rs1536506 | hCV2005097 | rs2478886 | 0.9 | 0.9622 |
| hCV11544885 | rs1536506 | hCV2005121 | rs2504708 | 0.9 | 1 |
| hCV11544885 | rs1536506 | hCV2005126 | rs1536507 | 0.9 | 1 |
| hCV11544885 | rs1536506 | hCV2005128 | rs2504705 | 0.9 | 1 |
| hCV11544885 | rs1536506 | hCV2005129 | rs2478872 | 0.9 | 1 |
| hCV11544885 | rs1536506 | hCV2005135 | rs2504702 | 0.9 | 0.9615 |
| hCV11544885 | rs1536506 | hCV2005136 | rs1998950 | 0.9 | 0.9273 |
| hCV11544885 | rs1536506 | hCV27016744 | rs2478874 | 0.9 | 0.9625 |
| hCV11544885 | rs1536506 | hCV8768604 | rs1327283 | 0.9 | 0.9447 |
| hCV11544885 | rs1536506 | hCV8768614 | rs1342619 | 0.9 | 0.9637 |
| hCV11544885 | rs1536506 | hCV992360 | rs748514 | 0.9 | 0.9269 |
| hCV1166098 | rs4660234 | hCV1166103 | rs12407412 | 0.9 | 1 |
| hCV1166098 | rs4660234 | hCV1166105 | rs11576627 | 0.9 | 1 |
| hCV1166098 | rs4660234 | hCV30202184 | rs6685920 | 0.9 | 1 |
| hCV1166103 | rs12407412 | hCV1166098 | rs4660234 | 0.9 | 1 |
| hCV1166103 | rs12407412 | hCV1166105 | rs11576627 | 0.9 | 1 |
| hCV1166103 | rs12407412 | hCV30202184 | rs6685920 | 0.9 | 1 |
| hCV1166105 | rs11576627 | hCV1166098 | rs4660234 | 0.9 | 1 |
| hCV1166105 | rs11576627 | hCV1166103 | rs12407412 | 0.9 | 1 |
| hCV1166105 | rs11576627 | hCV30202184 | rs6685920 | 0.9 | 1 |

TABLE 3-continued

| Interrogated SNP (hCV #) | Interrogated SNP (rs #) | LD SNP (hCV #) | LD SNP (rs #) | Threshold $r^2$ | $r^2$ |
|---|---|---|---|---|---|
| hCV11675665 | rs2574 | hCV11226242 | rs2280210 | 0.9 | 1 |
| hCV11675665 | rs2574 | hCV11675666 | rs2575 | 0.9 | 0.9636 |
| hCV11675665 | rs2574 | hCV245252 | rs9835936 | 0.9 | 0.9636 |
| hCV11675665 | rs2574 | hCV474806 | rs11927308 | 0.9 | 1 |
| hCV11686367 | rs7955901 | hCV11686374 | rs7957932 | 0.9 | 0.9161 |
| hCV11686367 | rs7955901 | hCV171102 | rs7313973 | 0.9 | 0.9568 |
| hCV11686367 | rs7955901 | hCV240133 | rs4760895 | 0.9 | 0.9644 |
| hCV11686367 | rs7955901 | hCV240134 | rs7138300 | 0.9 | 0.9432 |
| hCV11686367 | rs7955901 | hCV2745807 | rs2063591 | 0.9 | 0.9303 |
| hCV11686367 | rs7955901 | hCV2745815 | rs1512991 | 0.9 | 1 |
| hCV11686367 | rs7955901 | hCV2745822 | rs1913201 | 0.9 | 0.9432 |
| hCV11686367 | rs7955901 | hCV2745828 | rs10879240 | 0.9 | 0.9274 |
| hCV11686367 | rs7955901 | hCV27952502 | rs4760894 | 0.9 | 0.9644 |
| hCV11686367 | rs7955901 | hCV27952503 | rs4760785 | 0.9 | 0.9644 |
| hCV11686367 | rs7955901 | hCV29120310 | rs7298255 | 0.9 | 0.9442 |
| hCV11686367 | rs7955901 | hCV31190748 | rs7959965 | 0.9 | 0.9442 |
| hCV11686367 | rs7955901 | hCV31190777 | rs10784891 | 0.9 | 1 |
| hCV11686367 | rs7955901 | hDV72015086 | rs7956274 | 0.9 | 1 |
| hCV11819777 | rs13172910 | hCV26478734 | rs11956952 | 0.9 | 1 |
| hCV11819777 | rs13172910 | hCV31237558 | rs6898857 | 0.9 | 1 |
| hCV11819780 | rs12153185 | hCV11819782 | rs12719415 | 0.9 | 1 |
| hCV11819780 | rs12153185 | hCV2575318 | rs7711358 | 0.9 | 0.9232 |
| hCV11819780 | rs12153185 | hCV2575336 | rs2418541 | 0.9 | 0.9232 |
| hCV11819780 | rs12153185 | hCV2575340 | rs11242020 | 0.9 | 0.9232 |
| hCV11819780 | rs12153185 | hCV26478744 | rs2016194 | 0.9 | 1 |
| hCV11819780 | rs12153185 | hCV26478745 | rs2108426 | 0.9 | 1 |
| hCV11819780 | rs12153185 | hCV26478747 | rs2190598 | 0.9 | 1 |
| hCV11819780 | rs12153185 | hCV26478763 | rs2418542 | 0.9 | 0.9232 |
| hCV11819780 | rs12153185 | hCV27996154 | rs4836502 | 0.9 | 1 |
| hCV11819780 | rs12153185 | hCV2961244 | rs2418548 | 0.9 | 1 |
| hCV11819780 | rs12153185 | hCV2961250 | rs4836507 | 0.9 | 1 |
| hCV11819780 | rs12153185 | hCV2961252 | rs10067895 | 0.9 | 1 |
| hCV11819780 | rs12153185 | hCV2961253 | rs2190600 | 0.9 | 1 |
| hCV11819780 | rs12153185 | hCV2961259 | rs11242023 | 0.9 | 0.9571 |
| hCV11819780 | rs12153185 | hCV2961260 | rs11242022 | 0.9 | 0.9785 |
| hCV11819780 | rs12153185 | hCV2961261 | rs11242021 | 0.9 | 1 |
| hCV11819780 | rs12153185 | hCV2961267 | rs1476714 | 0.9 | 1 |
| hCV11819780 | rs12153185 | hCV2961268 | rs2108425 | 0.9 | 1 |
| hCV11819780 | rs12153185 | hCV2961269 | rs2158958 | 0.9 | 1 |
| hCV11819780 | rs12153185 | hCV2961270 | rs9327555 | 0.9 | 1 |
| hCV11819780 | rs12153185 | hCV2961278 | rs7446891 | 0.9 | 1 |
| hCV11819780 | rs12153185 | hCV2961280 | rs10520072 | 0.9 | 1 |
| hCV11819780 | rs12153185 | hCV2961282 | rs917295 | 0.9 | 1 |
| hCV11819780 | rs12153185 | hCV2961284 | rs10054055 | 0.9 | 0.9573 |
| hCV11819780 | rs12153185 | hCV2961296 | rs10051148 | 0.9 | 0.9608 |
| hCV11819780 | rs12153185 | hCV2961297 | rs2158961 | 0.9 | 0.9616 |
| hCV11819780 | rs12153185 | hCV2961306 | rs264129 | 0.9 | 0.9358 |
| hCV11819780 | rs12153185 | hCV30621656 | rs10478919 | 0.9 | 0.9232 |
| hCV11819780 | rs12153185 | hCV31237567 | rs11749272 | 0.9 | 0.9232 |
| hCV11819780 | rs12153185 | hCV346713 | rs1990023 | 0.9 | 0.9358 |
| hCV11819780 | rs12153185 | hCV546489 | rs264122 | 0.9 | 0.9573 |
| hCV11819780 | rs12153185 | hCV8932829 | rs1116596 | 0.9 | 0.9232 |
| hCV11819782 | rs12719415 | hCV11819780 | rs12153185 | 0.9 | 1 |
| hCV11819782 | rs12719415 | hCV2575318 | rs7711358 | 0.9 | 0.927 |
| hCV11819782 | rs12719415 | hCV2575336 | rs2418541 | 0.9 | 0.927 |
| hCV11819782 | rs12719415 | hCV2575340 | rs11242020 | 0.9 | 0.927 |
| hCV11819782 | rs12719415 | hCV26478744 | rs2016194 | 0.9 | 0.9198 |
| hCV11819782 | rs12719415 | hCV26478745 | rs2108426 | 0.9 | 0.9135 |
| hCV11819782 | rs12719415 | hCV26478747 | rs2190598 | 0.9 | 1 |
| hCV11819782 | rs12719415 | hCV26478763 | rs2418542 | 0.9 | 0.927 |
| hCV11819782 | rs12719415 | hCV27996154 | rs4836502 | 0.9 | 1 |
| hCV11819782 | rs12719415 | hCV2961244 | rs2418548 | 0.9 | 1 |
| hCV11819782 | rs12719415 | hCV2961250 | rs4836507 | 0.9 | 1 |
| hCV11819782 | rs12719415 | hCV2961252 | rs10067895 | 0.9 | 1 |
| hCV11819782 | rs12719415 | hCV2961253 | rs2190600 | 0.9 | 1 |
| hCV11819782 | rs12719415 | hCV2961259 | rs11242023 | 0.9 | 0.9621 |
| hCV11819782 | rs12719415 | hCV2961260 | rs11242022 | 0.9 | 1 |
| hCV11819782 | rs12719415 | hCV2961261 | rs11242021 | 0.9 | 1 |
| hCV11819782 | rs12719415 | hCV2961267 | rs1476714 | 0.9 | 1 |
| hCV11819782 | rs12719415 | hCV2961268 | rs2108425 | 0.9 | 1 |
| hCV11819782 | rs12719415 | hCV2961269 | rs2158958 | 0.9 | 1 |
| hCV11819782 | rs12719415 | hCV2961270 | rs9327555 | 0.9 | 1 |
| hCV11819782 | rs12719415 | hCV2961278 | rs7446891 | 0.9 | 1 |
| hCV11819782 | rs12719415 | hCV2961280 | rs10520072 | 0.9 | 1 |
| hCV11819782 | rs12719415 | hCV2961282 | rs917295 | 0.9 | 1 |
| hCV11819782 | rs12719415 | hCV2961284 | rs10054055 | 0.9 | 0.9616 |
| hCV11819782 | rs12719415 | hCV2961296 | rs10051148 | 0.9 | 0.9623 |

TABLE 3-continued

| Interrogated SNP (hCV #) | Interrogated SNP (rs #) | LD SNP (hCV #) | LD SNP (rs #) | Threshold r² | r² |
|---|---|---|---|---|---|
| hCV11819782 | rs12719415 | hCV2961297 | rs2158961 | 0.9 | 0.9634 |
| hCV11819782 | rs12719415 | hCV2961306 | rs264129 | 0.9 | 0.9232 |
| hCV11819782 | rs12719415 | hCV30621656 | rs10478919 | 0.9 | 0.927 |
| hCV11819782 | rs12719415 | hCV31237567 | rs11749272 | 0.9 | 0.927 |
| hCV11819782 | rs12719415 | hCV346713 | rs1990023 | 0.9 | 0.9232 |
| hCV11819782 | rs12719415 | hCV546489 | rs264122 | 0.9 | 0.9616 |
| hCV11819782 | rs12719415 | hCV8932829 | rs1116596 | 0.9 | 0.927 |
| hCV1311177 | rs1868616 | hCV26853900 | rs17718789 | 0.9 | 0.9408 |
| hCV1319507 | rs16938626 | hCV1319514 | rs2383903 | 0.9 | 1 |
| hCV1319507 | rs16938626 | hCV1319518 | rs13265054 | 0.9 | 0.9055 |
| hCV1319514 | rs2383903 | hCV1319507 | rs16938626 | 0.9 | 1 |
| hCV1319516 | rs12678600 | hCV1319518 | rs13265054 | 0.9 | 1 |
| hCV1319516 | rs12678600 | hCV31080080 | rs12679254 | 0.9 | 1 |
| hCV1319518 | rs13265054 | hCV1319507 | rs16938626 | 0.9 | 0.9055 |
| hCV1319518 | rs13265054 | hCV1319516 | rs12678600 | 0.9 | 1 |
| hCV1319518 | rs13265054 | hCV31080080 | rs12679254 | 0.9 | 1 |
| hCV1329037 | rs9295154 | hCV29673016 | rs9458285 | 0.9 | 1 |
| hCV1329037 | rs9295154 | hCV30231903 | rs9458302 | 0.9 | 1 |
| hCV1329037 | rs9295154 | hCV31883369 | rs9458310 | 0.9 | 0.9236 |
| hCV1558085 | rs11656608 | hCV11625525 | rs7222186 | 0.9 | 1 |
| hCV1558085 | rs11656608 | hCV11625528 | rs9911847 | 0.9 | 0.9144 |
| hCV1558085 | rs11656608 | hCV11625529 | rs9911867 | 0.9 | 0.9079 |
| hCV1558085 | rs11656608 | hCV1558080 | rs9914580 | 0.9 | 1 |
| hCV1558085 | rs11656608 | hCV1558083 | rs9916432 | 0.9 | 0.9144 |
| hCV1558085 | rs11656608 | hCV1558084 | rs880718 | 0.9 | 0.9137 |
| hCV1558085 | rs11656608 | hCV29293441 | rs8066502 | 0.9 | 1 |
| hCV1558085 | rs11656608 | hCV29979212 | rs8068714 | 0.9 | 1 |
| hCV1558085 | rs11656608 | hCV29997278 | rs9906737 | 0.9 | 1 |
| hCV1558085 | rs11656608 | hCV7459667 | rs937890 | 0.9 | 0.9144 |
| hCV16126066 | rs2110564 | hCV2676440 | rs6722640 | 0.9 | 1 |
| hCV16126066 | rs2110564 | hCV27872026 | rs4851531 | 0.9 | 0.9638 |
| hCV16126066 | rs2110564 | hCV349805 | rs4851529 | 0.9 | 0.9329 |
| hCV16126066 | rs2110564 | hCV8905894 | rs974950 | 0.9 | 1 |
| hCV1631038 | rs9487284 | hCV11632712 | rs9481031 | 0.9 | 0.9098 |
| hCV1631038 | rs9487284 | hCV11638660 | rs6917496 | 0.9 | 0.9098 |
| hCV1631038 | rs9487284 | hCV11638661 | rs6937788 | 0.9 | 0.9098 |
| hCV1631038 | rs9487284 | hCV1631013 | rs17614034 | 0.9 | 0.9098 |
| hCV1631038 | rs9487284 | hCV1631015 | rs9481026 | 0.9 | 0.9098 |
| hCV1631038 | rs9487284 | hCV1631022 | rs9481029 | 0.9 | 0.9098 |
| hCV1631038 | rs9487284 | hCV1631034 | rs7776217 | 0.9 | 0.9098 |
| hCV1631038 | rs9487284 | hCV1631035 | rs7758270 | 0.9 | 0.9098 |
| hCV1631038 | rs9487284 | hCV1631067 | rs9481038 | 0.9 | 0.9098 |
| hCV1631038 | rs9487284 | hCV8703496 | rs1564077 | 0.9 | 0.9098 |
| hCV1787026 | rs475420 | hCV1787039 | rs538521 | 0.9 | 1 |
| hCV1787026 | rs475420 | hCV1787042 | rs657929 | 0.9 | 0.9081 |
| hCV1973764 | rs1866386 | hCV1973774 | rs1483301 | 0.9 | 0.9505 |
| hCV1973764 | rs1866386 | hCV1973785 | rs2930049 | 0.9 | 0.9732 |
| hCV2053088 | rs1155875 | hCV2053097 | rs4259369 | 0.9 | 0.961 |
| hCV2053088 | rs1155875 | hCV2053101 | rs7795792 | 0.9 | 0.9608 |
| hCV2053088 | rs1155875 | hCV2053104 | rs2163339 | 0.9 | 0.961 |
| hCV2053088 | rs1155875 | hCV2053105 | rs2195672 | 0.9 | 0.9604 |
| hCV2053088 | rs1155875 | hCV30565702 | rs10237019 | 0.9 | 0.963 |
| hCV2053097 | rs4259369 | hCV2053088 | rs1155875 | 0.9 | 0.961 |
| hCV2053097 | rs4259369 | hCV2053101 | rs7795792 | 0.9 | 1 |
| hCV2053097 | rs4259369 | hCV2053104 | rs2163339 | 0.9 | 1 |
| hCV2053097 | rs4259369 | hCV2053105 | rs2195672 | 0.9 | 1 |
| hCV2053097 | rs4259369 | hCV30565702 | rs10237019 | 0.9 | 1 |
| hCV2053101 | rs7795792 | hCV2053088 | rs1155875 | 0.9 | 0.9608 |
| hCV2053101 | rs7795792 | hCV2053097 | rs4259369 | 0.9 | 1 |
| hCV2053101 | rs7795792 | hCV2053104 | rs2163339 | 0.9 | 1 |
| hCV2053101 | rs7795792 | hCV2053105 | rs2195672 | 0.9 | 1 |
| hCV2053101 | rs7795792 | hCV30565702 | rs10237019 | 0.9 | 1 |
| hCV2209126 | rs208026 | hCV11706604 | rs208035 | 0.9 | 0.9176 |
| hCV2209126 | rs208026 | hCV11706608 | rs373886 | 0.9 | 0.9466 |
| hCV2209126 | rs208026 | hCV16233239 | rs2237852 | 0.9 | 0.9176 |
| hCV2209126 | rs208026 | hCV16233240 | rs2237853 | 0.9 | 0.9176 |
| hCV2209126 | rs208026 | hCV2442004 | rs208030 | 0.9 | 0.9176 |
| hCV2209194 | rs399485 | hCV2209191 | rs447024 | 0.9 | 0.9164 |
| hCV2209194 | rs399485 | hCV2209197 | rs7508 | 0.9 | 0.9573 |
| hCV2209197 | rs7508 | hCV2209194 | rs399485 | 0.9 | 0.9573 |
| hCV240133 | rs4760895 | hCV11686367 | rs7955901 | 0.9 | 0.9644 |
| hCV240133 | rs4760895 | hCV171102 | rs7313973 | 0.9 | 0.9603 |
| hCV240133 | rs4760895 | hCV240134 | rs7138300 | 0.9 | 1 |
| hCV240133 | rs4760895 | hCV2745815 | rs1512991 | 0.9 | 0.9668 |
| hCV240133 | rs4760895 | hCV2745822 | rs1913201 | 0.9 | 1 |
| hCV240133 | rs4760895 | hCV2745828 | rs10879240 | 0.9 | 0.9664 |
| hCV240133 | rs4760895 | hCV27952502 | rs4760894 | 0.9 | 1 |

TABLE 3-continued

| Interrogated SNP (hCV #) | Interrogated SNP (rs #) | LD SNP (hCV #) | LD SNP (rs #) | Threshold $r^2$ | $r^2$ |
|---|---|---|---|---|---|
| hCV240133 | rs4760895 | hCV27952503 | rs4760785 | 0.9 | 1 |
| hCV240133 | rs4760895 | hCV29120310 | rs7298255 | 0.9 | 0.9644 |
| hCV240133 | rs4760895 | hCV31190748 | rs7959965 | 0.9 | 0.9644 |
| hCV240133 | rs4760895 | hCV31190777 | rs10784891 | 0.9 | 0.962 |
| hCV240133 | rs4760895 | hDV72015086 | rs7956274 | 0.9 | 0.9649 |
| hCV240134 | rs7138300 | hCV11686367 | rs7955901 | 0.9 | 0.9432 |
| hCV240134 | rs7138300 | hCV171102 | rs7313973 | 0.9 | 0.9568 |
| hCV240134 | rs7138300 | hCV240133 | rs4760895 | 0.9 | 1 |
| hCV240134 | rs7138300 | hCV2745815 | rs1512991 | 0.9 | 0.9644 |
| hCV240134 | rs7138300 | hCV2745822 | rs1913201 | 0.9 | 1 |
| hCV240134 | rs7138300 | hCV2745828 | rs10879240 | 0.9 | 0.9639 |
| hCV240134 | rs7138300 | hCV27952502 | rs4760894 | 0.9 | 1 |
| hCV240134 | rs7138300 | hCV27952503 | rs4760785 | 0.9 | 1 |
| hCV240134 | rs7138300 | hCV31190777 | rs10784891 | 0.9 | 0.9588 |
| hCV240134 | rs7138300 | hDV72015086 | rs7956274 | 0.9 | 0.9622 |
| hCV2442103 | rs373983 | hCV2209192 | rs383499 | 0.9 | 0.9297 |
| hCV2529198 | rs742827 | hCV2529202 | rs6040667 | 0.9 | 0.9624 |
| hCV2529198 | rs742827 | hCV2529211 | rs17189710 | 0.9 | 0.9596 |
| hCV2529198 | rs742827 | hCV2529224 | rs2327412 | 0.9 | 0.9596 |
| hCV2529198 | rs742827 | hCV2529230 | rs4444612 | 0.9 | 0.9596 |
| hCV2529198 | rs742827 | hCV2529231 | rs4315598 | 0.9 | 0.9596 |
| hCV2529198 | rs742827 | hCV2529239 | rs6040638 | 0.9 | 0.9596 |
| hCV2529198 | rs742827 | hCV2529241 | rs6134243 | 0.9 | 0.9624 |
| hCV2529198 | rs742827 | hCV2529246 | rs6040619 | 0.9 | 0.9596 |
| hCV2529198 | rs742827 | hCV27367681 | rs2876227 | 0.9 | 1 |
| hCV2529198 | rs742827 | hCV27367708 | rs1009748 | 0.9 | 0.9596 |
| hCV2529198 | rs742827 | hCV29840965 | rs6040644 | 0.9 | 0.9596 |
| hCV2529198 | rs742827 | hCV30057061 | rs6033138 | 0.9 | 0.9624 |
| hCV2529198 | rs742827 | hCV30093270 | rs6040625 | 0.9 | 0.9624 |
| hCV2529198 | rs742827 | hCV30129243 | rs6040636 | 0.9 | 0.9624 |
| hCV2529198 | rs742827 | hCV30218977 | rs6040633 | 0.9 | 0.9624 |
| hCV2529198 | rs742827 | hCV30417550 | rs6040634 | 0.9 | 0.9624 |
| hCV2529198 | rs742827 | hCV30453433 | rs6131208 | 0.9 | 0.9167 |
| hCV2529198 | rs742827 | hCV32274419 | rs13038146 | 0.9 | 0.9624 |
| hCV2529198 | rs742827 | hCV330228 | rs6040668 | 0.9 | 0.9624 |
| hCV2529202 | rs6040667 | hCV2529198 | rs742827 | 0.9 | 0.9624 |
| hCV2529202 | rs6040667 | hCV2529211 | rs17189710 | 0.9 | 1 |
| hCV2529202 | rs6040667 | hCV2529224 | rs2327412 | 0.9 | 1 |
| hCV2529202 | rs6040667 | hCV2529230 | rs4444612 | 0.9 | 1 |
| hCV2529202 | rs6040667 | hCV2529231 | rs4315598 | 0.9 | 1 |
| hCV2529202 | rs6040667 | hCV2529239 | rs6040638 | 0.9 | 1 |
| hCV2529202 | rs6040667 | hCV2529241 | rs6134243 | 0.9 | 1 |
| hCV2529202 | rs6040667 | hCV2529246 | rs6040619 | 0.9 | 1 |
| hCV2529202 | rs6040667 | hCV27367681 | rs2876227 | 0.9 | 0.9649 |
| hCV2529202 | rs6040667 | hCV27367708 | rs1009748 | 0.9 | 1 |
| hCV2529202 | rs6040667 | hCV29840965 | rs6040644 | 0.9 | 1 |
| hCV2529202 | rs6040667 | hCV30057061 | rs6033138 | 0.9 | 1 |
| hCV2529202 | rs6040667 | hCV30093270 | rs6040625 | 0.9 | 1 |
| hCV2529202 | rs6040667 | hCV30129243 | rs6040636 | 0.9 | 1 |
| hCV2529202 | rs6040667 | hCV30218977 | rs6040633 | 0.9 | 1 |
| hCV2529202 | rs6040667 | hCV30417550 | rs6040634 | 0.9 | 1 |
| hCV2529202 | rs6040667 | hCV30453433 | rs6131208 | 0.9 | 0.9585 |
| hCV2529202 | rs6040667 | hCV30615489 | rs6040630 | 0.9 | 0.9294 |
| hCV2529202 | rs6040667 | hCV32274419 | rs13038146 | 0.9 | 1 |
| hCV2529202 | rs6040667 | hCV330228 | rs6040668 | 0.9 | 1 |
| hCV2529211 | rs17189710 | hCV2529198 | rs742827 | 0.9 | 0.9596 |
| hCV2529211 | rs17189710 | hCV2529202 | rs6040667 | 0.9 | 1 |
| hCV2529211 | rs17189710 | hCV2529224 | rs2327412 | 0.9 | 1 |
| hCV2529211 | rs17189710 | hCV2529230 | rs4444612 | 0.9 | 1 |
| hCV2529211 | rs17189710 | hCV2529231 | rs4315598 | 0.9 | 1 |
| hCV2529211 | rs17189710 | hCV2529239 | rs6040638 | 0.9 | 1 |
| hCV2529211 | rs17189710 | hCV2529241 | rs6134243 | 0.9 | 1 |
| hCV2529211 | rs17189710 | hCV2529246 | rs6040619 | 0.9 | 1 |
| hCV2529211 | rs17189710 | hCV27367681 | rs2876227 | 0.9 | 0.9616 |
| hCV2529211 | rs17189710 | hCV27367708 | rs1009748 | 0.9 | 1 |
| hCV2529211 | rs17189710 | hCV29840965 | rs6040644 | 0.9 | 1 |
| hCV2529211 | rs17189710 | hCV30057061 | rs6033138 | 0.9 | 1 |
| hCV2529211 | rs17189710 | hCV30093270 | rs6040625 | 0.9 | 1 |
| hCV2529211 | rs17189710 | hCV30129243 | rs6040636 | 0.9 | 1 |
| hCV2529211 | rs17189710 | hCV30218977 | rs6040633 | 0.9 | 1 |
| hCV2529211 | rs17189710 | hCV30417550 | rs6040634 | 0.9 | 1 |
| hCV2529211 | rs17189710 | hCV30453433 | rs6131208 | 0.9 | 0.9565 |
| hCV2529211 | rs17189710 | hCV30615489 | rs6040630 | 0.9 | 0.9225 |
| hCV2529211 | rs17189710 | hCV32274419 | rs13038146 | 0.9 | 1 |
| hCV2529211 | rs17189710 | hCV330228 | rs6040668 | 0.9 | 1 |
| hCV2529224 | rs2327412 | hCV2529198 | rs742827 | 0.9 | 0.9596 |
| hCV2529224 | rs2327412 | hCV2529202 | rs6040667 | 0.9 | 1 |

TABLE 3-continued

| Interrogated SNP (hCV #) | Interrogated SNP (rs #) | LD SNP (hCV #) | LD SNP (rs #) | Threshold r² | r² |
|---|---|---|---|---|---|
| hCV2529224 | rs2327412 | hCV2529211 | rs17189710 | 0.9 | 1 |
| hCV2529224 | rs2327412 | hCV2529230 | rs4444612 | 0.9 | 1 |
| hCV2529224 | rs2327412 | hCV2529231 | rs4315598 | 0.9 | 1 |
| hCV2529224 | rs2327412 | hCV2529239 | rs6040638 | 0.9 | 1 |
| hCV2529224 | rs2327412 | hCV2529241 | rs6134243 | 0.9 | 1 |
| hCV2529224 | rs2327412 | hCV2529246 | rs6040619 | 0.9 | 1 |
| hCV2529224 | rs2327412 | hCV27367681 | rs2876227 | 0.9 | 0.9616 |
| hCV2529224 | rs2327412 | hCV27367708 | rs1009748 | 0.9 | 1 |
| hCV2529224 | rs2327412 | hCV29840965 | rs6040644 | 0.9 | 1 |
| hCV2529224 | rs2327412 | hCV30057061 | rs6033138 | 0.9 | 1 |
| hCV2529224 | rs2327412 | hCV30093270 | rs6040625 | 0.9 | 1 |
| hCV2529224 | rs2327412 | hCV30129243 | rs6040636 | 0.9 | 1 |
| hCV2529224 | rs2327412 | hCV30218977 | rs6040633 | 0.9 | 1 |
| hCV2529224 | rs2327412 | hCV30417550 | rs6040634 | 0.9 | 1 |
| hCV2529224 | rs2327412 | hCV30453433 | rs6131208 | 0.9 | 0.9565 |
| hCV2529224 | rs2327412 | hCV30615489 | rs6040630 | 0.9 | 0.9225 |
| hCV2529224 | rs2327412 | hCV32274419 | rs13038146 | 0.9 | 1 |
| hCV2529224 | rs2327412 | hCV330228 | rs6040668 | 0.9 | 1 |
| hCV2529230 | rs4444612 | hCV2529198 | rs742827 | 0.9 | 0.9596 |
| hCV2529230 | rs4444612 | hCV2529202 | rs6040667 | 0.9 | 1 |
| hCV2529230 | rs4444612 | hCV2529211 | rs17189710 | 0.9 | 1 |
| hCV2529230 | rs4444612 | hCV2529224 | rs2327412 | 0.9 | 1 |
| hCV2529230 | rs4444612 | hCV2529231 | rs4315598 | 0.9 | 1 |
| hCV2529230 | rs4444612 | hCV2529239 | rs6040638 | 0.9 | 1 |
| hCV2529230 | rs4444612 | hCV2529241 | rs6134243 | 0.9 | 1 |
| hCV2529230 | rs4444612 | hCV2529246 | rs6040619 | 0.9 | 1 |
| hCV2529230 | rs4444612 | hCV27367681 | rs2876227 | 0.9 | 0.9616 |
| hCV2529230 | rs4444612 | hCV27367708 | rs1009748 | 0.9 | 1 |
| hCV2529230 | rs4444612 | hCV29840965 | rs6040644 | 0.9 | 1 |
| hCV2529230 | rs4444612 | hCV30057061 | rs6033138 | 0.9 | 1 |
| hCV2529230 | rs4444612 | hCV30093270 | rs6040625 | 0.9 | 1 |
| hCV2529230 | rs4444612 | hCV30129243 | rs6040636 | 0.9 | 1 |
| hCV2529230 | rs4444612 | hCV30218977 | rs6040633 | 0.9 | 1 |
| hCV2529230 | rs4444612 | hCV30417550 | rs6040634 | 0.9 | 1 |
| hCV2529230 | rs4444612 | hCV30453433 | rs6131208 | 0.9 | 0.9565 |
| hCV2529230 | rs4444612 | hCV30615489 | rs6040630 | 0.9 | 0.9225 |
| hCV2529230 | rs4444612 | hCV32274419 | rs13038146 | 0.9 | 1 |
| hCV2529230 | rs4444612 | hCV330228 | rs6040668 | 0.9 | 1 |
| hCV2529231 | rs4315598 | hCV2529198 | rs742827 | 0.9 | 0.9596 |
| hCV2529231 | rs4315598 | hCV2529202 | rs6040667 | 0.9 | 1 |
| hCV2529231 | rs4315598 | hCV2529211 | rs17189710 | 0.9 | 1 |
| hCV2529231 | rs4315598 | hCV2529224 | rs2327412 | 0.9 | 1 |
| hCV2529231 | rs4315598 | hCV2529230 | rs4444612 | 0.9 | 1 |
| hCV2529231 | rs4315598 | hCV2529239 | rs6040638 | 0.9 | 1 |
| hCV2529231 | rs4315598 | hCV2529241 | rs6134243 | 0.9 | 1 |
| hCV2529231 | rs4315598 | hCV2529246 | rs6040619 | 0.9 | 1 |
| hCV2529231 | rs4315598 | hCV27367681 | rs2876227 | 0.9 | 0.9616 |
| hCV2529231 | rs4315598 | hCV27367708 | rs1009748 | 0.9 | 1 |
| hCV2529231 | rs4315598 | hCV29840965 | rs6040644 | 0.9 | 1 |
| hCV2529231 | rs4315598 | hCV30057061 | rs6033138 | 0.9 | 1 |
| hCV2529231 | rs4315598 | hCV30093270 | rs6040625 | 0.9 | 1 |
| hCV2529231 | rs4315598 | hCV30129243 | rs6040636 | 0.9 | 1 |
| hCV2529231 | rs4315598 | hCV30218977 | rs6040633 | 0.9 | 1 |
| hCV2529231 | rs4315598 | hCV30417550 | rs6040634 | 0.9 | 1 |
| hCV2529231 | rs4315598 | hCV30453433 | rs6131208 | 0.9 | 0.9565 |
| hCV2529231 | rs4315598 | hCV30615489 | rs6040630 | 0.9 | 0.9225 |
| hCV2529231 | rs4315598 | hCV32274419 | rs13038146 | 0.9 | 1 |
| hCV2529231 | rs4315598 | hCV330228 | rs6040668 | 0.9 | 1 |
| hCV2529239 | rs6040638 | hCV2529198 | rs742827 | 0.9 | 0.9596 |
| hCV2529239 | rs6040638 | hCV2529202 | rs6040667 | 0.9 | 1 |
| hCV2529239 | rs6040638 | hCV2529211 | rs17189710 | 0.9 | 1 |
| hCV2529239 | rs6040638 | hCV2529224 | rs2327412 | 0.9 | 1 |
| hCV2529239 | rs6040638 | hCV2529230 | rs4444612 | 0.9 | 1 |
| hCV2529239 | rs6040638 | hCV2529231 | rs4315598 | 0.9 | 1 |
| hCV2529239 | rs6040638 | hCV2529241 | rs6134243 | 0.9 | 1 |
| hCV2529239 | rs6040638 | hCV2529246 | rs6040619 | 0.9 | 1 |
| hCV2529239 | rs6040638 | hCV27367681 | rs2876227 | 0.9 | 0.9616 |
| hCV2529239 | rs6040638 | hCV27367708 | rs1009748 | 0.9 | 1 |
| hCV2529239 | rs6040638 | hCV29840965 | rs6040644 | 0.9 | 1 |
| hCV2529239 | rs6040638 | hCV30057061 | rs6033138 | 0.9 | 1 |
| hCV2529239 | rs6040638 | hCV30093270 | rs6040625 | 0.9 | 1 |
| hCV2529239 | rs6040638 | hCV30129243 | rs6040636 | 0.9 | 1 |
| hCV2529239 | rs6040638 | hCV30218977 | rs6040633 | 0.9 | 1 |
| hCV2529239 | rs6040638 | hCV30417550 | rs6040634 | 0.9 | 1 |
| hCV2529239 | rs6040638 | hCV30453433 | rs6131208 | 0.9 | 0.9565 |
| hCV2529239 | rs6040638 | hCV30615489 | rs6040630 | 0.9 | 0.9225 |
| hCV2529239 | rs6040638 | hCV32274419 | rs13038146 | 0.9 | 1 |

TABLE 3-continued

| Interrogated SNP (hCV #) | Interrogated SNP (rs #) | LD SNP (hCV #) | LD SNP (rs #) | Threshold r² | r² |
|---|---|---|---|---|---|
| hCV2529239 | rs6040638 | hCV330228 | rs6040668 | 0.9 | 1 |
| hCV2529241 | rs6134243 | hCV2529198 | rs742827 | 0.9 | 0.9624 |
| hCV2529241 | rs6134243 | hCV2529202 | rs6040667 | 0.9 | 1 |
| hCV2529241 | rs6134243 | hCV2529211 | rs17189710 | 0.9 | 1 |
| hCV2529241 | rs6134243 | hCV2529224 | rs2327412 | 0.9 | 1 |
| hCV2529241 | rs6134243 | hCV2529230 | rs4444612 | 0.9 | 1 |
| hCV2529241 | rs6134243 | hCV2529231 | rs4315598 | 0.9 | 1 |
| hCV2529241 | rs6134243 | hCV2529239 | rs6040638 | 0.9 | 1 |
| hCV2529241 | rs6134243 | hCV2529246 | rs6040619 | 0.9 | 1 |
| hCV2529241 | rs6134243 | hCV27367681 | rs2876227 | 0.9 | 0.9649 |
| hCV2529241 | rs6134243 | hCV27367708 | rs1009748 | 0.9 | 1 |
| hCV2529241 | rs6134243 | hCV29840965 | rs6040644 | 0.9 | 1 |
| hCV2529241 | rs6134243 | hCV30057061 | rs6033138 | 0.9 | 1 |
| hCV2529241 | rs6134243 | hCV30093270 | rs6040625 | 0.9 | 1 |
| hCV2529241 | rs6134243 | hCV30129243 | rs6040636 | 0.9 | 1 |
| hCV2529241 | rs6134243 | hCV30218977 | rs6040633 | 0.9 | 1 |
| hCV2529241 | rs6134243 | hCV30417550 | rs6040634 | 0.9 | 1 |
| hCV2529241 | rs6134243 | hCV30453433 | rs6131208 | 0.9 | 0.9585 |
| hCV2529241 | rs6134243 | hCV30615489 | rs6040630 | 0.9 | 0.9294 |
| hCV2529241 | rs6134243 | hCV32274419 | rs13038146 | 0.9 | 1 |
| hCV2529241 | rs6134243 | hCV330228 | rs6040668 | 0.9 | 1 |
| hCV2529246 | rs6040619 | hCV2529198 | rs742827 | 0.9 | 0.9596 |
| hCV2529246 | rs6040619 | hCV2529202 | rs6040667 | 0.9 | 1 |
| hCV2529246 | rs6040619 | hCV2529211 | rs17189710 | 0.9 | 1 |
| hCV2529246 | rs6040619 | hCV2529224 | rs2327412 | 0.9 | 1 |
| hCV2529246 | rs6040619 | hCV2529230 | rs4444612 | 0.9 | 1 |
| hCV2529246 | rs6040619 | hCV2529231 | rs4315598 | 0.9 | 1 |
| hCV2529246 | rs6040619 | hCV2529239 | rs6040638 | 0.9 | 1 |
| hCV2529246 | rs6040619 | hCV2529241 | rs6134243 | 0.9 | 1 |
| hCV2529246 | rs6040619 | hCV27367681 | rs2876227 | 0.9 | 0.9616 |
| hCV2529246 | rs6040619 | hCV27367708 | rs1009748 | 0.9 | 1 |
| hCV2529246 | rs6040619 | hCV29840965 | rs6040644 | 0.9 | 1 |
| hCV2529246 | rs6040619 | hCV30057061 | rs6033138 | 0.9 | 1 |
| hCV2529246 | rs6040619 | hCV30093270 | rs6040625 | 0.9 | 1 |
| hCV2529246 | rs6040619 | hCV30129243 | rs6040636 | 0.9 | 1 |
| hCV2529246 | rs6040619 | hCV30218977 | rs6040633 | 0.9 | 1 |
| hCV2529246 | rs6040619 | hCV30417550 | rs6040634 | 0.9 | 1 |
| hCV2529246 | rs6040619 | hCV30453433 | rs6131208 | 0.9 | 0.9565 |
| hCV2529246 | rs6040619 | hCV30615489 | rs6040630 | 0.9 | 0.9225 |
| hCV2529246 | rs6040619 | hCV32274419 | rs13038146 | 0.9 | 1 |
| hCV2529246 | rs6040619 | hCV330228 | rs6040668 | 0.9 | 1 |
| hCV25609987 | rs10817479 | hCV32121729 | rs12235345 | 0.9 | 1 |
| hCV2575318 | rs7711358 | hCV11819780 | rs12153185 | 0.9 | 0.9232 |
| hCV2575318 | rs7711358 | hCV11819782 | rs12719415 | 0.9 | 0.927 |
| hCV2575318 | rs7711358 | hCV2575336 | rs2418541 | 0.9 | 1 |
| hCV2575318 | rs7711358 | hCV2575340 | rs11242020 | 0.9 | 1 |
| hCV2575318 | rs7711358 | hCV26478747 | rs2190598 | 0.9 | 0.9239 |
| hCV2575318 | rs7711358 | hCV26478763 | rs2418542 | 0.9 | 1 |
| hCV2575318 | rs7711358 | hCV27996154 | rs4836502 | 0.9 | 0.927 |
| hCV2575318 | rs7711358 | hCV2961244 | rs2418548 | 0.9 | 0.9232 |
| hCV2575318 | rs7711358 | hCV2961250 | rs4836507 | 0.9 | 0.927 |
| hCV2575318 | rs7711358 | hCV2961252 | rs10067895 | 0.9 | 0.927 |
| hCV2575318 | rs7711358 | hCV2961253 | rs2190600 | 0.9 | 0.927 |
| hCV2575318 | rs7711358 | hCV2961260 | rs11242022 | 0.9 | 0.9232 |
| hCV2575318 | rs7711358 | hCV2961261 | rs11242021 | 0.9 | 0.9255 |
| hCV2575318 | rs7711358 | hCV2961267 | rs1476714 | 0.9 | 0.9607 |
| hCV2575318 | rs7711358 | hCV2961268 | rs2108425 | 0.9 | 0.927 |
| hCV2575318 | rs7711358 | hCV2961269 | rs2158958 | 0.9 | 0.927 |
| hCV2575318 | rs7711358 | hCV2961270 | rs9327555 | 0.9 | 0.927 |
| hCV2575318 | rs7711358 | hCV2961278 | rs7446891 | 0.9 | 0.927 |
| hCV2575318 | rs7711358 | hCV2961280 | rs10520072 | 0.9 | 0.927 |
| hCV2575318 | rs7711358 | hCV2961282 | rs917295 | 0.9 | 0.927 |
| hCV2575318 | rs7711358 | hCV2961284 | rs10054055 | 0.9 | 0.9616 |
| hCV2575318 | rs7711358 | hCV2961296 | rs10051148 | 0.9 | 0.9623 |
| hCV2575318 | rs7711358 | hCV2961297 | rs2158961 | 0.9 | 0.9634 |
| hCV2575318 | rs7711358 | hCV2961306 | rs264129 | 0.9 | 0.9232 |
| hCV2575318 | rs7711358 | hCV30621656 | rs10478919 | 0.9 | 1 |
| hCV2575318 | rs7711358 | hCV31237567 | rs11749272 | 0.9 | 1 |
| hCV2575318 | rs7711358 | hCV346713 | rs1990023 | 0.9 | 1 |
| hCV2575318 | rs7711358 | hCV546489 | rs264122 | 0.9 | 0.9616 |
| hCV2575318 | rs7711358 | hCV8932829 | rs1116596 | 0.9 | 1 |
| hCV2575336 | rs2418541 | hCV11819780 | rs12153185 | 0.9 | 0.9232 |
| hCV2575336 | rs2418541 | hCV11819782 | rs12719415 | 0.9 | 0.927 |
| hCV2575336 | rs2418541 | hCV2575318 | rs7711358 | 0.9 | 1 |
| hCV2575336 | rs2418541 | hCV2575340 | rs11242020 | 0.9 | 1 |
| hCV2575336 | rs2418541 | hCV26478747 | rs2190598 | 0.9 | 0.9239 |
| hCV2575336 | rs2418541 | hCV26478763 | rs2418542 | 0.9 | 1 |

TABLE 3-continued

| Interrogated SNP (hCV #) | Interrogated SNP (rs #) | LD SNP (hCV #) | LD SNP (rs #) | Threshold $r^2$ | $r^2$ |
|---|---|---|---|---|---|
| hCV2575336 | rs2418541 | hCV27996154 | rs4836502 | 0.9 | 0.927 |
| hCV2575336 | rs2418541 | hCV2961244 | rs2418548 | 0.9 | 0.9232 |
| hCV2575336 | rs2418541 | hCV2961250 | rs4836507 | 0.9 | 0.927 |
| hCV2575336 | rs2418541 | hCV2961252 | rs10067895 | 0.9 | 0.927 |
| hCV2575336 | rs2418541 | hCV2961253 | rs2190600 | 0.9 | 0.927 |
| hCV2575336 | rs2418541 | hCV2961260 | rs11242022 | 0.9 | 0.9232 |
| hCV2575336 | rs2418541 | hCV2961261 | rs11242021 | 0.9 | 0.9255 |
| hCV2575336 | rs2418541 | hCV2961267 | rs1476714 | 0.9 | 0.9607 |
| hCV2575336 | rs2418541 | hCV2961268 | rs2108425 | 0.9 | 0.927 |
| hCV2575336 | rs2418541 | hCV2961269 | rs2158958 | 0.9 | 0.927 |
| hCV2575336 | rs2418541 | hCV2961270 | rs9327555 | 0.9 | 0.927 |
| hCV2575336 | rs2418541 | hCV2961278 | rs7446891 | 0.9 | 0.927 |
| hCV2575336 | rs2418541 | hCV2961280 | rs10520072 | 0.9 | 0.927 |
| hCV2575336 | rs2418541 | hCV2961282 | rs917295 | 0.9 | 0.927 |
| hCV2575336 | rs2418541 | hCV2961284 | rs10054055 | 0.9 | 0.9616 |
| hCV2575336 | rs2418541 | hCV2961296 | rs10051148 | 0.9 | 0.9623 |
| hCV2575336 | rs2418541 | hCV2961297 | rs2158961 | 0.9 | 0.9634 |
| hCV2575336 | rs2418541 | hCV2961306 | rs264129 | 0.9 | 0.9232 |
| hCV2575336 | rs2418541 | hCV30621656 | rs10478919 | 0.9 | 1 |
| hCV2575336 | rs2418541 | hCV31237567 | rs11749272 | 0.9 | 1 |
| hCV2575336 | rs2418541 | hCV346713 | rs1990023 | 0.9 | 1 |
| hCV2575336 | rs2418541 | hCV546489 | rs264122 | 0.9 | 0.9616 |
| hCV2575336 | rs2418541 | hCV8932829 | rs1116596 | 0.9 | 1 |
| hCV2575340 | rs11242020 | hCV11819780 | rs12153185 | 0.9 | 0.9232 |
| hCV2575340 | rs11242020 | hCV11819782 | rs12719415 | 0.9 | 0.927 |
| hCV2575340 | rs11242020 | hCV2575318 | rs7711358 | 0.9 | 1 |
| hCV2575340 | rs11242020 | hCV2575336 | rs2418541 | 0.9 | 1 |
| hCV2575340 | rs11242020 | hCV26478747 | rs2190598 | 0.9 | 0.9239 |
| hCV2575340 | rs11242020 | hCV26478763 | rs2418542 | 0.9 | 1 |
| hCV2575340 | rs11242020 | hCV27996154 | rs4836502 | 0.9 | 0.927 |
| hCV2575340 | rs11242020 | hCV2961244 | rs2418548 | 0.9 | 0.9232 |
| hCV2575340 | rs11242020 | hCV2961250 | rs4836507 | 0.9 | 0.927 |
| hCV2575340 | rs11242020 | hCV2961252 | rs10067895 | 0.9 | 0.927 |
| hCV2575340 | rs11242020 | hCV2961253 | rs2190600 | 0.9 | 0.927 |
| hCV2575340 | rs11242020 | hCV2961260 | rs11242022 | 0.9 | 0.9232 |
| hCV2575340 | rs11242020 | hCV2961261 | rs11242021 | 0.9 | 0.9255 |
| hCV2575340 | rs11242020 | hCV2961267 | rs1476714 | 0.9 | 0.9607 |
| hCV2575340 | rs11242020 | hCV2961268 | rs2108425 | 0.9 | 0.927 |
| hCV2575340 | rs11242020 | hCV2961269 | rs2158958 | 0.9 | 0.927 |
| hCV2575340 | rs11242020 | hCV2961270 | rs9327555 | 0.9 | 0.927 |
| hCV2575340 | rs11242020 | hCV2961278 | rs7446891 | 0.9 | 0.927 |
| hCV2575340 | rs11242020 | hCV2961280 | rs10520072 | 0.9 | 0.927 |
| hCV2575340 | rs11242020 | hCV2961282 | rs917295 | 0.9 | 0.927 |
| hCV2575340 | rs11242020 | hCV2961284 | rs10054055 | 0.9 | 0.9616 |
| hCV2575340 | rs11242020 | hCV2961296 | rs10051148 | 0.9 | 0.9623 |
| hCV2575340 | rs11242020 | hCV2961297 | rs2158961 | 0.9 | 0.9634 |
| hCV2575340 | rs11242020 | hCV2961306 | rs264129 | 0.9 | 0.9232 |
| hCV2575340 | rs11242020 | hCV30621656 | rs10478919 | 0.9 | 1 |
| hCV2575340 | rs11242020 | hCV31237567 | rs11749272 | 0.9 | 1 |
| hCV2575340 | rs11242020 | hCV346713 | rs1990023 | 0.9 | 1 |
| hCV2575340 | rs11242020 | hCV546489 | rs264122 | 0.9 | 0.9616 |
| hCV2575340 | rs11242020 | hCV8932829 | rs1116596 | 0.9 | 1 |
| hCV26478734 | rs11956952 | hCV11819777 | rs13172910 | 0.9 | 1 |
| hCV26478734 | rs11956952 | hCV31237558 | rs6898857 | 0.9 | 1 |
| hCV26478744 | rs2016194 | hCV11819780 | rs12153185 | 0.9 | 1 |
| hCV26478744 | rs2016194 | hCV11819782 | rs12719415 | 0.9 | 0.9198 |
| hCV26478744 | rs2016194 | hCV26478745 | rs2108426 | 0.9 | 1 |
| hCV26478744 | rs2016194 | hCV26478747 | rs2190598 | 0.9 | 0.916 |
| hCV26478744 | rs2016194 | hCV27996154 | rs4836502 | 0.9 | 0.9198 |
| hCV26478744 | rs2016194 | hCV2961244 | rs2418548 | 0.9 | 1 |
| hCV26478744 | rs2016194 | hCV2961250 | rs4836507 | 0.9 | 0.9198 |
| hCV26478744 | rs2016194 | hCV2961252 | rs10067895 | 0.9 | 0.9198 |
| hCV26478744 | rs2016194 | hCV2961253 | rs2190600 | 0.9 | 0.9198 |
| hCV26478744 | rs2016194 | hCV2961259 | rs11242023 | 0.9 | 0.9587 |
| hCV26478744 | rs2016194 | hCV2961260 | rs11242022 | 0.9 | 1 |
| hCV26478744 | rs2016194 | hCV2961261 | rs11242021 | 0.9 | 0.9198 |
| hCV26478744 | rs2016194 | hCV2961267 | rs1476714 | 0.9 | 0.9152 |
| hCV26478744 | rs2016194 | hCV2961268 | rs2108425 | 0.9 | 0.9198 |
| hCV26478744 | rs2016194 | hCV2961269 | rs2158958 | 0.9 | 0.9198 |
| hCV26478744 | rs2016194 | hCV2961270 | rs9327555 | 0.9 | 0.9198 |
| hCV26478744 | rs2016194 | hCV2961278 | rs7446891 | 0.9 | 0.9198 |
| hCV26478744 | rs2016194 | hCV2961280 | rs10520072 | 0.9 | 0.9198 |
| hCV26478744 | rs2016194 | hCV2961282 | rs917295 | 0.9 | 0.9197 |
| hCV26478744 | rs2016194 | hCV2961284 | rs10054055 | 0.9 | 0.9581 |
| hCV26478744 | rs2016194 | hCV2961296 | rs10051148 | 0.9 | 0.9589 |
| hCV26478744 | rs2016194 | hCV2961306 | rs264129 | 0.9 | 0.9162 |
| hCV26478744 | rs2016194 | hCV346713 | rs1990023 | 0.9 | 0.9162 |

TABLE 3-continued

| Interrogated SNP (hCV #) | Interrogated SNP (rs #) | LD SNP (hCV #) | LD SNP (rs #) | Threshold r² | r² |
|---|---|---|---|---|---|
| hCV26478744 | rs2016194 | hCV546489 | rs264122 | 0.9 | 0.9581 |
| hCV26478745 | rs2108426 | hCV11819780 | rs12153185 | 0.9 | 1 |
| hCV26478745 | rs2108426 | hCV11819782 | rs12719415 | 0.9 | 0.9135 |
| hCV26478745 | rs2108426 | hCV26478744 | rs2016194 | 0.9 | 1 |
| hCV26478745 | rs2108426 | hCV26478747 | rs2190598 | 0.9 | 0.9092 |
| hCV26478745 | rs2108426 | hCV27996154 | rs4836502 | 0.9 | 0.9135 |
| hCV26478745 | rs2108426 | hCV2961244 | rs2418548 | 0.9 | 1 |
| hCV26478745 | rs2108426 | hCV2961250 | rs4836507 | 0.9 | 0.9135 |
| hCV26478745 | rs2108426 | hCV2961252 | rs10067895 | 0.9 | 0.9135 |
| hCV26478745 | rs2108426 | hCV2961253 | rs2190600 | 0.9 | 0.9135 |
| hCV26478745 | rs2108426 | hCV2961259 | rs11242023 | 0.9 | 0.9557 |
| hCV26478745 | rs2108426 | hCV2961260 | rs11242022 | 0.9 | 1 |
| hCV26478745 | rs2108426 | hCV2961261 | rs11242021 | 0.9 | 0.9135 |
| hCV26478745 | rs2108426 | hCV2961267 | rs1476714 | 0.9 | 0.9081 |
| hCV26478745 | rs2108426 | hCV2961268 | rs2108425 | 0.9 | 0.9135 |
| hCV26478745 | rs2108426 | hCV2961269 | rs2158958 | 0.9 | 0.9135 |
| hCV26478745 | rs2108426 | hCV2961270 | rs9327555 | 0.9 | 0.9135 |
| hCV26478745 | rs2108426 | hCV2961278 | rs7446891 | 0.9 | 0.9135 |
| hCV26478745 | rs2108426 | hCV2961280 | rs10520072 | 0.9 | 0.9135 |
| hCV26478745 | rs2108426 | hCV2961282 | rs917295 | 0.9 | 0.9134 |
| hCV26478745 | rs2108426 | hCV2961284 | rs10054055 | 0.9 | 1 |
| hCV26478745 | rs2108426 | hCV2961296 | rs10051148 | 0.9 | 1 |
| hCV26478745 | rs2108426 | hCV2961297 | rs2158961 | 0.9 | 0.9135 |
| hCV26478745 | rs2108426 | hCV2961306 | rs264129 | 0.9 | 0.9557 |
| hCV26478745 | rs2108426 | hCV346713 | rs1990023 | 0.9 | 0.9557 |
| hCV26478745 | rs2108426 | hCV546489 | rs264122 | 0.9 | 1 |
| hCV26478747 | rs2190598 | hCV11819780 | rs12153185 | 0.9 | 1 |
| hCV26478747 | rs2190598 | hCV11819782 | rs12719415 | 0.9 | 1 |
| hCV26478747 | rs2190598 | hCV2575318 | rs7711358 | 0.9 | 0.9239 |
| hCV26478747 | rs2190598 | hCV2575336 | rs2418541 | 0.9 | 0.9239 |
| hCV26478747 | rs2190598 | hCV2575340 | rs11242020 | 0.9 | 0.9239 |
| hCV26478747 | rs2190598 | hCV26478744 | rs2016194 | 0.9 | 0.916 |
| hCV26478747 | rs2190598 | hCV26478745 | rs2108426 | 0.9 | 0.9092 |
| hCV26478747 | rs2190598 | hCV26478763 | rs2418542 | 0.9 | 0.9239 |
| hCV26478747 | rs2190598 | hCV27996154 | rs4836502 | 0.9 | 1 |
| hCV26478747 | rs2190598 | hCV2961244 | rs2418548 | 0.9 | 1 |
| hCV26478747 | rs2190598 | hCV2961250 | rs4836507 | 0.9 | 1 |
| hCV26478747 | rs2190598 | hCV2961252 | rs10067895 | 0.9 | 1 |
| hCV26478747 | rs2190598 | hCV2961253 | rs2190600 | 0.9 | 1 |
| hCV26478747 | rs2190598 | hCV2961259 | rs11242023 | 0.9 | 0.9604 |
| hCV26478747 | rs2190598 | hCV2961260 | rs11242022 | 0.9 | 1 |
| hCV26478747 | rs2190598 | hCV2961261 | rs11242021 | 0.9 | 1 |
| hCV26478747 | rs2190598 | hCV2961267 | rs1476714 | 0.9 | 1 |
| hCV26478747 | rs2190598 | hCV2961268 | rs2108425 | 0.9 | 1 |
| hCV26478747 | rs2190598 | hCV2961269 | rs2158958 | 0.9 | 1 |
| hCV26478747 | rs2190598 | hCV2961270 | rs9327555 | 0.9 | 1 |
| hCV26478747 | rs2190598 | hCV2961278 | rs7446891 | 0.9 | 1 |
| hCV26478747 | rs2190598 | hCV2961280 | rs10520072 | 0.9 | 1 |
| hCV26478747 | rs2190598 | hCV2961282 | rs917295 | 0.9 | 1 |
| hCV26478747 | rs2190598 | hCV2961284 | rs10054055 | 0.9 | 0.96 |
| hCV26478747 | rs2190598 | hCV2961296 | rs10051148 | 0.9 | 0.9615 |
| hCV26478747 | rs2190598 | hCV2961297 | rs2158961 | 0.9 | 0.9619 |
| hCV26478747 | rs2190598 | hCV2961306 | rs264129 | 0.9 | 0.9198 |
| hCV26478747 | rs2190598 | hCV30621656 | rs10478919 | 0.9 | 0.9239 |
| hCV26478747 | rs2190598 | hCV31237567 | rs11749272 | 0.9 | 0.9239 |
| hCV26478747 | rs2190598 | hCV346713 | rs1990023 | 0.9 | 0.9199 |
| hCV26478747 | rs2190598 | hCV546489 | rs264122 | 0.9 | 0.96 |
| hCV26478747 | rs2190598 | hCV8932829 | rs1116596 | 0.9 | 0.9239 |
| hCV26478748 | rs2190597 | hCV2575337 | rs2214640 | 0.9 | 0.9282 |
| hCV26478748 | rs2190597 | hCV2575344 | rs10064779 | 0.9 | 0.9339 |
| hCV26478748 | rs2190597 | hCV29134277 | rs6595948 | 0.9 | 0.9669 |
| hCV26478748 | rs2190597 | hCV2961229 | rs12654296 | 0.9 | 0.9664 |
| hCV26478748 | rs2190597 | hCV2961235 | rs6869219 | 0.9 | 1 |
| hCV26478748 | rs2190597 | hCV2961239 | rs6868888 | 0.9 | 1 |
| hCV26478748 | rs2190597 | hCV2961241 | rs2108427 | 0.9 | 0.9037 |
| hCV26478748 | rs2190597 | hCV2961251 | rs1157409 | 0.9 | 1 |
| hCV26478748 | rs2190597 | hCV31237552 | rs6889557 | 0.9 | 0.9652 |
| hCV26478748 | rs2190597 | hCV546493 | rs264126 | 0.9 | 0.9328 |
| hCV26478748 | rs2190597 | hCV8932783 | rs1473132 | 0.9 | 1 |
| hCV26478763 | rs2418542 | hCV11819780 | rs12153185 | 0.9 | 0.9232 |
| hCV26478763 | rs2418542 | hCV11819782 | rs12719415 | 0.9 | 0.927 |
| hCV26478763 | rs2418542 | hCV2575318 | rs7711358 | 0.9 | 1 |
| hCV26478763 | rs2418542 | hCV2575336 | rs2418541 | 0.9 | 1 |
| hCV26478763 | rs2418542 | hCV2575340 | rs11242020 | 0.9 | 1 |
| hCV26478763 | rs2418542 | hCV26478747 | rs2190598 | 0.9 | 0.9239 |
| hCV26478763 | rs2418542 | hCV27996154 | rs4836502 | 0.9 | 0.927 |
| hCV26478763 | rs2418542 | hCV2961244 | rs2418548 | 0.9 | 0.9232 |

TABLE 3-continued

| Interrogated SNP (hCV #) | Interrogated SNP (rs #) | LD SNP (hCV #) | LD SNP (rs #) | Threshold $r^2$ | $r^2$ |
|---|---|---|---|---|---|
| hCV26478763 | rs2418542 | hCV2961250 | rs4836507 | 0.9 | 0.927 |
| hCV26478763 | rs2418542 | hCV2961252 | rs10067895 | 0.9 | 0.927 |
| hCV26478763 | rs2418542 | hCV2961253 | rs2190600 | 0.9 | 0.927 |
| hCV26478763 | rs2418542 | hCV2961260 | rs11242022 | 0.9 | 0.9232 |
| hCV26478763 | rs2418542 | hCV2961261 | rs11242021 | 0.9 | 0.9255 |
| hCV26478763 | rs2418542 | hCV2961267 | rs1476714 | 0.9 | 0.9607 |
| hCV26478763 | rs2418542 | hCV2961268 | rs2108425 | 0.9 | 0.927 |
| hCV26478763 | rs2418542 | hCV2961269 | rs2158958 | 0.9 | 0.927 |
| hCV26478763 | rs2418542 | hCV2961270 | rs9327555 | 0.9 | 0.927 |
| hCV26478763 | rs2418542 | hCV2961278 | rs7446891 | 0.9 | 0.927 |
| hCV26478763 | rs2418542 | hCV2961280 | rs10520072 | 0.9 | 0.927 |
| hCV26478763 | rs2418542 | hCV2961282 | rs917295 | 0.9 | 0.927 |
| hCV26478763 | rs2418542 | hCV2961284 | rs10054055 | 0.9 | 0.9616 |
| hCV26478763 | rs2418542 | hCV2961296 | rs10051148 | 0.9 | 0.9623 |
| hCV26478763 | rs2418542 | hCV2961297 | rs2158961 | 0.9 | 0.9634 |
| hCV26478763 | rs2418542 | hCV2961306 | rs264129 | 0.9 | 0.9232 |
| hCV26478763 | rs2418542 | hCV30621656 | rs10478919 | 0.9 | 1 |
| hCV26478763 | rs2418542 | hCV31237567 | rs11749272 | 0.9 | 1 |
| hCV26478763 | rs2418542 | hCV346713 | rs1990023 | 0.9 | 1 |
| hCV26478763 | rs2418542 | hCV546489 | rs264122 | 0.9 | 0.9616 |
| hCV26478763 | rs2418542 | hCV8932829 | rs1116596 | 0.9 | 1 |
| hCV26499740 | rs1344081 | hCV11435810 | rs7808536 | 0.9 | 0.9396 |
| hCV26499740 | rs1344081 | hCV11435811 | rs2057903 | 0.9 | 0.9396 |
| hCV26499740 | rs1344081 | hCV16010888 | rs2402516 | 0.9 | 1 |
| hCV26499740 | rs1344081 | hCV16151622 | rs2896295 | 0.9 | 0.9396 |
| hCV26499740 | rs1344081 | hCV2580015 | rs6973461 | 0.9 | 0.9388 |
| hCV26499740 | rs1344081 | hCV29630277 | rs7799541 | 0.9 | 0.9703 |
| hCV26499740 | rs1344081 | hCV29720798 | rs10228725 | 0.9 | 0.9396 |
| hCV26499740 | rs1344081 | hCV29738883 | rs10237648 | 0.9 | 0.9401 |
| hCV26499740 | rs1344081 | hCV29865261 | rs10226287 | 0.9 | 0.9396 |
| hCV26499740 | rs1344081 | hCV30243451 | rs10270624 | 0.9 | 0.9401 |
| hCV26499740 | rs1344081 | hCV30441808 | rs10487413 | 0.9 | 1 |
| hCV26499740 | rs1344081 | hCV31281599 | rs13438543 | 0.9 | 1 |
| hCV2676440 | rs6722640 | hCV16126066 | rs2110564 | 0.9 | 1 |
| hCV2676440 | rs6722640 | hCV27872026 | rs4851531 | 0.9 | 0.9638 |
| hCV2676440 | rs6722640 | hCV349805 | rs4851529 | 0.9 | 0.9329 |
| hCV2676440 | rs6722640 | hCV8905894 | rs974950 | 0.9 | 1 |
| hCV26771384 | rs10865197 | hCV26135665 | rs4390811 | 0.9 | 0.96 |
| hCV26771384 | rs10865197 | hCV26771389 | rs10183431 | 0.9 | 1 |
| hCV26771384 | rs10865197 | hCV27875215 | rs4346434 | 0.9 | 0.922 |
| hCV26771384 | rs10865197 | hCV27933339 | rs4586678 | 0.9 | 1 |
| hCV26771384 | rs10865197 | hCV29229284 | rs6741066 | 0.9 | 0.9591 |
| hCV26771384 | rs10865197 | hCV30817981 | rs6723119 | 0.9 | 0.96 |
| hCV26771384 | rs10865197 | hCV375079 | rs9309112 | 0.9 | 0.92 |
| hCV26771384 | rs10865197 | hCV375083 | rs10206724 | 0.9 | 1 |
| hCV26771384 | rs10865197 | hCV375090 | rs4450660 | 0.9 | 1 |
| hCV26771384 | rs10865197 | hCV514334 | rs6544721 | 0.9 | 0.961 |
| hCV26771389 | rs10183431 | hCV26135665 | rs4390811 | 0.9 | 0.96 |
| hCV26771389 | rs10183431 | hCV26771384 | rs10865197 | 0.9 | 1 |
| hCV26771389 | rs10183431 | hCV27875215 | rs4346434 | 0.9 | 0.922 |
| hCV26771389 | rs10183431 | hCV27933339 | rs4586678 | 0.9 | 1 |
| hCV26771389 | rs10183431 | hCV29229284 | rs6741066 | 0.9 | 0.9591 |
| hCV26771389 | rs10183431 | hCV30817981 | rs6723119 | 0.9 | 0.96 |
| hCV26771389 | rs10183431 | hCV375079 | rs9309112 | 0.9 | 0.92 |
| hCV26771389 | rs10183431 | hCV375083 | rs10206724 | 0.9 | 1 |
| hCV26771389 | rs10183431 | hCV375090 | rs4450660 | 0.9 | 1 |
| hCV26771389 | rs10183431 | hCV514334 | rs6544721 | 0.9 | 0.961 |
| hCV26830134 | rs2993156 | hCV26830128 | rs10814709 | 0.9 | 1 |
| hCV26830134 | rs2993156 | hDV68926946 | rs10814708 | 0.9 | 0.9583 |
| hCV26881087 | rs4472926 | hCV29268001 | rs7939893 | 0.9 | 0.9787 |
| hCV2690291 | rs2270588 | hCV2690292 | rs2270589 | 0.9 | 0.9243 |
| hCV2690291 | rs2270588 | hCV8873448 | rs3844207 | 0.9 | 1 |
| hCV2690292 | rs2270589 | hCV2690291 | rs2270588 | 0.9 | 0.9243 |
| hCV2690292 | rs2270589 | hCV8873448 | rs3844207 | 0.9 | 0.9298 |
| hCV2690365 | rs11178583 | hCV11686277 | rs3763978 | 0.9 | 0.9654 |
| hCV2690365 | rs11178583 | hCV11686292 | rs1051334 | 0.9 | 0.9627 |
| hCV2690365 | rs11178583 | hCV15957961 | rs2270586 | 0.9 | 0.9627 |
| hCV2690365 | rs11178583 | hCV26441048 | rs3851610 | 0.9 | 0.9654 |
| hCV2690365 | rs11178583 | hCV26441140 | rs9325191 | 0.9 | 1 |
| hCV2690365 | rs11178583 | hCV2690286 | rs2270584 | 0.9 | 0.9622 |
| hCV2690365 | rs11178583 | hCV2690333 | rs11178602 | 0.9 | 1 |
| hCV2690365 | rs11178583 | hCV2690348 | rs11178594 | 0.9 | 1 |
| hCV2690365 | rs11178583 | hCV2690350 | rs2132242 | 0.9 | 1 |
| hCV2690365 | rs11178583 | hCV2690354 | rs11178589 | 0.9 | 1 |
| hCV2690365 | rs11178583 | hCV2690362 | rs10879249 | 0.9 | 1 |
| hCV2690365 | rs11178583 | hCV2690375 | rs1567740 | 0.9 | 1 |
| hCV2690365 | rs11178583 | hCV2690377 | rs10879245 | 0.9 | 1 |

TABLE 3-continued

| Interrogated SNP (hCV #) | Interrogated SNP (rs #) | LD SNP (hCV #) | LD SNP (rs #) | Threshold $r^2$ | $r^2$ |
|---|---|---|---|---|---|
| hCV2690365 | rs11178583 | hCV2690378 | rs11178579 | 0.9 | 1 |
| hCV2690365 | rs11178583 | hCV2690379 | rs10879242 | 0.9 | 1 |
| hCV2690365 | rs11178583 | hCV2690380 | rs10506623 | 0.9 | 1 |
| hCV2690365 | rs11178583 | hCV2690388 | rs2132241 | 0.9 | 1 |
| hCV2690365 | rs11178583 | hCV29593612 | rs10506626 | 0.9 | 0.9627 |
| hCV2690365 | rs11178583 | hCV31190567 | rs7311994 | 0.9 | 1 |
| hCV2690365 | rs11178583 | hCV31190598 | rs12818936 | 0.9 | 1 |
| hCV2690365 | rs11178583 | hCV31190625 | rs11178648 | 0.9 | 0.9627 |
| hCV2690365 | rs11178583 | hCV31190877 | rs12831292 | 0.9 | 0.9654 |
| hCV2690365 | rs11178583 | hCV8375364 | rs966583 | 0.9 | 1 |
| hCV2690365 | rs11178583 | hCV8871988 | rs1495375 | 0.9 | 1 |
| hCV2690365 | rs11178583 | hCV8871989 | rs1512989 | 0.9 | 1 |
| hCV2690365 | rs11178583 | hCV8871990 | rs1512988 | 0.9 | 1 |
| hCV2690365 | rs11178583 | hCV8873466 | rs1051344 | 0.9 | 1 |
| hCV2690365 | rs11178583 | hCV8873472 | rs1355373 | 0.9 | 1 |
| hCV2690377 | rs10879245 | hCV11412791 | rs1874313 | 0.9 | 1 |
| hCV2690377 | rs10879245 | hCV11686277 | rs3763978 | 0.9 | 0.9573 |
| hCV2690377 | rs10879245 | hCV11686292 | rs1051334 | 0.9 | 0.9557 |
| hCV2690377 | rs10879245 | hCV15957961 | rs2270586 | 0.9 | 0.9557 |
| hCV2690377 | rs10879245 | hCV26441048 | rs3851610 | 0.9 | 0.9573 |
| hCV2690377 | rs10879245 | hCV26441140 | rs9325191 | 0.9 | 1 |
| hCV2690377 | rs10879245 | hCV2690286 | rs2270584 | 0.9 | 0.9552 |
| hCV2690377 | rs10879245 | hCV2690333 | rs11178602 | 0.9 | 1 |
| hCV2690377 | rs10879245 | hCV2690348 | rs11178594 | 0.9 | 1 |
| hCV2690377 | rs10879245 | hCV2690350 | rs2132242 | 0.9 | 1 |
| hCV2690377 | rs10879245 | hCV2690354 | rs11178589 | 0.9 | 1 |
| hCV2690377 | rs10879245 | hCV2690362 | rs10879249 | 0.9 | 1 |
| hCV2690377 | rs10879245 | hCV2690365 | rs11178583 | 0.9 | 1 |
| hCV2690377 | rs10879245 | hCV2690375 | rs1567740 | 0.9 | 1 |
| hCV2690377 | rs10879245 | hCV2690378 | rs11178579 | 0.9 | 1 |
| hCV2690377 | rs10879245 | hCV2690379 | rs10879242 | 0.9 | 1 |
| hCV2690377 | rs10879245 | hCV2690380 | rs10506623 | 0.9 | 1 |
| hCV2690377 | rs10879245 | hCV2690388 | rs2132241 | 0.9 | 1 |
| hCV2690377 | rs10879245 | hCV29593612 | rs10506626 | 0.9 | 0.9557 |
| hCV2690377 | rs10879245 | hCV31190567 | rs7311994 | 0.9 | 1 |
| hCV2690377 | rs10879245 | hCV31190598 | rs12818936 | 0.9 | 1 |
| hCV2690377 | rs10879245 | hCV31190625 | rs11178648 | 0.9 | 0.9557 |
| hCV2690377 | rs10879245 | hCV31190877 | rs12831292 | 0.9 | 1 |
| hCV2690377 | rs10879245 | hCV8375364 | rs966583 | 0.9 | 1 |
| hCV2690377 | rs10879245 | hCV8871988 | rs1495375 | 0.9 | 1 |
| hCV2690377 | rs10879245 | hCV8871989 | rs1512989 | 0.9 | 1 |
| hCV2690377 | rs10879245 | hCV8871990 | rs1512988 | 0.9 | 1 |
| hCV2690377 | rs10879245 | hCV8873466 | rs1051344 | 0.9 | 1 |
| hCV2690377 | rs10879245 | hCV8873472 | rs1355373 | 0.9 | 1 |
| hCV2690378 | rs11178579 | hCV11412791 | rs1874313 | 0.9 | 1 |
| hCV2690378 | rs11178579 | hCV11686277 | rs3763978 | 0.9 | 1 |
| hCV2690378 | rs11178579 | hCV11686292 | rs1051334 | 0.9 | 1 |
| hCV2690378 | rs11178579 | hCV15957961 | rs2270586 | 0.9 | 1 |
| hCV2690378 | rs11178579 | hCV26441048 | rs3851610 | 0.9 | 1 |
| hCV2690378 | rs11178579 | hCV26441140 | rs9325191 | 0.9 | 1 |
| hCV2690378 | rs11178579 | hCV2690286 | rs2270584 | 0.9 | 1 |
| hCV2690378 | rs11178579 | hCV2690333 | rs11178602 | 0.9 | 1 |
| hCV2690378 | rs11178579 | hCV2690348 | rs11178594 | 0.9 | 1 |
| hCV2690378 | rs11178579 | hCV2690350 | rs2132242 | 0.9 | 1 |
| hCV2690378 | rs11178579 | hCV2690354 | rs11178589 | 0.9 | 1 |
| hCV2690378 | rs11178579 | hCV2690362 | rs10879249 | 0.9 | 1 |
| hCV2690378 | rs11178579 | hCV2690365 | rs11178583 | 0.9 | 1 |
| hCV2690378 | rs11178579 | hCV2690375 | rs1567740 | 0.9 | 1 |
| hCV2690378 | rs11178579 | hCV2690377 | rs10879245 | 0.9 | 1 |
| hCV2690378 | rs11178579 | hCV2690379 | rs10879242 | 0.9 | 1 |
| hCV2690378 | rs11178579 | hCV2690380 | rs10506623 | 0.9 | 1 |
| hCV2690378 | rs11178579 | hCV2690388 | rs2132241 | 0.9 | 1 |
| hCV2690378 | rs11178579 | hCV27530498 | rs3942254 | 0.9 | 0.9577 |
| hCV2690378 | rs11178579 | hCV29593612 | rs10506626 | 0.9 | 1 |
| hCV2690378 | rs11178579 | hCV31190567 | rs7311994 | 0.9 | 1 |
| hCV2690378 | rs11178579 | hCV31190598 | rs12818936 | 0.9 | 1 |
| hCV2690378 | rs11178579 | hCV31190625 | rs11178648 | 0.9 | 1 |
| hCV2690378 | rs11178579 | hCV31190877 | rs12831292 | 0.9 | 0.9609 |
| hCV2690378 | rs11178579 | hCV8375364 | rs966583 | 0.9 | 1 |
| hCV2690378 | rs11178579 | hCV8871988 | rs1495375 | 0.9 | 1 |
| hCV2690378 | rs11178579 | hCV8871989 | rs1512989 | 0.9 | 1 |
| hCV2690378 | rs11178579 | hCV8871990 | rs1512988 | 0.9 | 1 |
| hCV2690378 | rs11178579 | hCV8873466 | rs1051344 | 0.9 | 1 |
| hCV2690378 | rs11178579 | hCV8873472 | rs1355373 | 0.9 | 1 |
| hCV2690379 | rs10879242 | hCV11686277 | rs3763978 | 0.9 | 0.9645 |
| hCV2690379 | rs10879242 | hCV11686292 | rs1051334 | 0.9 | 0.9627 |
| hCV2690379 | rs10879242 | hCV15957961 | rs2270586 | 0.9 | 0.9627 |

TABLE 3-continued

| Interrogated SNP (hCV #) | Interrogated SNP (rs #) | LD SNP (hCV #) | LD SNP (rs #) | Threshold $r^2$ | $r^2$ |
| --- | --- | --- | --- | --- | --- |
| hCV2690379 | rs10879242 | hCV26441048 | rs3851610 | 0.9 | 0.9645 |
| hCV2690379 | rs10879242 | hCV26441140 | rs9325191 | 0.9 | 1 |
| hCV2690379 | rs10879242 | hCV2690286 | rs2270584 | 0.9 | 0.9622 |
| hCV2690379 | rs10879242 | hCV2690333 | rs11178602 | 0.9 | 1 |
| hCV2690379 | rs10879242 | hCV2690348 | rs11178594 | 0.9 | 1 |
| hCV2690379 | rs10879242 | hCV2690350 | rs2132242 | 0.9 | 1 |
| hCV2690379 | rs10879242 | hCV2690354 | rs11178589 | 0.9 | 1 |
| hCV2690379 | rs10879242 | hCV2690362 | rs10879249 | 0.9 | 1 |
| hCV2690379 | rs10879242 | hCV2690365 | rs11178583 | 0.9 | 1 |
| hCV2690379 | rs10879242 | hCV2690375 | rs1567740 | 0.9 | 1 |
| hCV2690379 | rs10879242 | hCV2690377 | rs10879245 | 0.9 | 1 |
| hCV2690379 | rs10879242 | hCV2690378 | rs11178579 | 0.9 | 1 |
| hCV2690379 | rs10879242 | hCV2690380 | rs10506623 | 0.9 | 1 |
| hCV2690379 | rs10879242 | hCV2690388 | rs2132241 | 0.9 | 1 |
| hCV2690379 | rs10879242 | hCV29593612 | rs10506626 | 0.9 | 0.9627 |
| hCV2690379 | rs10879242 | hCV31190567 | rs7311994 | 0.9 | 1 |
| hCV2690379 | rs10879242 | hCV31190598 | rs12818936 | 0.9 | 1 |
| hCV2690379 | rs10879242 | hCV31190625 | rs11178648 | 0.9 | 0.9627 |
| hCV2690379 | rs10879242 | hCV31190877 | rs12831292 | 0.9 | 0.9645 |
| hCV2690379 | rs10879242 | hCV8375364 | rs966583 | 0.9 | 1 |
| hCV2690379 | rs10879242 | hCV8871988 | rs1495375 | 0.9 | 1 |
| hCV2690379 | rs10879242 | hCV8871989 | rs1512989 | 0.9 | 1 |
| hCV2690379 | rs10879242 | hCV8871990 | rs1512988 | 0.9 | 1 |
| hCV2690379 | rs10879242 | hCV8873466 | rs1051344 | 0.9 | 1 |
| hCV2690379 | rs10879242 | hCV8873472 | rs1355373 | 0.9 | 1 |
| hCV27084860 | rs10758326 | hCV29338383 | rs7847621 | 0.9 | 0.9273 |
| hCV27084860 | rs10758326 | hCV31931605 | rs7022281 | 0.9 | 0.9004 |
| hCV27084860 | rs10758326 | hCV31931609 | rs10738948 | 0.9 | 0.9637 |
| hCV27344887 | rs4038018 | hCV27344902 | rs4463950 | 0.9 | 1 |
| hCV27344887 | rs4038018 | hCV28025299 | rs4771960 | 0.9 | 0.9616 |
| hCV27344887 | rs4038018 | hCV32256712 | rs9556694 | 0.9 | 0.9599 |
| hCV27367681 | rs2876227 | hCV2529198 | rs742827 | 0.9 | 1 |
| hCV27367681 | rs2876227 | hCV2529202 | rs6040667 | 0.9 | 0.9649 |
| hCV27367681 | rs2876227 | hCV2529211 | rs17189710 | 0.9 | 0.9616 |
| hCV27367681 | rs2876227 | hCV2529224 | rs2327412 | 0.9 | 0.9616 |
| hCV27367681 | rs2876227 | hCV2529230 | rs4444612 | 0.9 | 0.9616 |
| hCV27367681 | rs2876227 | hCV2529231 | rs4315598 | 0.9 | 0.9616 |
| hCV27367681 | rs2876227 | hCV2529239 | rs6040638 | 0.9 | 0.9616 |
| hCV27367681 | rs2876227 | hCV2529241 | rs6134243 | 0.9 | 0.9649 |
| hCV27367681 | rs2876227 | hCV2529246 | rs6040619 | 0.9 | 0.9616 |
| hCV27367681 | rs2876227 | hCV27367708 | rs1009748 | 0.9 | 0.9616 |
| hCV27367681 | rs2876227 | hCV29840965 | rs6040644 | 0.9 | 0.9616 |
| hCV27367681 | rs2876227 | hCV30057061 | rs6033138 | 0.9 | 0.9649 |
| hCV27367681 | rs2876227 | hCV30093270 | rs6040625 | 0.9 | 0.9649 |
| hCV27367681 | rs2876227 | hCV30129243 | rs6040636 | 0.9 | 0.9649 |
| hCV27367681 | rs2876227 | hCV30218977 | rs6040633 | 0.9 | 0.9649 |
| hCV27367681 | rs2876227 | hCV30417550 | rs6040634 | 0.9 | 0.9649 |
| hCV27367681 | rs2876227 | hCV30453433 | rs6131208 | 0.9 | 0.9193 |
| hCV27367681 | rs2876227 | hCV32274419 | rs13038146 | 0.9 | 0.9649 |
| hCV27367681 | rs2876227 | hCV330228 | rs6040668 | 0.9 | 0.9649 |
| hCV27367708 | rs1009748 | hCV2529198 | rs742827 | 0.9 | 0.9596 |
| hCV27367708 | rs1009748 | hCV2529202 | rs6040667 | 0.9 | 1 |
| hCV27367708 | rs1009748 | hCV2529211 | rs17189710 | 0.9 | 1 |
| hCV27367708 | rs1009748 | hCV2529224 | rs2327412 | 0.9 | 1 |
| hCV27367708 | rs1009748 | hCV2529230 | rs4444612 | 0.9 | 1 |
| hCV27367708 | rs1009748 | hCV2529231 | rs4315598 | 0.9 | 1 |
| hCV27367708 | rs1009748 | hCV2529239 | rs6040638 | 0.9 | 1 |
| hCV27367708 | rs1009748 | hCV2529241 | rs6134243 | 0.9 | 1 |
| hCV27367708 | rs1009748 | hCV2529246 | rs6040619 | 0.9 | 1 |
| hCV27367708 | rs1009748 | hCV27367681 | rs2876227 | 0.9 | 0.9616 |
| hCV27367708 | rs1009748 | hCV29840965 | rs6040644 | 0.9 | 1 |
| hCV27367708 | rs1009748 | hCV30057061 | rs6033138 | 0.9 | 1 |
| hCV27367708 | rs1009748 | hCV30093270 | rs6040625 | 0.9 | 1 |
| hCV27367708 | rs1009748 | hCV30129243 | rs6040636 | 0.9 | 1 |
| hCV27367708 | rs1009748 | hCV30218977 | rs6040633 | 0.9 | 1 |
| hCV27367708 | rs1009748 | hCV30417550 | rs6040634 | 0.9 | 1 |
| hCV27367708 | rs1009748 | hCV30453433 | rs6131208 | 0.9 | 0.9565 |
| hCV27367708 | rs1009748 | hCV30615489 | rs6040630 | 0.9 | 0.9225 |
| hCV27367708 | rs1009748 | hCV32274419 | rs13038146 | 0.9 | 1 |
| hCV27367708 | rs1009748 | hCV330228 | rs6040668 | 0.9 | 1 |
| hCV2745822 | rs1913201 | hCV11686367 | rs7955901 | 0.9 | 0.9432 |
| hCV2745822 | rs1913201 | hCV171102 | rs7313973 | 0.9 | 0.9568 |
| hCV2745822 | rs1913201 | hCV240133 | rs4760895 | 0.9 | 0.9 |
| hCV2745822 | rs1913201 | hCV240134 | rs7138300 | 0.9 | 1 |
| hCV2745822 | rs1913201 | hCV2745815 | rs1512991 | 0.9 | 0.9644 |
| hCV2745822 | rs1913201 | hCV2745828 | rs10879240 | 0.9 | 0.9639 |
| hCV2745822 | rs1913201 | hCV27952502 | rs4760894 | 0.9 | 1 |

TABLE 3-continued

| Interrogated SNP (hCV #) | Interrogated SNP (rs #) | LD SNP (hCV #) | LD SNP (rs #) | Threshold $r^2$ | $r^2$ |
|---|---|---|---|---|---|
| hCV2745822 | rs1913201 | hCV27952503 | rs4760785 | 0.9 | 1 |
| hCV2745822 | rs1913201 | hCV31190777 | rs10784891 | 0.9 | 0.9588 |
| hCV2745822 | rs1913201 | hDV72015086 | rs7956274 | 0.9 | 0.9622 |
| hCV2745828 | rs10879240 | hCV11686367 | rs7955901 | 0.9 | 0.9274 |
| hCV2745828 | rs10879240 | hCV171102 | rs7313973 | 0.9 | 0.9208 |
| hCV2745828 | rs10879240 | hCV240133 | rs4760895 | 0.9 | 0.9664 |
| hCV2745828 | rs10879240 | hCV240134 | rs7138300 | 0.9 | 0.9639 |
| hCV2745828 | rs10879240 | hCV2745815 | rs1512991 | 0.9 | 0.9324 |
| hCV2745828 | rs10879240 | hCV2745822 | rs1913201 | 0.9 | 0.9639 |
| hCV2745828 | rs10879240 | hCV27952502 | rs4760894 | 0.9 | 0.9664 |
| hCV2745828 | rs10879240 | hCV27952503 | rs4760785 | 0.9 | 0.9664 |
| hCV2745828 | rs10879240 | hCV29120310 | rs7298255 | 0.9 | 0.9274 |
| hCV2745828 | rs10879240 | hCV31190748 | rs7959965 | 0.9 | 0.9274 |
| hCV2745828 | rs10879240 | hCV31190777 | rs10784891 | 0.9 | 0.9235 |
| hCV2745828 | rs10879240 | hDV72015086 | rs7956274 | 0.9 | 0.9285 |
| hCV27872026 | rs4851531 | hCV16126066 | rs2110564 | 0.9 | 0.9638 |
| hCV27872026 | rs4851531 | hCV2676440 | rs6722640 | 0.9 | 0.9638 |
| hCV27872026 | rs4851531 | hCV349805 | rs4851529 | 0.9 | 0.9646 |
| hCV27872026 | rs4851531 | hCV8905894 | rs974950 | 0.9 | 0.9812 |
| hCV27894109 | rs4879931 | hCV29338373 | rs7035913 | 0.9 | 1 |
| hCV27894109 | rs4879931 | hDV70921009 | rs17204908 | 0.9 | 1 |
| hCV27933339 | rs4586678 | hCV26135665 | rs4390811 | 0.9 | 0.96 |
| hCV27933339 | rs4586678 | hCV26771384 | rs10865197 | 0.9 | 1 |
| hCV27933339 | rs4586678 | hCV26771389 | rs10183431 | 0.9 | 1 |
| hCV27933339 | rs4586678 | hCV27875215 | rs4346434 | 0.9 | 0.922 |
| hCV27933339 | rs4586678 | hCV29229284 | rs6741066 | 0.9 | 0.9591 |
| hCV27933339 | rs4586678 | hCV30817981 | rs6723119 | 0.9 | 0.96 |
| hCV27933339 | rs4586678 | hCV375079 | rs9309112 | 0.9 | 0.92 |
| hCV27933339 | rs4586678 | hCV375083 | rs10206724 | 0.9 | 1 |
| hCV27933339 | rs4586678 | hCV375090 | rs4450660 | 0.9 | 1 |
| hCV27933339 | rs4586678 | hCV514334 | rs6544721 | 0.9 | 0.961 |
| hCV27952502 | rs4760894 | hCV11686367 | rs7955901 | 0.9 | 0.9644 |
| hCV27952502 | rs4760894 | hCV171102 | rs7313973 | 0.9 | 0.9603 |
| hCV27952502 | rs4760894 | hCV240133 | rs4760895 | 0.9 | 1 |
| hCV27952502 | rs4760894 | hCV240134 | rs7138300 | 0.9 | 1 |
| hCV27952502 | rs4760894 | hCV2745815 | rs1512991 | 0.9 | 0.9668 |
| hCV27952502 | rs4760894 | hCV2745822 | rs1913201 | 0.9 | 1 |
| hCV27952502 | rs4760894 | hCV2745828 | rs10879240 | 0.9 | 0.9664 |
| hCV27952502 | rs4760894 | hCV27952503 | rs4760785 | 0.9 | 1 |
| hCV27952502 | rs4760894 | hCV29120310 | rs7298255 | 0.9 | 0.9644 |
| hCV27952502 | rs4760894 | hCV31190748 | rs7959965 | 0.9 | 0.9644 |
| hCV27952502 | rs4760894 | hCV31190777 | rs10784891 | 0.9 | 0.962 |
| hCV27952502 | rs4760894 | hDV72015086 | rs7956274 | 0.9 | 0.9649 |
| hCV27952503 | rs4760785 | hCV11686367 | rs7955901 | 0.9 | 0.9644 |
| hCV27952503 | rs4760785 | hCV171102 | rs7313973 | 0.9 | 0.9603 |
| hCV27952503 | rs4760785 | hCV240133 | rs4760895 | 0.9 | 1 |
| hCV27952503 | rs4760785 | hCV240134 | rs7138300 | 0.9 | 1 |
| hCV27952503 | rs4760785 | hCV2745815 | rs1512991 | 0.9 | 0.9668 |
| hCV27952503 | rs4760785 | hCV2745822 | rs1913201 | 0.9 | 1 |
| hCV27952503 | rs4760785 | hCV2745828 | rs10879240 | 0.9 | 0.9664 |
| hCV27952503 | rs4760785 | hCV27952502 | rs4760894 | 0.9 | 1 |
| hCV27952503 | rs4760785 | hCV29120310 | rs7298255 | 0.9 | 0.9644 |
| hCV27952503 | rs4760785 | hCV31190748 | rs7959965 | 0.9 | 0.9644 |
| hCV27952503 | rs4760785 | hCV31190777 | rs10784891 | 0.9 | 0.962 |
| hCV27952503 | rs4760785 | hDV72015086 | rs7956274 | 0.9 | 0.9649 |
| hCV27974149 | rs4964416 | hCV29121666 | rs6539231 | 0.9 | 0.9266 |
| hCV27996154 | rs4836502 | hCV11819780 | rs12153185 | 0.9 | 1 |
| hCV27996154 | rs4836502 | hCV11819782 | rs12719415 | 0.9 | 1 |
| hCV27996154 | rs4836502 | hCV2575318 | rs7711358 | 0.9 | 0.927 |
| hCV27996154 | rs4836502 | hCV2575336 | rs2418541 | 0.9 | 0.927 |
| hCV27996154 | rs4836502 | hCV2575340 | rs11242020 | 0.9 | 0.927 |
| hCV27996154 | rs4836502 | hCV26478744 | rs2016194 | 0.9 | 0.9198 |
| hCV27996154 | rs4836502 | hCV26478745 | rs2108426 | 0.9 | 0.9135 |
| hCV27996154 | rs4836502 | hCV26478747 | rs2190598 | 0.9 | 1 |
| hCV27996154 | rs4836502 | hCV26478763 | rs2418542 | 0.9 | 0.927 |
| hCV27996154 | rs4836502 | hCV2961244 | rs2418548 | 0.9 | 1 |
| hCV27996154 | rs4836502 | hCV2961250 | rs4836507 | 0.9 | 1 |
| hCV27996154 | rs4836502 | hCV2961252 | rs10067895 | 0.9 | 1 |
| hCV27996154 | rs4836502 | hCV2961253 | rs2190600 | 0.9 | 1 |
| hCV27996154 | rs4836502 | hCV2961259 | rs11242023 | 0.9 | 0.9621 |
| hCV27996154 | rs4836502 | hCV2961260 | rs11242022 | 0.9 | 1 |
| hCV27996154 | rs4836502 | hCV2961261 | rs11242021 | 0.9 | 1 |
| hCV27996154 | rs4836502 | hCV2961267 | rs1476714 | 0.9 | 1 |
| hCV27996154 | rs4836502 | hCV2961268 | rs2108425 | 0.9 | 1 |
| hCV27996154 | rs4836502 | hCV2961269 | rs2158958 | 0.9 | 1 |
| hCV27996154 | rs4836502 | hCV2961270 | rs9327555 | 0.9 | 1 |
| hCV27996154 | rs4836502 | hCV2961278 | rs7446891 | 0.9 | 1 |

TABLE 3-continued

| Interrogated SNP (hCV #) | Interrogated SNP (rs #) | LD SNP (hCV #) | LD SNP (rs #) | Threshold $r^2$ | $r^2$ |
|---|---|---|---|---|---|
| hCV27996154 | rs4836502 | hCV2961280 | rs10520072 | 0.9 | 1 |
| hCV27996154 | rs4836502 | hCV2961282 | rs917295 | 0.9 | 1 |
| hCV27996154 | rs4836502 | hCV2961284 | rs10054055 | 0.9 | 0.9616 |
| hCV27996154 | rs4836502 | hCV2961296 | rs10051148 | 0.9 | 0.9623 |
| hCV27996154 | rs4836502 | hCV2961297 | rs2158961 | 0.9 | 0.9634 |
| hCV27996154 | rs4836502 | hCV2961306 | rs264129 | 0.9 | 0.9232 |
| hCV27996154 | rs4836502 | hCV30621656 | rs10478919 | 0.9 | 0.927 |
| hCV27996154 | rs4836502 | hCV31237567 | rs11749272 | 0.9 | 0.927 |
| hCV27996154 | rs4836502 | hCV346713 | rs1990023 | 0.9 | 0.9232 |
| hCV27996154 | rs4836502 | hCV546489 | rs264122 | 0.9 | 0.9616 |
| hCV27996154 | rs4836502 | hCV8932829 | rs1116596 | 0.9 | 0.927 |
| hCV2881200 | rs2052428 | hCV2881217 | rs10735411 | 0.9 | 0.9234 |
| hCV2881200 | rs2052428 | hCV31198182 | rs10778446 | 0.9 | 0.9234 |
| hCV29012564 | rs7338174 | hCV29012561 | rs7333988 | 0.9 | 0.9184 |
| hCV29120310 | rs7298255 | hCV11686367 | rs7955901 | 0.9 | 0.9442 |
| hCV29120310 | rs7298255 | hCV11686374 | rs7957932 | 0.9 | 0.9161 |
| hCV29120310 | rs7298255 | hCV171102 | rs7313973 | 0.9 | 0.9568 |
| hCV29120310 | rs7298255 | hCV240133 | rs4760895 | 0.9 | 0.9644 |
| hCV29120310 | rs7298255 | hCV2745805 | rs7132840 | 0.9 | 0.9268 |
| hCV29120310 | rs7298255 | hCV2745807 | rs2063591 | 0.9 | 0.9303 |
| hCV29120310 | rs7298255 | hCV2745815 | rs1512991 | 0.9 | 1 |
| hCV29120310 | rs7298255 | hCV2745828 | rs10879240 | 0.9 | 0.9274 |
| hCV29120310 | rs7298255 | hCV27952502 | rs4760894 | 0.9 | 0.9644 |
| hCV29120310 | rs7298255 | hCV27952503 | rs4760785 | 0.9 | 0.9644 |
| hCV29120310 | rs7298255 | hCV31190748 | rs7959965 | 0.9 | 1 |
| hCV29120310 | rs7298255 | hCV31190777 | rs10784891 | 0.9 | 1 |
| hCV29120310 | rs7298255 | hDV72015086 | rs7956274 | 0.9 | 1 |
| hCV29121666 | rs6539231 | hCV27974149 | rs4964416 | 0.9 | 0.9266 |
| hCV29121666 | rs6539231 | hCV2881196 | rs878612 | 0.9 | 0.9637 |
| hCV29121666 | rs6539231 | hCV29121664 | rs7970318 | 0.9 | 0.9078 |
| hCV29121666 | rs6539231 | hCV29121665 | rs6539230 | 0.9 | 0.9078 |
| hCV29268001 | rs7939893 | hCV26881087 | rs4472926 | 0.9 | 0.9787 |
| hCV2961244 | rs2418548 | hCV11819780 | rs12153185 | 0.9 | 1 |
| hCV2961244 | rs2418548 | hCV11819782 | rs12719415 | 0.9 | 1 |
| hCV2961244 | rs2418548 | hCV2575318 | rs7711358 | 0.9 | 0.9232 |
| hCV2961244 | rs2418548 | hCV2575336 | rs2418541 | 0.9 | 0.9232 |
| hCV2961244 | rs2418548 | hCV2575340 | rs11242020 | 0.9 | 0.9232 |
| hCV2961244 | rs2418548 | hCV26478744 | rs2016194 | 0.9 | 1 |
| hCV2961244 | rs2418548 | hCV26478745 | rs2108426 | 0.9 | 1 |
| hCV2961244 | rs2418548 | hCV26478747 | rs2190598 | 0.9 | 1 |
| hCV2961244 | rs2418548 | hCV26478763 | rs2418542 | 0.9 | 0.9232 |
| hCV2961244 | rs2418548 | hCV27996154 | rs4836502 | 0.9 | 1 |
| hCV2961244 | rs2418548 | hCV2961250 | rs4836507 | 0.9 | 1 |
| hCV2961244 | rs2418548 | hCV2961252 | rs10067895 | 0.9 | 1 |
| hCV2961244 | rs2418548 | hCV2961253 | rs2190600 | 0.9 | 1 |
| hCV2961244 | rs2418548 | hCV2961259 | rs11242023 | 0.9 | 0.9571 |
| hCV2961244 | rs2418548 | hCV2961260 | rs11242022 | 0.9 | 0.9785 |
| hCV2961244 | rs2418548 | hCV2961261 | rs11242021 | 0.9 | 1 |
| hCV2961244 | rs2418548 | hCV2961267 | rs1476714 | 0.9 | 1 |
| hCV2961244 | rs2418548 | hCV2961268 | rs2108425 | 0.9 | 1 |
| hCV2961244 | rs2418548 | hCV2961269 | rs2158958 | 0.9 | 1 |
| hCV2961244 | rs2418548 | hCV2961270 | rs9327555 | 0.9 | 1 |
| hCV2961244 | rs2418548 | hCV2961278 | rs7446891 | 0.9 | 1 |
| hCV2961244 | rs2418548 | hCV2961280 | rs10520072 | 0.9 | 1 |
| hCV2961244 | rs2418548 | hCV2961282 | rs917295 | 0.9 | 1 |
| hCV2961244 | rs2418548 | hCV2961284 | rs10054055 | 0.9 | 0.9573 |
| hCV2961244 | rs2418548 | hCV2961296 | rs10051148 | 0.9 | 0.9608 |
| hCV2961244 | rs2418548 | hCV2961297 | rs2158961 | 0.9 | 0.9616 |
| hCV2961244 | rs2418548 | hCV2961306 | rs264129 | 0.9 | 0.9358 |
| hCV2961244 | rs2418548 | hCV30621656 | rs10478919 | 0.9 | 0.9232 |
| hCV2961244 | rs2418548 | hCV31237567 | rs11749272 | 0.9 | 0.9232 |
| hCV2961244 | rs2418548 | hCV346713 | rs1990023 | 0.9 | 0.9358 |
| hCV2961244 | rs2418548 | hCV546489 | rs264122 | 0.9 | 0.9573 |
| hCV2961244 | rs2418548 | hCV8932829 | rs1116596 | 0.9 | 0.9232 |
| hCV2961250 | rs4836507 | hCV11819780 | rs12153185 | 0.9 | 1 |
| hCV2961250 | rs4836507 | hCV11819782 | rs12719415 | 0.9 | 1 |
| hCV2961250 | rs4836507 | hCV2575318 | rs7711358 | 0.9 | 0.927 |
| hCV2961250 | rs4836507 | hCV2575336 | rs2418541 | 0.9 | 0.927 |
| hCV2961250 | rs4836507 | hCV2575340 | rs11242020 | 0.9 | 0.927 |
| hCV2961250 | rs4836507 | hCV26478744 | rs2016194 | 0.9 | 0.9198 |
| hCV2961250 | rs4836507 | hCV26478745 | rs2108426 | 0.9 | 0.9135 |
| hCV2961250 | rs4836507 | hCV26478747 | rs2190598 | 0.9 | 1 |
| hCV2961250 | rs4836507 | hCV26478763 | rs2418542 | 0.9 | 0.927 |
| hCV2961250 | rs4836507 | hCV27996154 | rs4836502 | 0.9 | 1 |
| hCV2961250 | rs4836507 | hCV2961244 | rs2418548 | 0.9 | 1 |
| hCV2961250 | rs4836507 | hCV2961252 | rs10067895 | 0.9 | 1 |
| hCV2961250 | rs4836507 | hCV2961253 | rs2190600 | 0.9 | 1 |

TABLE 3-continued

| Interrogated SNP (hCV #) | Interrogated SNP (rs #) | LD SNP (hCV #) | LD SNP (rs #) | Threshold $r^2$ | $r^2$ |
|---|---|---|---|---|---|
| hCV2961250 | rs4836507 | hCV2961259 | rs11242023 | 0.9 | 0.9621 |
| hCV2961250 | rs4836507 | hCV2961260 | rs11242022 | 0.9 | 1 |
| hCV2961250 | rs4836507 | hCV2961261 | rs11242021 | 0.9 | 1 |
| hCV2961250 | rs4836507 | hCV2961267 | rs1476714 | 0.9 | 1 |
| hCV2961250 | rs4836507 | hCV2961268 | rs2108425 | 0.9 | 1 |
| hCV2961250 | rs4836507 | hCV2961269 | rs2158958 | 0.9 | 1 |
| hCV2961250 | rs4836507 | hCV2961270 | rs9327555 | 0.9 | 1 |
| hCV2961250 | rs4836507 | hCV2961278 | rs7446891 | 0.9 | 1 |
| hCV2961250 | rs4836507 | hCV2961280 | rs10520072 | 0.9 | 1 |
| hCV2961250 | rs4836507 | hCV2961282 | rs917295 | 0.9 | 1 |
| hCV2961250 | rs4836507 | hCV2961284 | rs10054055 | 0.9 | 0.9616 |
| hCV2961250 | rs4836507 | hCV2961296 | rs10051148 | 0.9 | 0.9623 |
| hCV2961250 | rs4836507 | hCV2961297 | rs2158961 | 0.9 | 0.9634 |
| hCV2961250 | rs4836507 | hCV2961306 | rs264129 | 0.9 | 0.9232 |
| hCV2961250 | rs4836507 | hCV30621656 | rs10478919 | 0.9 | 0.927 |
| hCV2961250 | rs4836507 | hCV31237567 | rs11749272 | 0.9 | 0.927 |
| hCV2961250 | rs4836507 | hCV346713 | rs1990023 | 0.9 | 0.9232 |
| hCV2961250 | rs4836507 | hCV546489 | rs264122 | 0.9 | 0.9616 |
| hCV2961250 | rs4836507 | hCV8932829 | rs1116596 | 0.9 | 0.927 |
| hCV2961252 | rs10067895 | hCV11819780 | rs12153185 | 0.9 | 1 |
| hCV2961252 | rs10067895 | hCV11819782 | rs12719415 | 0.9 | 1 |
| hCV2961252 | rs10067895 | hCV2575318 | rs7711358 | 0.9 | 0.927 |
| hCV2961252 | rs10067895 | hCV2575336 | rs2418541 | 0.9 | 0.927 |
| hCV2961252 | rs10067895 | hCV2575340 | rs11242020 | 0.9 | 0.927 |
| hCV2961252 | rs10067895 | hCV26478744 | rs2016194 | 0.9 | 0.9198 |
| hCV2961252 | rs10067895 | hCV26478745 | rs2108426 | 0.9 | 0.9135 |
| hCV2961252 | rs10067895 | hCV26478747 | rs2190598 | 0.9 | 1 |
| hCV2961252 | rs10067895 | hCV26478763 | rs2418542 | 0.9 | 0.927 |
| hCV2961252 | rs10067895 | hCV27996154 | rs4836502 | 0.9 | 1 |
| hCV2961252 | rs10067895 | hCV2961244 | rs2418548 | 0.9 | 1 |
| hCV2961252 | rs10067895 | hCV2961250 | rs4836507 | 0.9 | 1 |
| hCV2961252 | rs10067895 | hCV2961253 | rs2190600 | 0.9 | 1 |
| hCV2961252 | rs10067895 | hCV2961259 | rs11242023 | 0.9 | 0.9621 |
| hCV2961252 | rs10067895 | hCV2961260 | rs11242022 | 0.9 | 1 |
| hCV2961252 | rs10067895 | hCV2961261 | rs11242021 | 0.9 | 1 |
| hCV2961252 | rs10067895 | hCV2961267 | rs1476714 | 0.9 | 1 |
| hCV2961252 | rs10067895 | hCV2961268 | rs2108425 | 0.9 | 1 |
| hCV2961252 | rs10067895 | hCV2961269 | rs2158958 | 0.9 | 1 |
| hCV2961252 | rs10067895 | hCV2961270 | rs9327555 | 0.9 | 1 |
| hCV2961252 | rs10067895 | hCV2961278 | rs7446891 | 0.9 | 1 |
| hCV2961252 | rs10067895 | hCV2961280 | rs10520072 | 0.9 | 1 |
| hCV2961252 | rs10067895 | hCV2961282 | rs917295 | 0.9 | 1 |
| hCV2961252 | rs10067895 | hCV2961284 | rs10054055 | 0.9 | 0.9616 |
| hCV2961252 | rs10067895 | hCV2961296 | rs10051148 | 0.9 | 0.9623 |
| hCV2961252 | rs10067895 | hCV2961297 | rs2158961 | 0.9 | 0.9634 |
| hCV2961252 | rs10067895 | hCV2961306 | rs264129 | 0.9 | 0.9232 |
| hCV2961252 | rs10067895 | hCV30621656 | rs10478919 | 0.9 | 0.927 |
| hCV2961252 | rs10067895 | hCV31237567 | rs11749272 | 0.9 | 0.927 |
| hCV2961252 | rs10067895 | hCV346713 | rs1990023 | 0.9 | 0.9232 |
| hCV2961252 | rs10067895 | hCV546489 | rs264122 | 0.9 | 0.9616 |
| hCV2961252 | rs10067895 | hCV8932829 | rs1116596 | 0.9 | 0.927 |
| hCV2961253 | rs2190600 | hCV11819780 | rs12153185 | 0.9 | 1 |
| hCV2961253 | rs2190600 | hCV11819782 | rs12719415 | 0.9 | 1 |
| hCV2961253 | rs2190600 | hCV2575318 | rs7711358 | 0.9 | 0.927 |
| hCV2961253 | rs2190600 | hCV2575336 | rs2418541 | 0.9 | 0.927 |
| hCV2961253 | rs2190600 | hCV2575340 | rs11242020 | 0.9 | 0.927 |
| hCV2961253 | rs2190600 | hCV26478744 | rs2016194 | 0.9 | 0.9198 |
| hCV2961253 | rs2190600 | hCV26478745 | rs2108426 | 0.9 | 0.9135 |
| hCV2961253 | rs2190600 | hCV26478747 | rs2190598 | 0.9 | 1 |
| hCV2961253 | rs2190600 | hCV26478763 | rs2418542 | 0.9 | 0.927 |
| hCV2961253 | rs2190600 | hCV27996154 | rs4836502 | 0.9 | 1 |
| hCV2961253 | rs2190600 | hCV2961244 | rs2418548 | 0.9 | 1 |
| hCV2961253 | rs2190600 | hCV2961250 | rs4836507 | 0.9 | 1 |
| hCV2961253 | rs2190600 | hCV2961252 | rs10067895 | 0.9 | 1 |
| hCV2961253 | rs2190600 | hCV2961259 | rs11242023 | 0.9 | 0.9621 |
| hCV2961253 | rs2190600 | hCV2961260 | rs11242022 | 0.9 | 1 |
| hCV2961253 | rs2190600 | hCV2961261 | rs11242021 | 0.9 | 1 |
| hCV2961253 | rs2190600 | hCV2961267 | rs1476714 | 0.9 | 1 |
| hCV2961253 | rs2190600 | hCV2961268 | rs2108425 | 0.9 | 1 |
| hCV2961253 | rs2190600 | hCV2961269 | rs2158958 | 0.9 | 1 |
| hCV2961253 | rs2190600 | hCV2961270 | rs9327555 | 0.9 | 1 |
| hCV2961253 | rs2190600 | hCV2961278 | rs7446891 | 0.9 | 1 |
| hCV2961253 | rs2190600 | hCV2961280 | rs10520072 | 0.9 | 1 |
| hCV2961253 | rs2190600 | hCV2961282 | rs917295 | 0.9 | 1 |
| hCV2961253 | rs2190600 | hCV2961284 | rs10054055 | 0.9 | 0.9616 |
| hCV2961253 | rs2190600 | hCV2961296 | rs10051148 | 0.9 | 0.9623 |
| hCV2961253 | rs2190600 | hCV2961297 | rs2158961 | 0.9 | 0.9634 |

TABLE 3-continued

| Interrogated SNP (hCV #) | Interrogated SNP (rs #) | LD SNP (hCV #) | LD SNP (rs #) | Threshold $r^2$ | $r^2$ |
|---|---|---|---|---|---|
| hCV2961253 | rs2190600 | hCV2961306 | rs264129 | 0.9 | 0.9232 |
| hCV2961253 | rs2190600 | hCV30621656 | rs10478919 | 0.9 | 0.927 |
| hCV2961253 | rs2190600 | hCV31237567 | rs11749272 | 0.9 | 0.927 |
| hCV2961253 | rs2190600 | hCV346713 | rs1990023 | 0.9 | 0.9232 |
| hCV2961253 | rs2190600 | hCV546489 | rs264122 | 0.9 | 0.9616 |
| hCV2961253 | rs2190600 | hCV8932829 | rs1116596 | 0.9 | 0.927 |
| hCV2961259 | rs11242023 | hCV11819780 | rs12153185 | 0.9 | 0.9571 |
| hCV2961259 | rs11242023 | hCV11819782 | rs12719415 | 0.9 | 0.9621 |
| hCV2961259 | rs11242023 | hCV26478744 | rs2016194 | 0.9 | 0.9587 |
| hCV2961259 | rs11242023 | hCV26478745 | rs2108426 | 0.9 | 0.9557 |
| hCV2961259 | rs11242023 | hCV26478747 | rs2190598 | 0.9 | 0.9604 |
| hCV2961259 | rs11242023 | hCV27996154 | rs4836502 | 0.9 | 0.9621 |
| hCV2961259 | rs11242023 | hCV2961244 | rs2418548 | 0.9 | 0.9571 |
| hCV2961259 | rs11242023 | hCV2961250 | rs4836507 | 0.9 | 0.9621 |
| hCV2961259 | rs11242023 | hCV2961252 | rs10067895 | 0.9 | 0.9621 |
| hCV2961259 | rs11242023 | hCV2961253 | rs2190600 | 0.9 | 0.9621 |
| hCV2961259 | rs11242023 | hCV2961260 | rs11242022 | 0.9 | 0.9785 |
| hCV2961259 | rs11242023 | hCV2961261 | rs11242021 | 0.9 | 0.9613 |
| hCV2961259 | rs11242023 | hCV2961267 | rs1476714 | 0.9 | 0.9592 |
| hCV2961259 | rs11242023 | hCV2961268 | rs2108425 | 0.9 | 0.9621 |
| hCV2961259 | rs11242023 | hCV2961269 | rs2158958 | 0.9 | 0.9621 |
| hCV2961259 | rs11242023 | hCV2961270 | rs9327555 | 0.9 | 0.9621 |
| hCV2961259 | rs11242023 | hCV2961278 | rs7446891 | 0.9 | 0.9621 |
| hCV2961259 | rs11242023 | hCV2961280 | rs10520072 | 0.9 | 0.9621 |
| hCV2961259 | rs11242023 | hCV2961282 | rs917295 | 0.9 | 0.9621 |
| hCV2961259 | rs11242023 | hCV2961284 | rs10054055 | 0.9 | 0.9573 |
| hCV2961259 | rs11242023 | hCV2961296 | rs10051148 | 0.9 | 0.9236 |
| hCV2961259 | rs11242023 | hCV2961297 | rs2158961 | 0.9 | 0.9252 |
| hCV2961259 | rs11242023 | hCV2961306 | rs264129 | 0.9 | 0.9358 |
| hCV2961259 | rs11242023 | hCV346713 | rs1990023 | 0.9 | 0.9358 |
| hCV2961259 | rs11242023 | hCV546489 | rs264122 | 0.9 | 0.9573 |
| hCV2961260 | rs11242022 | hCV11819780 | rs12153185 | 0.9 | 0.9785 |
| hCV2961260 | rs11242022 | hCV11819782 | rs12719415 | 0.9 | 1 |
| hCV2961260 | rs11242022 | hCV2575318 | rs7711358 | 0.9 | 0.9232 |
| hCV2961260 | rs11242022 | hCV2575336 | rs2418541 | 0.9 | 0.9232 |
| hCV2961260 | rs11242022 | hCV2575340 | rs11242020 | 0.9 | 0.9232 |
| hCV2961260 | rs11242022 | hCV26478744 | rs2016194 | 0.9 | 1 |
| hCV2961260 | rs11242022 | hCV26478745 | rs2108426 | 0.9 | 1 |
| hCV2961260 | rs11242022 | hCV26478747 | rs2190598 | 0.9 | 1 |
| hCV2961260 | rs11242022 | hCV26478763 | rs2418542 | 0.9 | 0.9232 |
| hCV2961260 | rs11242022 | hCV27996154 | rs4836502 | 0.9 | 1 |
| hCV2961260 | rs11242022 | hCV2961244 | rs2418548 | 0.9 | 0.9785 |
| hCV2961260 | rs11242022 | hCV2961250 | rs4836507 | 0.9 | 1 |
| hCV2961260 | rs11242022 | hCV2961252 | rs10067895 | 0.9 | 1 |
| hCV2961260 | rs11242022 | hCV2961253 | rs2190600 | 0.9 | 1 |
| hCV2961260 | rs11242022 | hCV2961259 | rs11242023 | 0.9 | 0.9785 |
| hCV2961260 | rs11242022 | hCV2961261 | rs11242021 | 0.9 | 1 |
| hCV2961260 | rs11242022 | hCV2961267 | rs1476714 | 0.9 | 1 |
| hCV2961260 | rs11242022 | hCV2961268 | rs2108425 | 0.9 | 1 |
| hCV2961260 | rs11242022 | hCV2961269 | rs2158958 | 0.9 | 1 |
| hCV2961260 | rs11242022 | hCV2961270 | rs9327555 | 0.9 | 1 |
| hCV2961260 | rs11242022 | hCV2961278 | rs7446891 | 0.9 | 1 |
| hCV2961260 | rs11242022 | hCV2961280 | rs10520072 | 0.9 | 1 |
| hCV2961260 | rs11242022 | hCV2961282 | rs917295 | 0.9 | 1 |
| hCV2961260 | rs11242022 | hCV2961284 | rs10054055 | 0.9 | 0.9783 |
| hCV2961260 | rs11242022 | hCV2961296 | rs10051148 | 0.9 | 0.9608 |
| hCV2961260 | rs11242022 | hCV2961297 | rs2158961 | 0.9 | 0.9616 |
| hCV2961260 | rs11242022 | hCV2961306 | rs264129 | 0.9 | 0.9567 |
| hCV2961260 | rs11242022 | hCV30621656 | rs10478919 | 0.9 | 0.9232 |
| hCV2961260 | rs11242022 | hCV31237567 | rs11749272 | 0.9 | 0.9232 |
| hCV2961260 | rs11242022 | hCV346713 | rs1990023 | 0.9 | 0.9567 |
| hCV2961260 | rs11242022 | hCV546489 | rs264122 | 0.9 | 0.9783 |
| hCV2961260 | rs11242022 | hCV8932829 | rs1116596 | 0.9 | 0.9232 |
| hCV2961261 | rs11242021 | hCV11819780 | rs12153185 | 0.9 | 1 |
| hCV2961261 | rs11242021 | hCV11819782 | rs12719415 | 0.9 | 1 |
| hCV2961261 | rs11242021 | hCV2575318 | rs7711358 | 0.9 | 0.9255 |
| hCV2961261 | rs11242021 | hCV2575336 | rs2418541 | 0.9 | 0.9255 |
| hCV2961261 | rs11242021 | hCV2575340 | rs11242020 | 0.9 | 0.9255 |
| hCV2961261 | rs11242021 | hCV26478744 | rs2016194 | 0.9 | 0.9198 |
| hCV2961261 | rs11242021 | hCV26478745 | rs2108426 | 0.9 | 0.9135 |
| hCV2961261 | rs11242021 | hCV26478747 | rs2190598 | 0.9 | 1 |
| hCV2961261 | rs11242021 | hCV26478763 | rs2418542 | 0.9 | 0.9255 |
| hCV2961261 | rs11242021 | hCV27996154 | rs4836502 | 0.9 | 1 |
| hCV2961261 | rs11242021 | hCV2961244 | rs2418548 | 0.9 | 1 |
| hCV2961261 | rs11242021 | hCV2961250 | rs4836507 | 0.9 | 1 |
| hCV2961261 | rs11242021 | hCV2961252 | rs10067895 | 0.9 | 1 |
| hCV2961261 | rs11242021 | hCV2961253 | rs2190600 | 0.9 | 1 |

TABLE 3-continued

| Interrogated SNP (hCV #) | Interrogated SNP (rs #) | LD SNP (hCV #) | LD SNP (rs #) | Threshold r² | r² |
|---|---|---|---|---|---|
| hCV2961261 | rs11242021 | hCV2961259 | rs11242023 | 0.9 | 0.9613 |
| hCV2961261 | rs11242021 | hCV2961260 | rs11242022 | 0.9 | 1 |
| hCV2961261 | rs11242021 | hCV2961267 | rs1476714 | 0.9 | 1 |
| hCV2961261 | rs11242021 | hCV2961268 | rs2108425 | 0.9 | 1 |
| hCV2961261 | rs11242021 | hCV2961269 | rs2158958 | 0.9 | 1 |
| hCV2961261 | rs11242021 | hCV2961270 | rs9327555 | 0.9 | 1 |
| hCV2961261 | rs11242021 | hCV2961278 | rs7446891 | 0.9 | 1 |
| hCV2961261 | rs11242021 | hCV2961280 | rs10520072 | 0.9 | 1 |
| hCV2961261 | rs11242021 | hCV2961282 | rs917295 | 0.9 | 1 |
| hCV2961261 | rs11242021 | hCV2961284 | rs10054055 | 0.9 | 0.9608 |
| hCV2961261 | rs11242021 | hCV2961296 | rs10051148 | 0.9 | 0.9615 |
| hCV2961261 | rs11242021 | hCV2961297 | rs2158961 | 0.9 | 0.9627 |
| hCV2961261 | rs11242021 | hCV2961306 | rs264129 | 0.9 | 0.9216 |
| hCV2961261 | rs11242021 | hCV30621656 | rs10478919 | 0.9 | 0.9255 |
| hCV2961261 | rs11242021 | hCV31237567 | rs11749272 | 0.9 | 0.9255 |
| hCV2961261 | rs11242021 | hCV346713 | rs1990023 | 0.9 | 0.9216 |
| hCV2961261 | rs11242021 | hCV546489 | rs264122 | 0.9 | 0.9608 |
| hCV2961261 | rs11242021 | hCV8932829 | rs1116596 | 0.9 | 0.9255 |
| hCV2961267 | rs1476714 | hCV11819780 | rs12153185 | 0.9 | 1 |
| hCV2961267 | rs1476714 | hCV11819782 | rs12719415 | 0.9 | 1 |
| hCV2961267 | rs1476714 | hCV2575318 | rs7711358 | 0.9 | 0.9607 |
| hCV2961267 | rs1476714 | hCV2575336 | rs2418541 | 0.9 | 0.9607 |
| hCV2961267 | rs1476714 | hCV2575340 | rs11242020 | 0.9 | 0.9607 |
| hCV2961267 | rs1476714 | hCV26478744 | rs2016194 | 0.9 | 0.9152 |
| hCV2961267 | rs1476714 | hCV26478745 | rs2108426 | 0.9 | 0.9081 |
| hCV2961267 | rs1476714 | hCV26478747 | rs2190598 | 0.9 | 1 |
| hCV2961267 | rs1476714 | hCV26478763 | rs2418542 | 0.9 | 0.9607 |
| hCV2961267 | rs1476714 | hCV27996154 | rs4836502 | 0.9 | 1 |
| hCV2961267 | rs1476714 | hCV2961244 | rs2418548 | 0.9 | 1 |
| hCV2961267 | rs1476714 | hCV2961250 | rs4836507 | 0.9 | 1 |
| hCV2961267 | rs1476714 | hCV2961252 | rs10067895 | 0.9 | 1 |
| hCV2961267 | rs1476714 | hCV2961253 | rs2190600 | 0.9 | 1 |
| hCV2961267 | rs1476714 | hCV2961259 | rs11242023 | 0.9 | 0.9592 |
| hCV2961267 | rs1476714 | hCV2961260 | rs11242022 | 0.9 | 1 |
| hCV2961267 | rs1476714 | hCV2961261 | rs11242021 | 0.9 | 1 |
| hCV2961267 | rs1476714 | hCV2961268 | rs2108425 | 0.9 | 1 |
| hCV2961267 | rs1476714 | hCV2961269 | rs2158958 | 0.9 | 1 |
| hCV2961267 | rs1476714 | hCV2961270 | rs9327555 | 0.9 | 1 |
| hCV2961267 | rs1476714 | hCV2961278 | rs7446891 | 0.9 | 1 |
| hCV2961267 | rs1476714 | hCV2961280 | rs10520072 | 0.9 | 1 |
| hCV2961267 | rs1476714 | hCV2961282 | rs917295 | 0.9 | 1 |
| hCV2961267 | rs1476714 | hCV2961284 | rs10054055 | 0.9 | 0.9587 |
| hCV2961267 | rs1476714 | hCV2961296 | rs10051148 | 0.9 | 0.9595 |
| hCV2961267 | rs1476714 | hCV2961297 | rs2158961 | 0.9 | 0.9607 |
| hCV2961267 | rs1476714 | hCV2961306 | rs264129 | 0.9 | 0.9172 |
| hCV2961267 | rs1476714 | hCV30621656 | rs10478919 | 0.9 | 0.9607 |
| hCV2961267 | rs1476714 | hCV31237567 | rs11749272 | 0.9 | 0.9607 |
| hCV2961267 | rs1476714 | hCV346713 | rs1990023 | 0.9 | 0.9587 |
| hCV2961267 | rs1476714 | hCV546489 | rs264122 | 0.9 | 0.9587 |
| hCV2961267 | rs1476714 | hCV8932829 | rs1116596 | 0.9 | 0.9607 |
| hCV2961268 | rs2108425 | hCV11819780 | rs12153185 | 0.9 | 1 |
| hCV2961268 | rs2108425 | hCV11819782 | rs12719415 | 0.9 | 1 |
| hCV2961268 | rs2108425 | hCV2575318 | rs7711358 | 0.9 | 0.927 |
| hCV2961268 | rs2108425 | hCV2575336 | rs2418541 | 0.9 | 0.927 |
| hCV2961268 | rs2108425 | hCV2575340 | rs11242020 | 0.9 | 0.927 |
| hCV2961268 | rs2108425 | hCV26478744 | rs2016194 | 0.9 | 0.9198 |
| hCV2961268 | rs2108425 | hCV26478745 | rs2108426 | 0.9 | 0.9135 |
| hCV2961268 | rs2108425 | hCV26478747 | rs2190598 | 0.9 | 1 |
| hCV2961268 | rs2108425 | hCV26478763 | rs2418542 | 0.9 | 0.927 |
| hCV2961268 | rs2108425 | hCV27996154 | rs4836502 | 0.9 | 1 |
| hCV2961268 | rs2108425 | hCV2961244 | rs2418548 | 0.9 | 1 |
| hCV2961268 | rs2108425 | hCV2961250 | rs4836507 | 0.9 | 1 |
| hCV2961268 | rs2108425 | hCV2961252 | rs10067895 | 0.9 | 1 |
| hCV2961268 | rs2108425 | hCV2961253 | rs2190600 | 0.9 | 1 |
| hCV2961268 | rs2108425 | hCV2961259 | rs11242023 | 0.9 | 0.9621 |
| hCV2961268 | rs2108425 | hCV2961260 | rs11242022 | 0.9 | 1 |
| hCV2961268 | rs2108425 | hCV2961261 | rs11242021 | 0.9 | 1 |
| hCV2961268 | rs2108425 | hCV2961267 | rs1476714 | 0.9 | 1 |
| hCV2961268 | rs2108425 | hCV2961269 | rs2158958 | 0.9 | 1 |
| hCV2961268 | rs2108425 | hCV2961270 | rs9327555 | 0.9 | 1 |
| hCV2961268 | rs2108425 | hCV2961278 | rs7446891 | 0.9 | 1 |
| hCV2961268 | rs2108425 | hCV2961280 | rs10520072 | 0.9 | 1 |
| hCV2961268 | rs2108425 | hCV2961282 | rs917295 | 0.9 | 1 |
| hCV2961268 | rs2108425 | hCV2961284 | rs10054055 | 0.9 | 0.9616 |
| hCV2961268 | rs2108425 | hCV2961296 | rs10051148 | 0.9 | 0.9623 |
| hCV2961268 | rs2108425 | hCV2961297 | rs2158961 | 0.9 | 0.9634 |
| hCV2961268 | rs2108425 | hCV2961306 | rs264129 | 0.9 | 0.9232 |

TABLE 3-continued

| Interrogated SNP (hCV #) | Interrogated SNP (rs #) | LD SNP (hCV #) | LD SNP (rs #) | Threshold r² | r² |
|---|---|---|---|---|---|
| hCV2961268 | rs2108425 | hCV30621656 | rs10478919 | 0.9 | 0.927 |
| hCV2961268 | rs2108425 | hCV31237567 | rs11749272 | 0.9 | 0.927 |
| hCV2961268 | rs2108425 | hCV346713 | rs1990023 | 0.9 | 0.9232 |
| hCV2961268 | rs2108425 | hCV546489 | rs264122 | 0.9 | 0.9616 |
| hCV2961268 | rs2108425 | hCV8932829 | rs1116596 | 0.9 | 0.927 |
| hCV2961269 | rs2158958 | hCV11819780 | rs12153185 | 0.9 | 1 |
| hCV2961269 | rs2158958 | hCV11819782 | rs12719415 | 0.9 | 1 |
| hCV2961269 | rs2158958 | hCV2575318 | rs7711358 | 0.9 | 0.927 |
| hCV2961269 | rs2158958 | hCV2575336 | rs2418541 | 0.9 | 0.927 |
| hCV2961269 | rs2158958 | hCV2575340 | rs11242020 | 0.9 | 0.927 |
| hCV2961269 | rs2158958 | hCV26478744 | rs2016194 | 0.9 | 0.9198 |
| hCV2961269 | rs2158958 | hCV26478745 | rs2108426 | 0.9 | 0.9135 |
| hCV2961269 | rs2158958 | hCV26478747 | rs2190598 | 0.9 | 1 |
| hCV2961269 | rs2158958 | hCV26478763 | rs2418542 | 0.9 | 0.927 |
| hCV2961269 | rs2158958 | hCV27996154 | rs4836502 | 0.9 | 1 |
| hCV2961269 | rs2158958 | hCV2961244 | rs2418548 | 0.9 | 1 |
| hCV2961269 | rs2158958 | hCV2961250 | rs4836507 | 0.9 | 1 |
| hCV2961269 | rs2158958 | hCV2961252 | rs10067895 | 0.9 | 1 |
| hCV2961269 | rs2158958 | hCV2961253 | rs2190600 | 0.9 | 1 |
| hCV2961269 | rs2158958 | hCV2961259 | rs11242023 | 0.9 | 0.9621 |
| hCV2961269 | rs2158958 | hCV2961260 | rs11242022 | 0.9 | 1 |
| hCV2961269 | rs2158958 | hCV2961261 | rs11242021 | 0.9 | 1 |
| hCV2961269 | rs2158958 | hCV2961267 | rs1476714 | 0.9 | 1 |
| hCV2961269 | rs2158958 | hCV2961268 | rs2108425 | 0.9 | 1 |
| hCV2961269 | rs2158958 | hCV2961270 | rs9327555 | 0.9 | 1 |
| hCV2961269 | rs2158958 | hCV2961278 | rs7446891 | 0.9 | 1 |
| hCV2961269 | rs2158958 | hCV2961280 | rs10520072 | 0.9 | 1 |
| hCV2961269 | rs2158958 | hCV2961282 | rs917295 | 0.9 | 1 |
| hCV2961269 | rs2158958 | hCV2961284 | rs10054055 | 0.9 | 0.9616 |
| hCV2961269 | rs2158958 | hCV2961296 | rs10051148 | 0.9 | 0.9623 |
| hCV2961269 | rs2158958 | hCV2961297 | rs2158961 | 0.9 | 0.9634 |
| hCV2961269 | rs2158958 | hCV2961306 | rs264129 | 0.9 | 0.9232 |
| hCV2961269 | rs2158958 | hCV30621656 | rs10478919 | 0.9 | 0.927 |
| hCV2961269 | rs2158958 | hCV31237567 | rs11749272 | 0.9 | 0.927 |
| hCV2961269 | rs2158958 | hCV346713 | rs1990023 | 0.9 | 0.9232 |
| hCV2961269 | rs2158958 | hCV546489 | rs264122 | 0.9 | 0.9616 |
| hCV2961269 | rs2158958 | hCV8932829 | rs1116596 | 0.9 | 0.927 |
| hCV2961270 | rs9327555 | hCV11819780 | rs12153185 | 0.9 | 1 |
| hCV2961270 | rs9327555 | hCV11819782 | rs12719415 | 0.9 | 1 |
| hCV2961270 | rs9327555 | hCV2575318 | rs7711358 | 0.9 | 0.927 |
| hCV2961270 | rs9327555 | hCV2575336 | rs2418541 | 0.9 | 0.927 |
| hCV2961270 | rs9327555 | hCV2575340 | rs11242020 | 0.9 | 0.927 |
| hCV2961270 | rs9327555 | hCV26478744 | rs2016194 | 0.9 | 0.9198 |
| hCV2961270 | rs9327555 | hCV26478745 | rs2108426 | 0.9 | 0.9135 |
| hCV2961270 | rs9327555 | hCV26478747 | rs2190598 | 0.9 | 1 |
| hCV2961270 | rs9327555 | hCV26478763 | rs2418542 | 0.9 | 0.927 |
| hCV2961270 | rs9327555 | hCV27996154 | rs4836502 | 0.9 | 1 |
| hCV2961270 | rs9327555 | hCV2961244 | rs2418548 | 0.9 | 1 |
| hCV2961270 | rs9327555 | hCV2961250 | rs4836507 | 0.9 | 1 |
| hCV2961270 | rs9327555 | hCV2961252 | rs10067895 | 0.9 | 1 |
| hCV2961270 | rs9327555 | hCV2961253 | rs2190600 | 0.9 | 1 |
| hCV2961270 | rs9327555 | hCV2961259 | rs11242023 | 0.9 | 0.9621 |
| hCV2961270 | rs9327555 | hCV2961260 | rs11242022 | 0.9 | 1 |
| hCV2961270 | rs9327555 | hCV2961261 | rs11242021 | 0.9 | 1 |
| hCV2961270 | rs9327555 | hCV2961267 | rs1476714 | 0.9 | 1 |
| hCV2961270 | rs9327555 | hCV2961268 | rs2108425 | 0.9 | 1 |
| hCV2961270 | rs9327555 | hCV2961269 | rs2158958 | 0.9 | 1 |
| hCV2961270 | rs9327555 | hCV2961278 | rs7446891 | 0.9 | 1 |
| hCV2961270 | rs9327555 | hCV2961280 | rs10520072 | 0.9 | 1 |
| hCV2961270 | rs9327555 | hCV2961282 | rs917295 | 0.9 | 1 |
| hCV2961270 | rs9327555 | hCV2961284 | rs10054055 | 0.9 | 0.9616 |
| hCV2961270 | rs9327555 | hCV2961296 | rs10051148 | 0.9 | 0.9623 |
| hCV2961270 | rs9327555 | hCV2961297 | rs2158961 | 0.9 | 0.9634 |
| hCV2961270 | rs9327555 | hCV2961306 | rs264129 | 0.9 | 0.9232 |
| hCV2961270 | rs9327555 | hCV30621656 | rs10478919 | 0.9 | 0.927 |
| hCV2961270 | rs9327555 | hCV31237567 | rs11749272 | 0.9 | 0.927 |
| hCV2961270 | rs9327555 | hCV346713 | rs1990023 | 0.9 | 0.9232 |
| hCV2961270 | rs9327555 | hCV546489 | rs264122 | 0.9 | 0.9616 |
| hCV2961270 | rs9327555 | hCV8932829 | rs1116596 | 0.9 | 0.927 |
| hCV2961278 | rs7446891 | hCV11819780 | rs12153185 | 0.9 | 1 |
| hCV2961278 | rs7446891 | hCV11819782 | rs12719415 | 0.9 | 1 |
| hCV2961278 | rs7446891 | hCV2575318 | rs7711358 | 0.9 | 0.927 |
| hCV2961278 | rs7446891 | hCV2575336 | rs2418541 | 0.9 | 0.927 |
| hCV2961278 | rs7446891 | hCV2575340 | rs11242020 | 0.9 | 0.927 |
| hCV2961278 | rs7446891 | hCV26478744 | rs2016194 | 0.9 | 0.9198 |
| hCV2961278 | rs7446891 | hCV26478745 | rs2108426 | 0.9 | 0.9135 |
| hCV2961278 | rs7446891 | hCV26478747 | rs2190598 | 0.9 | 1 |

TABLE 3-continued

| Interrogated SNP (hCV #) | Interrogated SNP (rs #) | LD SNP (hCV #) | LD SNP (rs #) | Threshold $r^2$ | $r^2$ |
|---|---|---|---|---|---|
| hCV2961278 | rs7446891 | hCV26478763 | rs2418542 | 0.9 | 0.927 |
| hCV2961278 | rs7446891 | hCV27996154 | rs4836502 | 0.9 | 1 |
| hCV2961278 | rs7446891 | hCV2961244 | rs2418548 | 0.9 | 1 |
| hCV2961278 | rs7446891 | hCV2961250 | rs4836507 | 0.9 | 1 |
| hCV2961278 | rs7446891 | hCV2961252 | rs10067895 | 0.9 | 1 |
| hCV2961278 | rs7446891 | hCV2961253 | rs2190600 | 0.9 | 1 |
| hCV2961278 | rs7446891 | hCV2961259 | rs11242023 | 0.9 | 0.9621 |
| hCV2961278 | rs7446891 | hCV2961260 | rs11242022 | 0.9 | 1 |
| hCV2961278 | rs7446891 | hCV2961261 | rs11242021 | 0.9 | 1 |
| hCV2961278 | rs7446891 | hCV2961267 | rs1476714 | 0.9 | 1 |
| hCV2961278 | rs7446891 | hCV2961268 | rs2108425 | 0.9 | 1 |
| hCV2961278 | rs7446891 | hCV2961269 | rs2158958 | 0.9 | 1 |
| hCV2961278 | rs7446891 | hCV2961270 | rs9327555 | 0.9 | 1 |
| hCV2961278 | rs7446891 | hCV2961280 | rs10520072 | 0.9 | 1 |
| hCV2961278 | rs7446891 | hCV2961282 | rs917295 | 0.9 | 1 |
| hCV2961278 | rs7446891 | hCV2961284 | rs10054055 | 0.9 | 0.9616 |
| hCV2961278 | rs7446891 | hCV2961296 | rs10051148 | 0.9 | 0.9623 |
| hCV2961278 | rs7446891 | hCV2961297 | rs2158961 | 0.9 | 0.9634 |
| hCV2961278 | rs7446891 | hCV2961306 | rs264129 | 0.9 | 0.9232 |
| hCV2961278 | rs7446891 | hCV30621656 | rs10478919 | 0.9 | 0.927 |
| hCV2961278 | rs7446891 | hCV31237567 | rs11749272 | 0.9 | 0.927 |
| hCV2961278 | rs7446891 | hCV346713 | rs1990023 | 0.9 | 0.9232 |
| hCV2961278 | rs7446891 | hCV546489 | rs264122 | 0.9 | 0.9616 |
| hCV2961278 | rs7446891 | hCV8932829 | rs1116596 | 0.9 | 0.927 |
| hCV2961280 | rs10520072 | hCV11819780 | rs12153185 | 0.9 | 1 |
| hCV2961280 | rs10520072 | hCV11819782 | rs12719415 | 0.9 | 1 |
| hCV2961280 | rs10520072 | hCV2575318 | rs7711358 | 0.9 | 0.927 |
| hCV2961280 | rs10520072 | hCV2575336 | rs2418541 | 0.9 | 0.927 |
| hCV2961280 | rs10520072 | hCV2575340 | rs11242020 | 0.9 | 0.927 |
| hCV2961280 | rs10520072 | hCV26478744 | rs2016194 | 0.9 | 0.9198 |
| hCV2961280 | rs10520072 | hCV26478745 | rs2108426 | 0.9 | 0.9135 |
| hCV2961280 | rs10520072 | hCV26478747 | rs2190598 | 0.9 | 1 |
| hCV2961280 | rs10520072 | hCV26478763 | rs2418542 | 0.9 | 0.927 |
| hCV2961280 | rs10520072 | hCV27996154 | rs4836502 | 0.9 | 1 |
| hCV2961280 | rs10520072 | hCV2961244 | rs2418548 | 0.9 | 1 |
| hCV2961280 | rs10520072 | hCV2961250 | rs4836507 | 0.9 | 1 |
| hCV2961280 | rs10520072 | hCV2961252 | rs10067895 | 0.9 | 1 |
| hCV2961280 | rs10520072 | hCV2961253 | rs2190600 | 0.9 | 1 |
| hCV2961280 | rs10520072 | hCV2961259 | rs11242023 | 0.9 | 0.9621 |
| hCV2961280 | rs10520072 | hCV2961260 | rs11242022 | 0.9 | 1 |
| hCV2961280 | rs10520072 | hCV2961261 | rs11242021 | 0.9 | 1 |
| hCV2961280 | rs10520072 | hCV2961267 | rs1476714 | 0.9 | 1 |
| hCV2961280 | rs10520072 | hCV2961268 | rs2108425 | 0.9 | 1 |
| hCV2961280 | rs10520072 | hCV2961269 | rs2158958 | 0.9 | 1 |
| hCV2961280 | rs10520072 | hCV2961270 | rs9327555 | 0.9 | 1 |
| hCV2961280 | rs10520072 | hCV2961278 | rs7446891 | 0.9 | 1 |
| hCV2961280 | rs10520072 | hCV2961282 | rs917295 | 0.9 | 1 |
| hCV2961280 | rs10520072 | hCV2961284 | rs10054055 | 0.9 | 0.9616 |
| hCV2961280 | rs10520072 | hCV2961296 | rs10051148 | 0.9 | 0.9623 |
| hCV2961280 | rs10520072 | hCV2961297 | rs2158961 | 0.9 | 0.9634 |
| hCV2961280 | rs10520072 | hCV2961306 | rs264129 | 0.9 | 0.9232 |
| hCV2961280 | rs10520072 | hCV30621656 | rs10478919 | 0.9 | 0.927 |
| hCV2961280 | rs10520072 | hCV31237567 | rs11749272 | 0.9 | 0.927 |
| hCV2961280 | rs10520072 | hCV346713 | rs1990023 | 0.9 | 0.9232 |
| hCV2961280 | rs10520072 | hCV546489 | rs264122 | 0.9 | 0.9616 |
| hCV2961280 | rs10520072 | hCV8932829 | rs1116596 | 0.9 | 0.927 |
| hCV2961282 | rs917295 | hCV11819780 | rs12153185 | 0.9 | 1 |
| hCV2961282 | rs917295 | hCV11819782 | rs12719415 | 0.9 | 1 |
| hCV2961282 | rs917295 | hCV2575318 | rs7711358 | 0.9 | 0.927 |
| hCV2961282 | rs917295 | hCV2575336 | rs2418541 | 0.9 | 0.927 |
| hCV2961282 | rs917295 | hCV2575340 | rs11242020 | 0.9 | 0.927 |
| hCV2961282 | rs917295 | hCV26478744 | rs2016194 | 0.9 | 0.9197 |
| hCV2961282 | rs917295 | hCV26478745 | rs2108426 | 0.9 | 0.9134 |
| hCV2961282 | rs917295 | hCV26478747 | rs2190598 | 0.9 | 1 |
| hCV2961282 | rs917295 | hCV26478763 | rs2418542 | 0.9 | 0.927 |
| hCV2961282 | rs917295 | hCV27996154 | rs4836502 | 0.9 | 1 |
| hCV2961282 | rs917295 | hCV2961244 | rs2418548 | 0.9 | 1 |
| hCV2961282 | rs917295 | hCV2961250 | rs4836507 | 0.9 | 1 |
| hCV2961282 | rs917295 | hCV2961252 | rs10067895 | 0.9 | 1 |
| hCV2961282 | rs917295 | hCV2961253 | rs2190600 | 0.9 | 1 |
| hCV2961282 | rs917295 | hCV2961259 | rs11242023 | 0.9 | 0.9621 |
| hCV2961282 | rs917295 | hCV2961260 | rs11242022 | 0.9 | 1 |
| hCV2961282 | rs917295 | hCV2961261 | rs11242021 | 0.9 | 1 |
| hCV2961282 | rs917295 | hCV2961267 | rs1476714 | 0.9 | 1 |
| hCV2961282 | rs917295 | hCV2961268 | rs2108425 | 0.9 | 1 |
| hCV2961282 | rs917295 | hCV2961269 | rs2158958 | 0.9 | 1 |
| hCV2961282 | rs917295 | hCV2961270 | rs9327555 | 0.9 | 1 |

TABLE 3-continued

| Interrogated SNP (hCV #) | Interrogated SNP (rs #) | LD SNP (hCV #) | LD SNP (rs #) | Threshold $r^2$ | $r^2$ |
|---|---|---|---|---|---|
| hCV2961282 | rs917295 | hCV2961278 | rs7446891 | 0.9 | 1 |
| hCV2961282 | rs917295 | hCV2961280 | rs10520072 | 0.9 | 1 |
| hCV2961282 | rs917295 | hCV2961284 | rs10054055 | 0.9 | 0.9616 |
| hCV2961282 | rs917295 | hCV2961296 | rs10051148 | 0.9 | 0.9623 |
| hCV2961282 | rs917295 | hCV2961297 | rs2158961 | 0.9 | 0.9634 |
| hCV2961282 | rs917295 | hCV2961306 | rs264129 | 0.9 | 0.9232 |
| hCV2961282 | rs917295 | hCV30621656 | rs10478919 | 0.9 | 0.927 |
| hCV2961282 | rs917295 | hCV31237567 | rs11749272 | 0.9 | 0.927 |
| hCV2961282 | rs917295 | hCV346713 | rs1990023 | 0.9 | 0.9232 |
| hCV2961282 | rs917295 | hCV546489 | rs264122 | 0.9 | 0.9616 |
| hCV2961282 | rs917295 | hCV8932829 | rs1116596 | 0.9 | 0.927 |
| hCV2961284 | rs10054055 | hCV11819780 | rs12153185 | 0.9 | 0.9573 |
| hCV2961284 | rs10054055 | hCV11819782 | rs12719415 | 0.9 | 0.9616 |
| hCV2961284 | rs10054055 | hCV2575318 | rs7711358 | 0.9 | 0.9616 |
| hCV2961284 | rs10054055 | hCV2575336 | rs2418541 | 0.9 | 0.9616 |
| hCV2961284 | rs10054055 | hCV2575340 | rs11242020 | 0.9 | 0.9616 |
| hCV2961284 | rs10054055 | hCV26478744 | rs2016194 | 0.9 | 0.9581 |
| hCV2961284 | rs10054055 | hCV26478745 | rs2108426 | 0.9 | 1 |
| hCV2961284 | rs10054055 | hCV26478747 | rs2190598 | 0.9 | 0.96 |
| hCV2961284 | rs10054055 | hCV26478763 | rs2418542 | 0.9 | 0.9616 |
| hCV2961284 | rs10054055 | hCV27996154 | rs4836502 | 0.9 | 0.9616 |
| hCV2961284 | rs10054055 | hCV2961244 | rs2418548 | 0.9 | 0.9573 |
| hCV2961284 | rs10054055 | hCV2961250 | rs4836507 | 0.9 | 0.9616 |
| hCV2961284 | rs10054055 | hCV2961252 | rs10067895 | 0.9 | 0.9616 |
| hCV2961284 | rs10054055 | hCV2961253 | rs2190600 | 0.9 | 0.9616 |
| hCV2961284 | rs10054055 | hCV2961259 | rs11242023 | 0.9 | 0.9573 |
| hCV2961284 | rs10054055 | hCV2961260 | rs11242022 | 0.9 | 0.9783 |
| hCV2961284 | rs10054055 | hCV2961261 | rs11242021 | 0.9 | 0.9608 |
| hCV2961284 | rs10054055 | hCV2961267 | rs1476714 | 0.9 | 0.9587 |
| hCV2961284 | rs10054055 | hCV2961268 | rs2108425 | 0.9 | 0.9616 |
| hCV2961284 | rs10054055 | hCV2961269 | rs2158958 | 0.9 | 0.9616 |
| hCV2961284 | rs10054055 | hCV2961270 | rs9327555 | 0.9 | 0.9616 |
| hCV2961284 | rs10054055 | hCV2961278 | rs7446891 | 0.9 | 0.9616 |
| hCV2961284 | rs10054055 | hCV2961280 | rs10520072 | 0.9 | 0.9616 |
| hCV2961284 | rs10054055 | hCV2961282 | rs917295 | 0.9 | 0.9616 |
| hCV2961284 | rs10054055 | hCV2961296 | rs10051148 | 0.9 | 1 |
| hCV2961284 | rs10054055 | hCV2961297 | rs2158961 | 0.9 | 1 |
| hCV2961284 | rs10054055 | hCV2961306 | rs264129 | 0.9 | 0.9783 |
| hCV2961284 | rs10054055 | hCV29666186 | rs6871041 | 0.9 | 0.9189 |
| hCV2961284 | rs10054055 | hCV30621656 | rs10478919 | 0.9 | 0.9616 |
| hCV2961284 | rs10054055 | hCV31237567 | rs11749272 | 0.9 | 0.9616 |
| hCV2961284 | rs10054055 | hCV346713 | rs1990023 | 0.9 | 0.9783 |
| hCV2961284 | rs10054055 | hCV546489 | rs264122 | 0.9 | 1 |
| hCV2961284 | rs10054055 | hCV8932829 | rs1116596 | 0.9 | 0.9616 |
| hCV2961296 | rs10051148 | hCV11819780 | rs12153185 | 0.9 | 0.9608 |
| hCV2961296 | rs10051148 | hCV11819782 | rs12719415 | 0.9 | 0.9623 |
| hCV2961296 | rs10051148 | hCV2575318 | rs7711358 | 0.9 | 0.9623 |
| hCV2961296 | rs10051148 | hCV2575336 | rs2418541 | 0.9 | 0.9623 |
| hCV2961296 | rs10051148 | hCV2575340 | rs11242020 | 0.9 | 0.9623 |
| hCV2961296 | rs10051148 | hCV26478744 | rs2016194 | 0.9 | 0.9589 |
| hCV2961296 | rs10051148 | hCV26478745 | rs2108426 | 0.9 | 1 |
| hCV2961296 | rs10051148 | hCV26478747 | rs2190598 | 0.9 | 0.9615 |
| hCV2961296 | rs10051148 | hCV26478763 | rs2418542 | 0.9 | 0.9623 |
| hCV2961296 | rs10051148 | hCV27996154 | rs4836502 | 0.9 | 0.9623 |
| hCV2961296 | rs10051148 | hCV2961244 | rs2418548 | 0.9 | 0.9608 |
| hCV2961296 | rs10051148 | hCV2961250 | rs4836507 | 0.9 | 0.9623 |
| hCV2961296 | rs10051148 | hCV2961252 | rs10067895 | 0.9 | 0.9623 |
| hCV2961296 | rs10051148 | hCV2961253 | rs2190600 | 0.9 | 0.9623 |
| hCV2961296 | rs10051148 | hCV2961259 | rs11242023 | 0.9 | 0.9236 |
| hCV2961296 | rs10051148 | hCV2961260 | rs11242022 | 0.9 | 0.9608 |
| hCV2961296 | rs10051148 | hCV2961261 | rs11242021 | 0.9 | 0.9615 |
| hCV2961296 | rs10051148 | hCV2961267 | rs1476714 | 0.9 | 0.9595 |
| hCV2961296 | rs10051148 | hCV2961268 | rs2108425 | 0.9 | 0.9623 |
| hCV2961296 | rs10051148 | hCV2961269 | rs2158958 | 0.9 | 0.9623 |
| hCV2961296 | rs10051148 | hCV2961270 | rs9327555 | 0.9 | 0.9623 |
| hCV2961296 | rs10051148 | hCV2961278 | rs7446891 | 0.9 | 0.9623 |
| hCV2961296 | rs10051148 | hCV2961280 | rs10520072 | 0.9 | 0.9623 |
| hCV2961296 | rs10051148 | hCV2961282 | rs917295 | 0.9 | 0.9623 |
| hCV2961296 | rs10051148 | hCV2961284 | rs10054055 | 0.9 | 1 |
| hCV2961296 | rs10051148 | hCV2961297 | rs2158961 | 0.9 | 1 |
| hCV2961296 | rs10051148 | hCV2961306 | rs264129 | 0.9 | 0.9608 |
| hCV2961296 | rs10051148 | hCV29666186 | rs6871041 | 0.9 | 0.9202 |
| hCV2961296 | rs10051148 | hCV30621656 | rs10478919 | 0.9 | 0.9623 |
| hCV2961296 | rs10051148 | hCV31237567 | rs11749272 | 0.9 | 0.9623 |
| hCV2961296 | rs10051148 | hCV346713 | rs1990023 | 0.9 | 0.9608 |
| hCV2961296 | rs10051148 | hCV546489 | rs264122 | 0.9 | 1 |
| hCV2961296 | rs10051148 | hCV8932829 | rs1116596 | 0.9 | 0.9623 |

TABLE 3-continued

| Interrogated SNP (hCV #) | Interrogated SNP (rs #) | LD SNP (hCV #) | LD SNP (rs #) | Threshold r² | r² |
|---|---|---|---|---|---|
| hCV2961297 | rs2158961 | hCV11819780 | rs12153185 | 0.9 | 0.9616 |
| hCV2961297 | rs2158961 | hCV11819782 | rs12719415 | 0.9 | 0.9634 |
| hCV2961297 | rs2158961 | hCV2575318 | rs7711358 | 0.9 | 0.9634 |
| hCV2961297 | rs2158961 | hCV2575336 | rs2418541 | 0.9 | 0.9634 |
| hCV2961297 | rs2158961 | hCV2575340 | rs11242020 | 0.9 | 0.9634 |
| hCV2961297 | rs2158961 | hCV26478745 | rs2108426 | 0.9 | 0.9135 |
| hCV2961297 | rs2158961 | hCV26478747 | rs2190598 | 0.9 | 0.9619 |
| hCV2961297 | rs2158961 | hCV26478763 | rs2418542 | 0.9 | 0.9634 |
| hCV2961297 | rs2158961 | hCV27996154 | rs4836502 | 0.9 | 0.9634 |
| hCV2961297 | rs2158961 | hCV2961244 | rs2418548 | 0.9 | 0.9616 |
| hCV2961297 | rs2158961 | hCV2961250 | rs4836507 | 0.9 | 0.9634 |
| hCV2961297 | rs2158961 | hCV2961252 | rs10067895 | 0.9 | 0.9634 |
| hCV2961297 | rs2158961 | hCV2961253 | rs2190600 | 0.9 | 0.9634 |
| hCV2961297 | rs2158961 | hCV2961259 | rs11242023 | 0.9 | 0.9252 |
| hCV2961297 | rs2158961 | hCV2961260 | rs11242022 | 0.9 | 0.9616 |
| hCV2961297 | rs2158961 | hCV2961261 | rs11242021 | 0.9 | 0.9627 |
| hCV2961297 | rs2158961 | hCV2961267 | rs1476714 | 0.9 | 0.9607 |
| hCV2961297 | rs2158961 | hCV2961268 | rs2108425 | 0.9 | 0.9634 |
| hCV2961297 | rs2158961 | hCV2961269 | rs2158958 | 0.9 | 0.9634 |
| hCV2961297 | rs2158961 | hCV2961270 | rs9327555 | 0.9 | 0.9634 |
| hCV2961297 | rs2158961 | hCV2961278 | rs7446891 | 0.9 | 0.9634 |
| hCV2961297 | rs2158961 | hCV2961280 | rs10520072 | 0.9 | 0.9634 |
| hCV2961297 | rs2158961 | hCV2961282 | rs917295 | 0.9 | 0.9634 |
| hCV2961297 | rs2158961 | hCV2961284 | rs10054055 | 0.9 | 1 |
| hCV2961297 | rs2158961 | hCV2961296 | rs10051148 | 0.9 | 1 |
| hCV2961297 | rs2158961 | hCV2961306 | rs264129 | 0.9 | 0.9616 |
| hCV2961297 | rs2158961 | hCV29666186 | rs6871041 | 0.9 | 0.9226 |
| hCV2961297 | rs2158961 | hCV30621656 | rs10478919 | 0.9 | 0.9634 |
| hCV2961297 | rs2158961 | hCV31237567 | rs11749272 | 0.9 | 0.9634 |
| hCV2961297 | rs2158961 | hCV346713 | rs1990023 | 0.9 | 0.9616 |
| hCV2961297 | rs2158961 | hCV546489 | rs264122 | 0.9 | 1 |
| hCV2961297 | rs2158961 | hCV8932829 | rs1116596 | 0.9 | 0.9634 |
| hCV2961306 | rs264129 | hCV11819780 | rs12153185 | 0.9 | 0.9358 |
| hCV2961306 | rs264129 | hCV11819782 | rs12719415 | 0.9 | 0.9232 |
| hCV2961306 | rs264129 | hCV2575318 | rs7711358 | 0.9 | 0.9232 |
| hCV2961306 | rs264129 | hCV2575336 | rs2418541 | 0.9 | 0.9232 |
| hCV2961306 | rs264129 | hCV2575340 | rs11242020 | 0.9 | 0.9232 |
| hCV2961306 | rs264129 | hCV26478744 | rs2016194 | 0.9 | 0.9162 |
| hCV2961306 | rs264129 | hCV26478745 | rs2108426 | 0.9 | 0.9557 |
| hCV2961306 | rs264129 | hCV26478747 | rs2190598 | 0.9 | 0.9198 |
| hCV2961306 | rs264129 | hCV26478763 | rs2418542 | 0.9 | 0.9232 |
| hCV2961306 | rs264129 | hCV27996154 | rs4836502 | 0.9 | 0.9232 |
| hCV2961306 | rs264129 | hCV2961244 | rs2418548 | 0.9 | 0.9358 |
| hCV2961306 | rs264129 | hCV2961250 | rs4836507 | 0.9 | 0.9232 |
| hCV2961306 | rs264129 | hCV2961252 | rs10067895 | 0.9 | 0.9232 |
| hCV2961306 | rs264129 | hCV2961253 | rs2190600 | 0.9 | 0.9232 |
| hCV2961306 | rs264129 | hCV2961259 | rs11242023 | 0.9 | 0.9358 |
| hCV2961306 | rs264129 | hCV2961260 | rs11242022 | 0.9 | 0.9567 |
| hCV2961306 | rs264129 | hCV2961261 | rs11242021 | 0.9 | 0.9216 |
| hCV2961306 | rs264129 | hCV2961267 | rs1476714 | 0.9 | 0.9172 |
| hCV2961306 | rs264129 | hCV2961268 | rs2108425 | 0.9 | 0.9232 |
| hCV2961306 | rs264129 | hCV2961269 | rs2158958 | 0.9 | 0.9232 |
| hCV2961306 | rs264129 | hCV2961270 | rs9327555 | 0.9 | 0.9232 |
| hCV2961306 | rs264129 | hCV2961278 | rs7446891 | 0.9 | 0.9232 |
| hCV2961306 | rs264129 | hCV2961280 | rs10520072 | 0.9 | 0.9232 |
| hCV2961306 | rs264129 | hCV2961282 | rs917295 | 0.9 | 0.9232 |
| hCV2961306 | rs264129 | hCV2961284 | rs10054055 | 0.9 | 0.9783 |
| hCV2961306 | rs264129 | hCV2961296 | rs10051148 | 0.9 | 0.9608 |
| hCV2961306 | rs264129 | hCV2961297 | rs2158961 | 0.9 | 0.9616 |
| hCV2961306 | rs264129 | hCV30621656 | rs10478919 | 0.9 | 0.9232 |
| hCV2961306 | rs264129 | hCV31237567 | rs11749272 | 0.9 | 0.9232 |
| hCV2961306 | rs264129 | hCV346713 | rs1990023 | 0.9 | 0.9567 |
| hCV2961306 | rs264129 | hCV546489 | rs264122 | 0.9 | 0.9783 |
| hCV2961306 | rs264129 | hCV8932829 | rs1116596 | 0.9 | 0.9232 |
| hCV29666186 | rs6871041 | hCV2961284 | rs10054055 | 0.9 | 0.9189 |
| hCV29666186 | rs6871041 | hCV2961296 | rs10051148 | 0.9 | 0.9202 |
| hCV29666186 | rs6871041 | hCV2961297 | rs2158961 | 0.9 | 0.9226 |
| hCV29666186 | rs6871041 | hCV546489 | rs264122 | 0.9 | 0.9189 |
| hCV29840965 | rs6040644 | hCV2529198 | rs742827 | 0.9 | 0.9596 |
| hCV29840965 | rs6040644 | hCV2529202 | rs6040667 | 0.9 | 1 |
| hCV29840965 | rs6040644 | hCV2529211 | rs17189710 | 0.9 | 1 |
| hCV29840965 | rs6040644 | hCV2529224 | rs2327412 | 0.9 | 1 |
| hCV29840965 | rs6040644 | hCV2529230 | rs4444612 | 0.9 | 1 |
| hCV29840965 | rs6040644 | hCV2529231 | rs4315598 | 0.9 | 1 |
| hCV29840965 | rs6040644 | hCV2529239 | rs6040638 | 0.9 | 1 |
| hCV29840965 | rs6040644 | hCV2529241 | rs6134243 | 0.9 | 1 |
| hCV29840965 | rs6040644 | hCV2529246 | rs6040619 | 0.9 | 1 |

TABLE 3-continued

| Interrogated SNP (hCV #) | Interrogated SNP (rs #) | LD SNP (hCV #) | LD SNP (rs #) | Threshold $r^2$ | $r^2$ |
|---|---|---|---|---|---|
| hCV29840965 | rs6040644 | hCV27367681 | rs2876227 | 0.9 | 0.9616 |
| hCV29840965 | rs6040644 | hCV27367708 | rs1009748 | 0.9 | 1 |
| hCV29840965 | rs6040644 | hCV30057061 | rs6033138 | 0.9 | 1 |
| hCV29840965 | rs6040644 | hCV30093270 | rs6040625 | 0.9 | 1 |
| hCV29840965 | rs6040644 | hCV30129243 | rs6040636 | 0.9 | 1 |
| hCV29840965 | rs6040644 | hCV30218977 | rs6040633 | 0.9 | 1 |
| hCV29840965 | rs6040644 | hCV30417550 | rs6040634 | 0.9 | 1 |
| hCV29840965 | rs6040644 | hCV30453433 | rs6131208 | 0.9 | 0.9565 |
| hCV29840965 | rs6040644 | hCV30615489 | rs6040630 | 0.9 | 0.9225 |
| hCV29840965 | rs6040644 | hCV32274419 | rs13038146 | 0.9 | 1 |
| hCV29840965 | rs6040644 | hCV330228 | rs6040668 | 0.9 | 1 |
| hCV29997278 | rs9906737 | hCV11625525 | rs7222186 | 0.9 | 1 |
| hCV29997278 | rs9906737 | hCV1558080 | rs9914580 | 0.9 | 1 |
| hCV29997278 | rs9906737 | hCV1558085 | rs11656608 | 0.9 | 1 |
| hCV29997278 | rs9906737 | hCV29293441 | rs8066502 | 0.9 | 1 |
| hCV29997278 | rs9906737 | hCV29979212 | rs8068714 | 0.9 | 1 |
| hCV30057061 | rs6033138 | hCV2529198 | rs742827 | 0.9 | 0.9624 |
| hCV30057061 | rs6033138 | hCV2529202 | rs6040667 | 0.9 | 1 |
| hCV30057061 | rs6033138 | hCV2529211 | rs17189710 | 0.9 | 1 |
| hCV30057061 | rs6033138 | hCV2529224 | rs2327412 | 0.9 | 1 |
| hCV30057061 | rs6033138 | hCV2529230 | rs4444612 | 0.9 | 1 |
| hCV30057061 | rs6033138 | hCV2529231 | rs4315598 | 0.9 | 1 |
| hCV30057061 | rs6033138 | hCV2529239 | rs6040638 | 0.9 | 1 |
| hCV30057061 | rs6033138 | hCV2529241 | rs6134243 | 0.9 | 1 |
| hCV30057061 | rs6033138 | hCV2529246 | rs6040619 | 0.9 | 1 |
| hCV30057061 | rs6033138 | hCV27367681 | rs2876227 | 0.9 | 0.9649 |
| hCV30057061 | rs6033138 | hCV27367708 | rs1009748 | 0.9 | 1 |
| hCV30057061 | rs6033138 | hCV29840965 | rs6040644 | 0.9 | 1 |
| hCV30057061 | rs6033138 | hCV30093270 | rs6040625 | 0.9 | 1 |
| hCV30057061 | rs6033138 | hCV30129243 | rs6040636 | 0.9 | 1 |
| hCV30057061 | rs6033138 | hCV30218977 | rs6040633 | 0.9 | 1 |
| hCV30057061 | rs6033138 | hCV30417550 | rs6040634 | 0.9 | 1 |
| hCV30057061 | rs6033138 | hCV30453433 | rs6131208 | 0.9 | 0.9585 |
| hCV30057061 | rs6033138 | hCV30615489 | rs6040630 | 0.9 | 0.9294 |
| hCV30057061 | rs6033138 | hCV32274419 | rs13038146 | 0.9 | 1 |
| hCV30057061 | rs6033138 | hCV330228 | rs6040668 | 0.9 | 1 |
| hCV30093270 | rs6040625 | hCV2529198 | rs742827 | 0.9 | 0.9624 |
| hCV30093270 | rs6040625 | hCV2529202 | rs6040667 | 0.9 | 1 |
| hCV30093270 | rs6040625 | hCV2529211 | rs17189710 | 0.9 | 1 |
| hCV30093270 | rs6040625 | hCV2529224 | rs2327412 | 0.9 | 1 |
| hCV30093270 | rs6040625 | hCV2529230 | rs4444612 | 0.9 | 1 |
| hCV30093270 | rs6040625 | hCV2529231 | rs4315598 | 0.9 | 1 |
| hCV30093270 | rs6040625 | hCV2529239 | rs6040638 | 0.9 | 1 |
| hCV30093270 | rs6040625 | hCV2529241 | rs6134243 | 0.9 | 1 |
| hCV30093270 | rs6040625 | hCV2529246 | rs6040619 | 0.9 | 1 |
| hCV30093270 | rs6040625 | hCV27367681 | rs2876227 | 0.9 | 0.9649 |
| hCV30093270 | rs6040625 | hCV27367708 | rs1009748 | 0.9 | 1 |
| hCV30093270 | rs6040625 | hCV29840965 | rs6040644 | 0.9 | 1 |
| hCV30093270 | rs6040625 | hCV30057061 | rs6033138 | 0.9 | 1 |
| hCV30093270 | rs6040625 | hCV30129243 | rs6040636 | 0.9 | 1 |
| hCV30093270 | rs6040625 | hCV30218977 | rs6040633 | 0.9 | 1 |
| hCV30093270 | rs6040625 | hCV30417550 | rs6040634 | 0.9 | 1 |
| hCV30093270 | rs6040625 | hCV30453433 | rs6131208 | 0.9 | 0.9585 |
| hCV30093270 | rs6040625 | hCV30615489 | rs6040630 | 0.9 | 0.9294 |
| hCV30093270 | rs6040625 | hCV32274419 | rs13038146 | 0.9 | 1 |
| hCV30093270 | rs6040625 | hCV330228 | rs6040668 | 0.9 | 1 |
| hCV30129243 | rs6040636 | hCV2529198 | rs742827 | 0.9 | 0.9624 |
| hCV30129243 | rs6040636 | hCV2529202 | rs6040667 | 0.9 | 1 |
| hCV30129243 | rs6040636 | hCV2529211 | rs17189710 | 0.9 | 1 |
| hCV30129243 | rs6040636 | hCV2529224 | rs2327412 | 0.9 | 1 |
| hCV30129243 | rs6040636 | hCV2529230 | rs4444612 | 0.9 | 1 |
| hCV30129243 | rs6040636 | hCV2529231 | rs4315598 | 0.9 | 1 |
| hCV30129243 | rs6040636 | hCV2529239 | rs6040638 | 0.9 | 1 |
| hCV30129243 | rs6040636 | hCV2529241 | rs6134243 | 0.9 | 1 |
| hCV30129243 | rs6040636 | hCV2529246 | rs6040619 | 0.9 | 1 |
| hCV30129243 | rs6040636 | hCV27367681 | rs2876227 | 0.9 | 0.9649 |
| hCV30129243 | rs6040636 | hCV27367708 | rs1009748 | 0.9 | 1 |
| hCV30129243 | rs6040636 | hCV29840965 | rs6040644 | 0.9 | 1 |
| hCV30129243 | rs6040636 | hCV30057061 | rs6033138 | 0.9 | 1 |
| hCV30129243 | rs6040636 | hCV30093270 | rs6040625 | 0.9 | 1 |
| hCV30129243 | rs6040636 | hCV30218977 | rs6040633 | 0.9 | 1 |
| hCV30129243 | rs6040636 | hCV30417550 | rs6040634 | 0.9 | 1 |
| hCV30129243 | rs6040636 | hCV30453433 | rs6131208 | 0.9 | 0.9585 |
| hCV30129243 | rs6040636 | hCV30615489 | rs6040630 | 0.9 | 0.9294 |
| hCV30129243 | rs6040636 | hCV32274419 | rs13038146 | 0.9 | 1 |
| hCV30129243 | rs6040636 | hCV330228 | rs6040668 | 0.9 | 1 |
| hCV30202184 | rs6685920 | hCV1166098 | rs4660234 | 0.9 | 1 |

TABLE 3-continued

| Interrogated SNP (hCV #) | Interrogated SNP (rs #) | LD SNP (hCV #) | LD SNP (rs #) | Threshold $r^2$ | $r^2$ |
|---|---|---|---|---|---|
| hCV30202184 | rs6685920 | hCV1166103 | rs12407412 | 0.9 | 1 |
| hCV30202184 | rs6685920 | hCV1166105 | rs11576627 | 0.9 | 1 |
| hCV30218977 | rs6040633 | hCV2529198 | rs742827 | 0.9 | 0.9624 |
| hCV30218977 | rs6040633 | hCV2529202 | rs6040667 | 0.9 | 1 |
| hCV30218977 | rs6040633 | hCV2529211 | rs17189710 | 0.9 | 1 |
| hCV30218977 | rs6040633 | hCV2529224 | rs2327412 | 0.9 | 1 |
| hCV30218977 | rs6040633 | hCV2529230 | rs4444612 | 0.9 | 1 |
| hCV30218977 | rs6040633 | hCV2529231 | rs4315598 | 0.9 | 1 |
| hCV30218977 | rs6040633 | hCV2529239 | rs6040638 | 0.9 | 1 |
| hCV30218977 | rs6040633 | hCV2529241 | rs6134243 | 0.9 | 1 |
| hCV30218977 | rs6040633 | hCV2529246 | rs6040619 | 0.9 | 1 |
| hCV30218977 | rs6040633 | hCV27367681 | rs2876227 | 0.9 | 0.9649 |
| hCV30218977 | rs6040633 | hCV27367708 | rs1009748 | 0.9 | 1 |
| hCV30218977 | rs6040633 | hCV29840965 | rs6040644 | 0.9 | 1 |
| hCV30218977 | rs6040633 | hCV30057061 | rs6033138 | 0.9 | 1 |
| hCV30218977 | rs6040633 | hCV30093270 | rs6040625 | 0.9 | 1 |
| hCV30218977 | rs6040633 | hCV30129243 | rs6040636 | 0.9 | 1 |
| hCV30218977 | rs6040633 | hCV30417550 | rs6040634 | 0.9 | 1 |
| hCV30218977 | rs6040633 | hCV30453433 | rs6131208 | 0.9 | 0.9585 |
| hCV30218977 | rs6040633 | hCV30615489 | rs6040630 | 0.9 | 0.9294 |
| hCV30218977 | rs6040633 | hCV32274419 | rs13038146 | 0.9 | 1 |
| hCV30218977 | rs6040633 | hCV330228 | rs6040668 | 0.9 | 1 |
| hCV3023182 | rs2648694 | hCV1408878 | rs17194378 | 0.9 | 1 |
| hCV3023182 | rs2648694 | hCV16274605 | rs2653496 | 0.9 | 0.9203 |
| hCV3023182 | rs2648694 | hCV1871425 | rs7610808 | 0.9 | 0.9234 |
| hCV3023182 | rs2648694 | hCV1871428 | rs10049421 | 0.9 | 0.9616 |
| hCV3023182 | rs2648694 | hCV1871433 | rs9310741 | 0.9 | 0.9382 |
| hCV3023182 | rs2648694 | hCV26850538 | rs2648687 | 0.9 | 0.9392 |
| hCV3023182 | rs2648694 | hCV26850540 | rs2616575 | 0.9 | 0.9392 |
| hCV3023182 | rs2648694 | hCV29941790 | rs9852630 | 0.9 | 0.9203 |
| hCV3023182 | rs2648694 | hCV3095156 | rs2616569 | 0.9 | 0.9011 |
| hCV3023182 | rs2648694 | hCV3095166 | rs2616571 | 0.9 | 0.9613 |
| hCV30243451 | rs10270624 | hCV11435810 | rs7808536 | 0.9 | 1 |
| hCV30243451 | rs10270624 | hCV11435811 | rs2057903 | 0.9 | 1 |
| hCV30243451 | rs10270624 | hCV16010888 | rs2402516 | 0.9 | 0.9338 |
| hCV30243451 | rs10270624 | hCV16151622 | rs2896295 | 0.9 | 1 |
| hCV30243451 | rs10270624 | hCV2580015 | rs6973461 | 0.9 | 1 |
| hCV30243451 | rs10270624 | hCV26499740 | rs1344081 | 0.9 | 0.9401 |
| hCV30243451 | rs10270624 | hCV29630277 | rs7799541 | 0.9 | 0.9714 |
| hCV30243451 | rs10270624 | hCV29720798 | rs10228725 | 0.9 | 1 |
| hCV30243451 | rs10270624 | hCV29738883 | rs10237648 | 0.9 | 1 |
| hCV30243451 | rs10270624 | hCV29865261 | rs10226287 | 0.9 | 1 |
| hCV30243451 | rs10270624 | hCV30441808 | rs10487413 | 0.9 | 0.9396 |
| hCV30243451 | rs10270624 | hCV31281599 | rs13438543 | 0.9 | 1 |
| hCV30332546 | rs9346951 | hCV30080541 | rs9346948 | 0.9 | 1 |
| hCV30332546 | rs9346951 | hCV3125579 | rs10945874 | 0.9 | 0.9549 |
| hCV30417550 | rs6040634 | hCV2529198 | rs742827 | 0.9 | 0.9624 |
| hCV30417550 | rs6040634 | hCV2529202 | rs6040667 | 0.9 | 1 |
| hCV30417550 | rs6040634 | hCV2529211 | rs17189710 | 0.9 | 1 |
| hCV30417550 | rs6040634 | hCV2529224 | rs2327412 | 0.9 | 1 |
| hCV30417550 | rs6040634 | hCV2529230 | rs4444612 | 0.9 | 1 |
| hCV30417550 | rs6040634 | hCV2529231 | rs4315598 | 0.9 | 1 |
| hCV30417550 | rs6040634 | hCV2529239 | rs6040638 | 0.9 | 1 |
| hCV30417550 | rs6040634 | hCV2529241 | rs6134243 | 0.9 | 1 |
| hCV30417550 | rs6040634 | hCV2529246 | rs6040619 | 0.9 | 1 |
| hCV30417550 | rs6040634 | hCV27367681 | rs2876227 | 0.9 | 0.9649 |
| hCV30417550 | rs6040634 | hCV27367708 | rs1009748 | 0.9 | 1 |
| hCV30417550 | rs6040634 | hCV29840965 | rs6040644 | 0.9 | 1 |
| hCV30417550 | rs6040634 | hCV30057061 | rs6033138 | 0.9 | 1 |
| hCV30417550 | rs6040634 | hCV30093270 | rs6040625 | 0.9 | 1 |
| hCV30417550 | rs6040634 | hCV30129243 | rs6040636 | 0.9 | 1 |
| hCV30417550 | rs6040634 | hCV30218977 | rs6040633 | 0.9 | 1 |
| hCV30417550 | rs6040634 | hCV30453433 | rs6131208 | 0.9 | 0.9585 |
| hCV30417550 | rs6040634 | hCV30615489 | rs6040630 | 0.9 | 0.9294 |
| hCV30417550 | rs6040634 | hCV32274419 | rs13038146 | 0.9 | 1 |
| hCV30417550 | rs6040634 | hCV330228 | rs6040668 | 0.9 | 1 |
| hCV30453433 | rs6131208 | hCV2529198 | rs742827 | 0.9 | 0.9167 |
| hCV30453433 | rs6131208 | hCV2529202 | rs6040667 | 0.9 | 0.9585 |
| hCV30453433 | rs6131208 | hCV2529210 | rs6131206 | 0.9 | 0.9129 |
| hCV30453433 | rs6131208 | hCV2529211 | rs17189710 | 0.9 | 0.9565 |
| hCV30453433 | rs6131208 | hCV2529224 | rs2327412 | 0.9 | 0.9565 |
| hCV30453433 | rs6131208 | hCV2529230 | rs4444612 | 0.9 | 0.9565 |
| hCV30453433 | rs6131208 | hCV2529231 | rs4315598 | 0.9 | 0.9565 |
| hCV30453433 | rs6131208 | hCV2529239 | rs6040638 | 0.9 | 0.9565 |
| hCV30453433 | rs6131208 | hCV2529241 | rs6134243 | 0.9 | 0.9585 |
| hCV30453433 | rs6131208 | hCV2529246 | rs6040619 | 0.9 | 0.9565 |
| hCV30453433 | rs6131208 | hCV27367681 | rs2876227 | 0.9 | 0.9193 |

TABLE 3-continued

| Interrogated SNP (hCV #) | Interrogated SNP (rs #) | LD SNP (hCV #) | LD SNP (rs #) | Threshold $r^2$ | $r^2$ |
|---|---|---|---|---|---|
| hCV30453433 | rs6131208 | hCV27367708 | rs1009748 | 0.9 | 0.9565 |
| hCV30453433 | rs6131208 | hCV29840965 | rs6040644 | 0.9 | 0.9565 |
| hCV30453433 | rs6131208 | hCV30057061 | rs6033138 | 0.9 | 0.9585 |
| hCV30453433 | rs6131208 | hCV30093270 | rs6040625 | 0.9 | 0.9585 |
| hCV30453433 | rs6131208 | hCV30129243 | rs6040636 | 0.9 | 0.9585 |
| hCV30453433 | rs6131208 | hCV30218977 | rs6040633 | 0.9 | 0.9585 |
| hCV30453433 | rs6131208 | hCV30417550 | rs6040634 | 0.9 | 0.9585 |
| hCV30453433 | rs6131208 | hCV32274419 | rs13038146 | 0.9 | 0.9585 |
| hCV30453433 | rs6131208 | hCV330228 | rs6040668 | 0.9 | 0.9585 |
| hCV30615489 | rs6040630 | hCV2529202 | rs6040667 | 0.9 | 0.9294 |
| hCV30615489 | rs6040630 | hCV2529211 | rs17189710 | 0.9 | 0.9225 |
| hCV30615489 | rs6040630 | hCV2529224 | rs2327412 | 0.9 | 0.9225 |
| hCV30615489 | rs6040630 | hCV2529230 | rs4444612 | 0.9 | 0.9225 |
| hCV30615489 | rs6040630 | hCV2529231 | rs4315598 | 0.9 | 0.9225 |
| hCV30615489 | rs6040630 | hCV2529239 | rs6040638 | 0.9 | 0.9225 |
| hCV30615489 | rs6040630 | hCV2529241 | rs6134243 | 0.9 | 0.9294 |
| hCV30615489 | rs6040630 | hCV2529246 | rs6040619 | 0.9 | 0.9225 |
| hCV30615489 | rs6040630 | hCV27367708 | rs1009748 | 0.9 | 0.9225 |
| hCV30615489 | rs6040630 | hCV29840965 | rs6040644 | 0.9 | 0.9225 |
| hCV30615489 | rs6040630 | hCV30057061 | rs6033138 | 0.9 | 0.9294 |
| hCV30615489 | rs6040630 | hCV30093270 | rs6040625 | 0.9 | 0.9294 |
| hCV30615489 | rs6040630 | hCV30129243 | rs6040636 | 0.9 | 0.9294 |
| hCV30615489 | rs6040630 | hCV30218977 | rs6040633 | 0.9 | 0.9294 |
| hCV30615489 | rs6040630 | hCV30417550 | rs6040634 | 0.9 | 0.9294 |
| hCV30615489 | rs6040630 | hCV32274419 | rs13038146 | 0.9 | 0.9294 |
| hCV30615489 | rs6040630 | hCV330228 | rs6040668 | 0.9 | 0.9294 |
| hCV30621656 | rs10478919 | hCV11819780 | rs12153185 | 0.9 | 0.9232 |
| hCV30621656 | rs10478919 | hCV11819782 | rs12719415 | 0.9 | 0.927 |
| hCV30621656 | rs10478919 | hCV2575318 | rs7711358 | 0.9 | 1 |
| hCV30621656 | rs10478919 | hCV2575336 | rs2418541 | 0.9 | 1 |
| hCV30621656 | rs10478919 | hCV2575340 | rs11242020 | 0.9 | 1 |
| hCV30621656 | rs10478919 | hCV26478747 | rs2190598 | 0.9 | 0.9239 |
| hCV30621656 | rs10478919 | hCV26478763 | rs2418542 | 0.9 | 1 |
| hCV30621656 | rs10478919 | hCV27996154 | rs4836502 | 0.9 | 0.927 |
| hCV30621656 | rs10478919 | hCV2961244 | rs2418548 | 0.9 | 0.9232 |
| hCV30621656 | rs10478919 | hCV2961250 | rs4836507 | 0.9 | 0.927 |
| hCV30621656 | rs10478919 | hCV2961252 | rs10067895 | 0.9 | 0.927 |
| hCV30621656 | rs10478919 | hCV2961253 | rs2190600 | 0.9 | 0.927 |
| hCV30621656 | rs10478919 | hCV2961260 | rs11242022 | 0.9 | 0.9232 |
| hCV30621656 | rs10478919 | hCV2961261 | rs11242021 | 0.9 | 0.9255 |
| hCV30621656 | rs10478919 | hCV2961267 | rs1476714 | 0.9 | 0.9607 |
| hCV30621656 | rs10478919 | hCV2961268 | rs2108425 | 0.9 | 0.927 |
| hCV30621656 | rs10478919 | hCV2961269 | rs2158958 | 0.9 | 0.927 |
| hCV30621656 | rs10478919 | hCV2961270 | rs9327555 | 0.9 | 0.927 |
| hCV30621656 | rs10478919 | hCV2961278 | rs7446891 | 0.9 | 0.927 |
| hCV30621656 | rs10478919 | hCV2961280 | rs10520072 | 0.9 | 0.927 |
| hCV30621656 | rs10478919 | hCV2961282 | rs917295 | 0.9 | 0.927 |
| hCV30621656 | rs10478919 | hCV2961284 | rs10054055 | 0.9 | 0.9616 |
| hCV30621656 | rs10478919 | hCV2961296 | rs10051148 | 0.9 | 0.9623 |
| hCV30621656 | rs10478919 | hCV2961297 | rs2158961 | 0.9 | 0.9634 |
| hCV30621656 | rs10478919 | hCV2961306 | rs264129 | 0.9 | 0.9232 |
| hCV30621656 | rs10478919 | hCV31237567 | rs11749272 | 0.9 | 1 |
| hCV30621656 | rs10478919 | hCV346713 | rs1990023 | 0.9 | 1 |
| hCV30621656 | rs10478919 | hCV546489 | rs264122 | 0.9 | 0.9616 |
| hCV30621656 | rs10478919 | hCV8932829 | rs1116596 | 0.9 | 1 |
| hCV30935888 | rs13089860 | hCV11226226 | rs4234592 | 0.9 | 1 |
| hCV30935888 | rs13089860 | hCV1712351 | rs2280209 | 0.9 | 0.9621 |
| hCV30935888 | rs13089860 | hCV29037733 | rs6444109 | 0.9 | 1 |
| hCV30935888 | rs13089860 | hCV29037738 | rs7627157 | 0.9 | 1 |
| hCV30935888 | rs13089860 | hCV29735597 | rs9826842 | 0.9 | 0.9051 |
| hCV30935888 | rs13089860 | hCV29771757 | rs4234591 | 0.9 | 1 |
| hCV31080080 | rs12679254 | hCV1319516 | rs12678600 | 0.9 | 1 |
| hCV31080080 | rs12679254 | hCV1319518 | rs13265054 | 0.9 | 1 |
| hCV31190748 | rs7959965 | hCV11686367 | rs7955901 | 0.9 | 0.9442 |
| hCV31190748 | rs7959965 | hCV11686374 | rs7957932 | 0.9 | 0.9161 |
| hCV31190748 | rs7959965 | hCV171102 | rs7313973 | 0.9 | 0.9568 |
| hCV31190748 | rs7959965 | hCV240133 | rs4760895 | 0.9 | 0.9644 |
| hCV31190748 | rs7959965 | hCV2745805 | rs7132840 | 0.9 | 0.9268 |
| hCV31190748 | rs7959965 | hCV2745807 | rs2063591 | 0.9 | 0.9303 |
| hCV31190748 | rs7959965 | hCV2745815 | rs1512991 | 0.9 | 1 |
| hCV31190748 | rs7959965 | hCV2745828 | rs10879240 | 0.9 | 0.9274 |
| hCV31190748 | rs7959965 | hCV27952502 | rs4760894 | 0.9 | 0.9644 |
| hCV31190748 | rs7959965 | hCV27952503 | rs4760785 | 0.9 | 0.9644 |
| hCV31190748 | rs7959965 | hCV29120310 | rs7298255 | 0.9 | 1 |
| hCV31190748 | rs7959965 | hCV31190777 | rs10784891 | 0.9 | 1 |
| hCV31190748 | rs7959965 | hDV72015086 | rs7956274 | 0.9 | 1 |
| hCV31190777 | rs10784891 | hCV11686367 | rs7955901 | 0.9 | 1 |

TABLE 3-continued

| Interrogated SNP (hCV #) | Interrogated SNP (rs #) | LD SNP (hCV #) | LD SNP (rs #) | Threshold $r^2$ | $r^2$ |
|---|---|---|---|---|---|
| hCV31190777 | rs10784891 | hCV11686374 | rs7957932 | 0.9 | 0.9572 |
| hCV31190777 | rs10784891 | hCV171102 | rs7313973 | 0.9 | 0.9553 |
| hCV31190777 | rs10784891 | hCV240133 | rs4760895 | 0.9 | 0.962 |
| hCV31190777 | rs10784891 | hCV240134 | rs7138300 | 0.9 | 0.9588 |
| hCV31190777 | rs10784891 | hCV2745797 | rs1877527 | 0.9 | 0.9555 |
| hCV31190777 | rs10784891 | hCV2745800 | rs11178531 | 0.9 | 1 |
| hCV31190777 | rs10784891 | hCV2745805 | rs7132840 | 0.9 | 1 |
| hCV31190777 | rs10784891 | hCV2745807 | rs2063591 | 0.9 | 0.962 |
| hCV31190777 | rs10784891 | hCV2745815 | rs1512991 | 0.9 | 1 |
| hCV31190777 | rs10784891 | hCV2745822 | rs1913201 | 0.9 | 0.9588 |
| hCV31190777 | rs10784891 | hCV2745828 | rs10879240 | 0.9 | 0.9235 |
| hCV31190777 | rs10784891 | hCV27952502 | rs4760894 | 0.9 | 0.962 |
| hCV31190777 | rs10784891 | hCV27952503 | rs4760785 | 0.9 | 0.962 |
| hCV31190777 | rs10784891 | hCV29120310 | rs7298255 | 0.9 | 1 |
| hCV31190777 | rs10784891 | hCV31190748 | rs7959965 | 0.9 | 1 |
| hCV31190777 | rs10784891 | hDV72015086 | rs7956274 | 0.9 | 1 |
| hCV31237567 | rs11749272 | hCV11819780 | rs12153185 | 0.9 | 0.9232 |
| hCV31237567 | rs11749272 | hCV11819782 | rs12719415 | 0.9 | 0.927 |
| hCV31237567 | rs11749272 | hCV2575318 | rs7711358 | 0.9 | 1 |
| hCV31237567 | rs11749272 | hCV2575336 | rs2418541 | 0.9 | 1 |
| hCV31237567 | rs11749272 | hCV2575340 | rs11242020 | 0.9 | 1 |
| hCV31237567 | rs11749272 | hCV26478747 | rs2190598 | 0.9 | 0.9239 |
| hCV31237567 | rs11749272 | hCV26478763 | rs2418542 | 0.9 | 1 |
| hCV31237567 | rs11749272 | hCV27996154 | rs4836502 | 0.9 | 0.927 |
| hCV31237567 | rs11749272 | hCV2961244 | rs2418548 | 0.9 | 0.9232 |
| hCV31237567 | rs11749272 | hCV2961250 | rs4836507 | 0.9 | 0.927 |
| hCV31237567 | rs11749272 | hCV2961252 | rs10067895 | 0.9 | 0.927 |
| hCV31237567 | rs11749272 | hCV2961253 | rs2190600 | 0.9 | 0.927 |
| hCV31237567 | rs11749272 | hCV2961260 | rs11242022 | 0.9 | 0.9232 |
| hCV31237567 | rs11749272 | hCV2961261 | rs11242021 | 0.9 | 0.9255 |
| hCV31237567 | rs11749272 | hCV2961267 | rs1476714 | 0.9 | 0.9607 |
| hCV31237567 | rs11749272 | hCV2961268 | rs2108425 | 0.9 | 0.927 |
| hCV31237567 | rs11749272 | hCV2961269 | rs2158958 | 0.9 | 0.927 |
| hCV31237567 | rs11749272 | hCV2961270 | rs9327555 | 0.9 | 0.927 |
| hCV31237567 | rs11749272 | hCV2961278 | rs7446891 | 0.9 | 0.927 |
| hCV31237567 | rs11749272 | hCV2961280 | rs10520072 | 0.9 | 0.927 |
| hCV31237567 | rs11749272 | hCV2961282 | rs917295 | 0.9 | 0.927 |
| hCV31237567 | rs11749272 | hCV2961284 | rs10054055 | 0.9 | 0.9616 |
| hCV31237567 | rs11749272 | hCV2961296 | rs10051148 | 0.9 | 0.9623 |
| hCV31237567 | rs11749272 | hCV2961297 | rs2158961 | 0.9 | 0.9634 |
| hCV31237567 | rs11749272 | hCV2961306 | rs264129 | 0.9 | 0.9232 |
| hCV31237567 | rs11749272 | hCV30621656 | rs10478919 | 0.9 | 1 |
| hCV31237567 | rs11749272 | hCV346713 | rs1990023 | 0.9 | 1 |
| hCV31237567 | rs11749272 | hCV546489 | rs264122 | 0.9 | 0.9616 |
| hCV31237567 | rs11749272 | hCV8932829 | rs1116596 | 0.9 | 1 |
| hCV3125579 | rs10945874 | hCV30080541 | rs9346948 | 0.9 | 1 |
| hCV3125579 | rs10945874 | hCV30332546 | rs9346951 | 0.9 | 0.9549 |
| hCV31587413 | rs6746182 | hCV31587414 | rs6746170 | 0.9 | 1 |
| hCV31587413 | rs6746182 | hCV31587415 | rs6544728 | 0.9 | 1 |
| hCV31587413 | rs6746182 | hCV31587430 | rs11124962 | 0.9 | 0.9489 |
| hCV31587414 | rs6746170 | hCV31587413 | rs6746182 | 0.9 | 1 |
| hCV31587414 | rs6746170 | hCV31587415 | rs6544728 | 0.9 | 1 |
| hCV31587414 | rs6746170 | hCV31587430 | rs11124962 | 0.9 | 0.9489 |
| hCV31587415 | rs6544728 | hCV25642662 | rs10190161 | 0.9 | 0.9224 |
| hCV31587415 | rs6544728 | hCV31587413 | rs6746182 | 0.9 | 1 |
| hCV31587415 | rs6544728 | hCV31587414 | rs6746170 | 0.9 | 1 |
| hCV31587415 | rs6544728 | hCV31587430 | rs11124962 | 0.9 | 0.9602 |
| hCV31587430 | rs11124962 | hCV31587413 | rs6746182 | 0.9 | 0.9489 |
| hCV31587430 | rs11124962 | hCV31587414 | rs6746170 | 0.9 | 0.9489 |
| hCV31587430 | rs11124962 | hCV31587415 | rs6544728 | 0.9 | 0.9602 |
| hCV3172867 | rs316720 | hCV989588 | rs669684 | 0.9 | 0.9626 |
| hCV3172867 | rs316720 | hCV989658 | rs647645 | 0.9 | 0.9631 |
| hCV31931605 | rs7022281 | hCV27084860 | rs10758326 | 0.9 | 0.9004 |
| hCV31931605 | rs7022281 | hCV31931609 | rs10738948 | 0.9 | 0.9289 |
| hCV31931609 | rs10738948 | hCV27084860 | rs10758326 | 0.9 | 0.9637 |
| hCV31931609 | rs10738948 | hCV31931605 | rs7022281 | 0.9 | 0.9289 |
| hCV32014843 | rs11221075 | hCV1056544 | rs675163 | 0.9 | 1 |
| hCV32014843 | rs11221075 | hCV32014853 | rs11221097 | 0.9 | 1 |
| hCV32014843 | rs11221075 | hCV767324 | rs687047 | 0.9 | 1 |
| hCV32274419 | rs13038146 | hCV2529198 | rs742827 | 0.9 | 0.9624 |
| hCV32274419 | rs13038146 | hCV2529202 | rs6040667 | 0.9 | 1 |
| hCV32274419 | rs13038146 | hCV2529211 | rs17189710 | 0.9 | 1 |
| hCV32274419 | rs13038146 | hCV2529224 | rs2327412 | 0.9 | 1 |
| hCV32274419 | rs13038146 | hCV2529230 | rs4444612 | 0.9 | 1 |
| hCV32274419 | rs13038146 | hCV2529231 | rs4315598 | 0.9 | 1 |
| hCV32274419 | rs13038146 | hCV2529239 | rs6040638 | 0.9 | 1 |
| hCV32274419 | rs13038146 | hCV2529241 | rs6134243 | 0.9 | 1 |

TABLE 3-continued

| Interrogated SNP (hCV #) | Interrogated SNP (rs #) | LD SNP (hCV #) | LD SNP (rs #) | Threshold $r^2$ | $r^2$ |
|---|---|---|---|---|---|
| hCV32274419 | rs13038146 | hCV2529246 | rs6040619 | 0.9 | 1 |
| hCV32274419 | rs13038146 | hCV27367681 | rs2876227 | 0.9 | 0.9649 |
| hCV32274419 | rs13038146 | hCV27367708 | rs1009748 | 0.9 | 1 |
| hCV32274419 | rs13038146 | hCV29840965 | rs6040644 | 0.9 | 1 |
| hCV32274419 | rs13038146 | hCV30057061 | rs6033138 | 0.9 | 1 |
| hCV32274419 | rs13038146 | hCV30093270 | rs6040625 | 0.9 | 1 |
| hCV32274419 | rs13038146 | hCV30129243 | rs6040636 | 0.9 | 1 |
| hCV32274419 | rs13038146 | hCV30218977 | rs6040633 | 0.9 | 1 |
| hCV32274419 | rs13038146 | hCV30417550 | rs6040634 | 0.9 | 1 |
| hCV32274419 | rs13038146 | hCV30453433 | rs6131208 | 0.9 | 0.9585 |
| hCV32274419 | rs13038146 | hCV30615489 | rs6040630 | 0.9 | 0.9294 |
| hCV32274419 | rs13038146 | hCV330228 | rs6040668 | 0.9 | 1 |
| hCV330228 | rs6040668 | hCV2529198 | rs742827 | 0.9 | 0.9624 |
| hCV330228 | rs6040668 | hCV2529202 | rs6040667 | 0.9 | 1 |
| hCV330228 | rs6040668 | hCV2529211 | rs17189710 | 0.9 | 1 |
| hCV330228 | rs6040668 | hCV2529224 | rs2327412 | 0.9 | 1 |
| hCV330228 | rs6040668 | hCV2529230 | rs4444612 | 0.9 | 1 |
| hCV330228 | rs6040668 | hCV2529231 | rs4315598 | 0.9 | 1 |
| hCV330228 | rs6040668 | hCV2529239 | rs6040638 | 0.9 | 1 |
| hCV330228 | rs6040668 | hCV2529241 | rs6134243 | 0.9 | 1 |
| hCV330228 | rs6040668 | hCV2529246 | rs6040619 | 0.9 | 1 |
| hCV330228 | rs6040668 | hCV27367681 | rs2876227 | 0.9 | 0.9649 |
| hCV330228 | rs6040668 | hCV27367708 | rs1009748 | 0.9 | 1 |
| hCV330228 | rs6040668 | hCV29840965 | rs6040644 | 0.9 | 1 |
| hCV330228 | rs6040668 | hCV30057061 | rs6033138 | 0.9 | 1 |
| hCV330228 | rs6040668 | hCV30093270 | rs6040625 | 0.9 | 1 |
| hCV330228 | rs6040668 | hCV30129243 | rs6040636 | 0.9 | 1 |
| hCV330228 | rs6040668 | hCV30218977 | rs6040633 | 0.9 | 1 |
| hCV330228 | rs6040668 | hCV30417550 | rs6040634 | 0.9 | 1 |
| hCV330228 | rs6040668 | hCV30453433 | rs6131208 | 0.9 | 0.9585 |
| hCV330228 | rs6040668 | hCV30615489 | rs6040630 | 0.9 | 0.9294 |
| hCV330228 | rs6040668 | hCV32274419 | rs13038146 | 0.9 | 1 |
| hCV346713 | rs1990023 | hCV11819780 | rs12153185 | 0.9 | 0.9358 |
| hCV346713 | rs1990023 | hCV11819782 | rs12719415 | 0.9 | 0.9232 |
| hCV346713 | rs1990023 | hCV2575318 | rs7711358 | 0.9 | 1 |
| hCV346713 | rs1990023 | hCV2575336 | rs2418541 | 0.9 | 1 |
| hCV346713 | rs1990023 | hCV2575340 | rs11242020 | 0.9 | 1 |
| hCV346713 | rs1990023 | hCV26478744 | rs2016194 | 0.9 | 0.9162 |
| hCV346713 | rs1990023 | hCV26478745 | rs2108426 | 0.9 | 0.9557 |
| hCV346713 | rs1990023 | hCV26478747 | rs2190598 | 0.9 | 0.9199 |
| hCV346713 | rs1990023 | hCV26478763 | rs2418542 | 0.9 | 1 |
| hCV346713 | rs1990023 | hCV27996154 | rs4836502 | 0.9 | 0.9232 |
| hCV346713 | rs1990023 | hCV2961244 | rs2418548 | 0.9 | 0.9358 |
| hCV346713 | rs1990023 | hCV2961250 | rs4836507 | 0.9 | 0.9232 |
| hCV346713 | rs1990023 | hCV2961252 | rs10067895 | 0.9 | 0.9232 |
| hCV346713 | rs1990023 | hCV2961253 | rs2190600 | 0.9 | 0.9232 |
| hCV346713 | rs1990023 | hCV2961259 | rs11242023 | 0.9 | 0.9358 |
| hCV346713 | rs1990023 | hCV2961260 | rs11242022 | 0.9 | 0.9567 |
| hCV346713 | rs1990023 | hCV2961261 | rs11242021 | 0.9 | 0.9216 |
| hCV346713 | rs1990023 | hCV2961267 | rs1476714 | 0.9 | 0.9587 |
| hCV346713 | rs1990023 | hCV2961268 | rs2108425 | 0.9 | 0.9232 |
| hCV346713 | rs1990023 | hCV2961269 | rs2158958 | 0.9 | 0.9232 |
| hCV346713 | rs1990023 | hCV2961270 | rs9327555 | 0.9 | 0.9232 |
| hCV346713 | rs1990023 | hCV2961278 | rs7446891 | 0.9 | 0.9232 |
| hCV346713 | rs1990023 | hCV2961280 | rs10520072 | 0.9 | 0.9232 |
| hCV346713 | rs1990023 | hCV2961282 | rs917295 | 0.9 | 0.9232 |
| hCV346713 | rs1990023 | hCV2961284 | rs10054055 | 0.9 | 0.9783 |
| hCV346713 | rs1990023 | hCV2961296 | rs10051148 | 0.9 | 0.9608 |
| hCV346713 | rs1990023 | hCV2961297 | rs2158961 | 0.9 | 0.9616 |
| hCV346713 | rs1990023 | hCV2961306 | rs264129 | 0.9 | 0.9567 |
| hCV346713 | rs1990023 | hCV30621656 | rs10478919 | 0.9 | 1 |
| hCV346713 | rs1990023 | hCV31237567 | rs11749272 | 0.9 | 1 |
| hCV346713 | rs1990023 | hCV546489 | rs264122 | 0.9 | 0.9783 |
| hCV346713 | rs1990023 | hCV8932829 | rs1116596 | 0.9 | 1 |
| hCV349805 | rs4851529 | hCV16126066 | rs2110564 | 0.9 | 0.9329 |
| hCV349805 | rs4851529 | hCV2676440 | rs6722640 | 0.9 | 0.9329 |
| hCV349805 | rs4851529 | hCV27872026 | rs4851531 | 0.9 | 0.9646 |
| hCV349805 | rs4851529 | hCV8905894 | rs974950 | 0.9 | 0.9303 |
| hCV364260 | rs2505039 | hCV29557190 | rs9487275 | 0.9 | 0.9632 |
| hCV364260 | rs2505039 | hCV35209 | rs4329143 | 0.9 | 0.9615 |
| hCV364260 | rs2505039 | hCV364258 | rs2505038 | 0.9 | 0.9806 |
| hCV364261 | rs2505039 | hCV364261 | rs7749240 | 0.9 | 0.9639 |
| hCV375090 | rs4450660 | hCV26135665 | rs4390811 | 0.9 | 0.96 |
| hCV375090 | rs4450660 | hCV26771384 | rs10865197 | 0.9 | 1 |
| hCV375090 | rs4450660 | hCV26771389 | rs10183431 | 0.9 | 1 |
| hCV375090 | rs4450660 | hCV27875215 | rs4346434 | 0.9 | 0.922 |
| hCV375090 | rs4450660 | hCV27933339 | rs4586678 | 0.9 | 1 |

TABLE 3-continued

| Interrogated SNP (hCV #) | Interrogated SNP (rs #) | LD SNP (hCV #) | LD SNP (rs #) | Threshold $r^2$ | $r^2$ |
|---|---|---|---|---|---|
| hCV375090 | rs4450660 | hCV29229284 | rs6741066 | 0.9 | 0.9591 |
| hCV375090 | rs4450660 | hCV30817981 | rs6723119 | 0.9 | 0.96 |
| hCV375090 | rs4450660 | hCV375079 | rs9309112 | 0.9 | 0.92 |
| hCV375090 | rs4450660 | hCV375083 | rs10206724 | 0.9 | 1 |
| hCV375090 | rs4450660 | hCV514334 | rs6544721 | 0.9 | 0.961 |
| hCV443083 | rs6742894 | hCV48381 | rs6743092 | 0.9 | 1 |
| hCV443083 | rs6742894 | hCV48382 | rs12465349 | 0.9 | 1 |
| hCV48381 | rs6743092 | hCV443083 | rs6742894 | 0.9 | 1 |
| hCV48381 | rs6743092 | hCV48382 | rs12465349 | 0.9 | 1 |
| hCV514334 | rs6544721 | hCV25642662 | rs10190161 | 0.9 | 0.9211 |
| hCV514334 | rs6544721 | hCV26135665 | rs4390811 | 0.9 | 0.9201 |
| hCV514334 | rs6544721 | hCV26771384 | rs10865197 | 0.9 | 0.961 |
| hCV514334 | rs6544721 | hCV26771389 | rs10183431 | 0.9 | 0.961 |
| hCV514334 | rs6544721 | hCV27933339 | rs4586678 | 0.9 | 0.961 |
| hCV514334 | rs6544721 | hCV29229284 | rs6741066 | 0.9 | 0.9183 |
| hCV514334 | rs6544721 | hCV30817981 | rs6723119 | 0.9 | 1 |
| hCV514334 | rs6544721 | hCV375083 | rs10206724 | 0.9 | 0.96 |
| hCV514334 | rs6544721 | hCV375090 | rs4450660 | 0.9 | 0.961 |
| hCV546489 | rs264122 | hCV11819780 | rs12153185 | 0.9 | 0.9573 |
| hCV546489 | rs264122 | hCV11819782 | rs12719415 | 0.9 | 0.9616 |
| hCV546489 | rs264122 | hCV2575318 | rs7711358 | 0.9 | 0.9616 |
| hCV546489 | rs264122 | hCV2575336 | rs2418541 | 0.9 | 0.9616 |
| hCV546489 | rs264122 | hCV2575340 | rs11242020 | 0.9 | 0.9616 |
| hCV546489 | rs264122 | hCV26478744 | rs2016194 | 0.9 | 0.9581 |
| hCV546489 | rs264122 | hCV26478745 | rs2108426 | 0.9 | 1 |
| hCV546489 | rs264122 | hCV26478747 | rs2190598 | 0.9 | 0.96 |
| hCV546489 | rs264122 | hCV26478763 | rs2418542 | 0.9 | 0.9616 |
| hCV546489 | rs264122 | hCV27996154 | rs4836502 | 0.9 | 0.9616 |
| hCV546489 | rs264122 | hCV2961244 | rs2418548 | 0.9 | 0.9573 |
| hCV546489 | rs264122 | hCV2961250 | rs4836507 | 0.9 | 0.9616 |
| hCV546489 | rs264122 | hCV2961252 | rs10067895 | 0.9 | 0.9616 |
| hCV546489 | rs264122 | hCV2961253 | rs2190600 | 0.9 | 0.9616 |
| hCV546489 | rs264122 | hCV2961259 | rs11242023 | 0.9 | 0.9573 |
| hCV546489 | rs264122 | hCV2961260 | rs11242022 | 0.9 | 0.9783 |
| hCV546489 | rs264122 | hCV2961261 | rs11242021 | 0.9 | 0.9608 |
| hCV546489 | rs264122 | hCV2961267 | rs1476714 | 0.9 | 0.9587 |
| hCV546489 | rs264122 | hCV2961268 | rs2108425 | 0.9 | 0.9616 |
| hCV546489 | rs264122 | hCV2961269 | rs2158958 | 0.9 | 0.9616 |
| hCV546489 | rs264122 | hCV2961270 | rs9327555 | 0.9 | 0.9616 |
| hCV546489 | rs264122 | hCV2961278 | rs7446891 | 0.9 | 0.9616 |
| hCV546489 | rs264122 | hCV2961280 | rs10520072 | 0.9 | 0.9616 |
| hCV546489 | rs264122 | hCV2961282 | rs917295 | 0.9 | 0.9616 |
| hCV546489 | rs264122 | hCV2961284 | rs10054055 | 0.9 | 1 |
| hCV546489 | rs264122 | hCV2961296 | rs10051148 | 0.9 | 1 |
| hCV546489 | rs264122 | hCV2961297 | rs2158961 | 0.9 | 1 |
| hCV546489 | rs264122 | hCV2961306 | rs264129 | 0.9 | 0.9783 |
| hCV546489 | rs264122 | hCV29666186 | rs6871041 | 0.9 | 0.9189 |
| hCV546489 | rs264122 | hCV30621656 | rs10478919 | 0.9 | 0.9616 |
| hCV546489 | rs264122 | hCV31237567 | rs11749272 | 0.9 | 0.9616 |
| hCV546489 | rs264122 | hCV346713 | rs1990023 | 0.9 | 0.9783 |
| hCV546489 | rs264122 | hCV8932829 | rs1116596 | 0.9 | 0.9616 |
| hCV546493 | rs264126 | hCV2575337 | rs2214640 | 0.9 | 1 |
| hCV546493 | rs264126 | hCV2575344 | rs10064779 | 0.9 | 0.9328 |
| hCV546493 | rs264126 | hCV26478748 | rs2190597 | 0.9 | 0.9328 |
| hCV546493 | rs264126 | hCV29134277 | rs6595948 | 0.9 | 0.9001 |
| hCV546493 | rs264126 | hCV2961235 | rs6869219 | 0.9 | 0.9255 |
| hCV546493 | rs264126 | hCV2961239 | rs6868888 | 0.9 | 0.9282 |
| hCV546493 | rs264126 | hCV2961251 | rs1157409 | 0.9 | 0.9328 |
| hCV546493 | rs264126 | hCV8932783 | rs1473132 | 0.9 | 0.9328 |
| hCV767324 | rs687047 | hCV1056543 | rs688358 | 0.9 | 1 |
| hCV767324 | rs687047 | hCV1056544 | rs675163 | 0.9 | 1 |
| hCV767324 | rs687047 | hCV32014843 | rs11221075 | 0.9 | 1 |
| hCV767324 | rs687047 | hCV32014853 | rs11221097 | 0.9 | 1 |
| hCV8351640 | rs842796 | hCV9110432 | rs12025826 | 0.9 | 0.9273 |
| hCV8375036 | rs9960 | hCV1166092 | rs12406279 | 0.9 | 1 |
| hCV8375036 | rs9960 | hCV1166096 | rs12406643 | 0.9 | 1 |
| hCV8375036 | rs9960 | hDV70946874 | rs17386162 | 0.9 | 1 |
| hCV8375364 | rs966583 | hCV26441140 | rs9325191 | 0.9 | 1 |
| hCV8375364 | rs966583 | hCV2690333 | rs11178602 | 0.9 | 1 |
| hCV8375364 | rs966583 | hCV2690348 | rs11178594 | 0.9 | 1 |
| hCV8375364 | rs966583 | hCV2690350 | rs2132242 | 0.9 | 1 |
| hCV8375364 | rs966583 | hCV2690354 | rs11178589 | 0.9 | 1 |
| hCV8375364 | rs966583 | hCV2690362 | rs10879249 | 0.9 | 1 |
| hCV8375364 | rs966583 | hCV2690365 | rs11178583 | 0.9 | 1 |
| hCV8375364 | rs966583 | hCV2690375 | rs1567740 | 0.9 | 1 |
| hCV8375364 | rs966583 | hCV2690377 | rs10879245 | 0.9 | 1 |
| hCV8375364 | rs966583 | hCV2690378 | rs11178579 | 0.9 | 1 |

TABLE 3-continued

| Interrogated SNP (hCV #) | Interrogated SNP (rs #) | LD SNP (hCV #) | LD SNP (rs #) | Threshold r² | r² |
|---|---|---|---|---|---|
| hCV8375364 | rs966583 | hCV2690379 | rs10879242 | 0.9 | 1 |
| hCV8375364 | rs966583 | hCV2690380 | rs10506623 | 0.9 | 1 |
| hCV8375364 | rs966583 | hCV2690388 | rs2132241 | 0.9 | 1 |
| hCV8375364 | rs966583 | hCV31190567 | rs7311994 | 0.9 | 1 |
| hCV8375364 | rs966583 | hCV31190598 | rs12818936 | 0.9 | 1 |
| hCV8375364 | rs966583 | hCV8871988 | rs1495375 | 0.9 | 1 |
| hCV8375364 | rs966583 | hCV8871989 | rs1512989 | 0.9 | 1 |
| hCV8375364 | rs966583 | hCV8871990 | rs1512988 | 0.9 | 1 |
| hCV8375364 | rs966583 | hCV8873466 | rs1051344 | 0.9 | 1 |
| hCV8375364 | rs966583 | hCV8873472 | rs1355373 | 0.9 | 1 |
| hCV8719512 | rs4773 | hCV8719513 | rs1266483 | 0.9 | 0.9781 |
| hCV8719512 | rs4773 | hCV8719628 | rs1266489 | 0.9 | 1 |
| hCV8719628 | rs1266489 | hCV12100073 | rs871078 | 0.9 | 0.9543 |
| hCV8719628 | rs1266489 | hCV27008723 | rs2677744 | 0.9 | 0.955 |
| hCV8719628 | rs1266489 | hCV2979204 | rs734252 | 0.9 | 1 |
| hCV8719628 | rs1266489 | hCV8718176 | rs1550636 | 0.9 | 0.955 |
| hCV8719628 | rs1266489 | hCV8719512 | rs4773 | 0.9 | 1 |
| hCV8719628 | rs1266489 | hCV8719513 | rs1266483 | 0.9 | 1 |
| hCV8793528 | rs9857 | hCV1973774 | rs1483301 | 0.9 | 1 |
| hCV8873448 | rs3844207 | hCV2690291 | rs2270588 | 0.9 | 1 |
| hCV8873448 | rs3844207 | hCV2690292 | rs2270589 | 0.9 | 0.9298 |
| hCV8905894 | rs974950 | hCV16126066 | rs2110564 | 0.9 | 1 |
| hCV8905894 | rs974950 | hCV2676440 | rs6722640 | 0.9 | 1 |
| hCV8905894 | rs974950 | hCV27872026 | rs4851531 | 0.9 | 0.9812 |
| hCV8905894 | rs974950 | hCV349805 | rs4851529 | 0.9 | 0.9303 |
| hCV8932829 | rs1116596 | hCV11819780 | rs12153185 | 0.9 | 0.9232 |
| hCV8932829 | rs1116596 | hCV11819782 | rs12719415 | 0.9 | 0.927 |
| hCV8932829 | rs1116596 | hCV2575318 | rs7711358 | 0.9 | 1 |
| hCV8932829 | rs1116596 | hCV2575336 | rs2418541 | 0.9 | 1 |
| hCV8932829 | rs1116596 | hCV2575340 | rs11242020 | 0.9 | 1 |
| hCV8932829 | rs1116596 | hCV26478747 | rs2190598 | 0.9 | 0.9239 |
| hCV8932829 | rs1116596 | hCV26478763 | rs2418542 | 0.9 | 1 |
| hCV8932829 | rs1116596 | hCV27996154 | rs4836502 | 0.9 | 0.927 |
| hCV8932829 | rs1116596 | hCV2961244 | rs2418548 | 0.9 | 0.9232 |
| hCV8932829 | rs1116596 | hCV2961250 | rs4836507 | 0.9 | 0.927 |
| hCV8932829 | rs1116596 | hCV2961252 | rs10067895 | 0.9 | 0.927 |
| hCV8932829 | rs1116596 | hCV2961253 | rs2190600 | 0.9 | 0.927 |
| hCV8932829 | rs1116596 | hCV2961260 | rs11242022 | 0.9 | 0.9232 |
| hCV8932829 | rs1116596 | hCV2961261 | rs11242021 | 0.9 | 0.9255 |
| hCV8932829 | rs1116596 | hCV2961267 | rs1476714 | 0.9 | 0.9607 |
| hCV8932829 | rs1116596 | hCV2961268 | rs2108425 | 0.9 | 0.927 |
| hCV8932829 | rs1116596 | hCV2961269 | rs2158958 | 0.9 | 0.927 |
| hCV8932829 | rs1116596 | hCV2961270 | rs9327555 | 0.9 | 0.927 |
| hCV8932829 | rs1116596 | hCV2961278 | rs7446891 | 0.9 | 0.927 |
| hCV8932829 | rs1116596 | hCV2961280 | rs10520072 | 0.9 | 0.927 |
| hCV8932829 | rs1116596 | hCV2961282 | rs917295 | 0.9 | 0.927 |
| hCV8932829 | rs1116596 | hCV2961284 | rs10054055 | 0.9 | 0.9616 |
| hCV8932829 | rs1116596 | hCV2961296 | rs10051148 | 0.9 | 0.9623 |
| hCV8932829 | rs1116596 | hCV2961297 | rs2158961 | 0.9 | 0.9634 |
| hCV8932829 | rs1116596 | hCV2961306 | rs264129 | 0.9 | 0.9232 |
| hCV8932829 | rs1116596 | hCV30621656 | rs10478919 | 0.9 | 1 |
| hCV8932829 | rs1116596 | hCV31237567 | rs11749272 | 0.9 | 1 |
| hCV8932829 | rs1116596 | hCV346713 | rs1990023 | 0.9 | 1 |
| hCV8932829 | rs1116596 | hCV546489 | rs264122 | 0.9 | 0.9616 |
| hCV9110432 | rs12025826 | hCV8351640 | rs842796 | 0.9 | 0.9273 |
| hCV940416 | rs498657 | hCV3125582 | rs2243708 | 0.9 | 1 |
| hDV70820190 | rs17035071 | hDV70820183 | rs17035064 | 0.9 | 1 |
| hDV70820190 | rs17035071 | hDV70820188 | rs17035069 | 0.9 | 1 |
| hDV70936275 | rs17310169 | hDV70936277 | rs17310176 | 0.9 | 1 |
| hDV70936277 | rs17310176 | hDV70936275 | rs17310169 | 0.9 | 1 |
| hDV70985165 | rs17662322 | hDV70995198 | rs17718867 | 0.9 | 1 |
| hDV70995198 | rs17718867 | hDV70985165 | rs17662322 | 0.9 | 1 |
| hDV72015086 | rs7956274 | hCV11686367 | rs7955901 | 0.9 | 1 |
| hDV72015086 | rs7956274 | hCV171102 | rs7313973 | 0.9 | 0.9584 |
| hDV72015086 | rs7956274 | hCV240133 | rs4760895 | 0.9 | 0.9649 |
| hDV72015086 | rs7956274 | hCV240134 | rs7138300 | 0.9 | 0.9622 |
| hDV72015086 | rs7956274 | hCV2745800 | rs11178531 | 0.9 | 0.9261 |
| hDV72015086 | rs7956274 | hCV2745805 | rs7132840 | 0.9 | 0.9261 |
| hDV72015086 | rs7956274 | hCV2745815 | rs1512991 | 0.9 | 1 |
| hDV72015086 | rs7956274 | hCV2745822 | rs1913201 | 0.9 | 0.9622 |
| hDV72015086 | rs7956274 | hCV2745828 | rs10879240 | 0.9 | 0.9285 |
| hDV72015086 | rs7956274 | hCV27952502 | rs4760894 | 0.9 | 0.9649 |
| hDV72015086 | rs7956274 | hCV27952503 | rs4760785 | 0.9 | 0.9649 |
| hDV72015086 | rs7956274 | hCV29120310 | rs7298255 | 0.9 | 1 |
| hDV72015086 | rs7956274 | hCV31190748 | rs7959965 | 0.9 | 1 |

TABLE 3-continued

| Interrogated SNP (hCV #) | Interrogated SNP (rs #) | LD SNP (hCV #) | LD SNP (rs #) | Threshold $r^2$ | $r^2$ |
|---|---|---|---|---|---|
| hDV72015086 | rs7956274 | hCV31190777 | rs10784891 | 0.9 | 1 |
| hDV76981734 | rs4251569 | hCV27943699 | rs4238087 | 0.9 | 1 |

TABLE 4

| Marker | allele A1 (non-ref) | allele A2 (ref) | Meta-analysis | | | | CARE | | | | | |
|---|---|---|---|---|---|---|---|---|---|---|---|---|
| | | | OR | OR L95 | OR U95 | P value | Prava Count | Placebo Count | OR | OR L95 | OR U95 | P value | Source |
| rs2157673 | G | A | 1.50 | 1.26 | 1.78 | 5.54E−06 | 50/156/151 | 28/189/227 | 1.47 | 1.18 | 1.82 | 5.43E−04 | Caseonly |
| rs12155847 | G | A | 1.66 | 1.32 | 2.09 | 1.80E−05 | 47/174/136 | 45/173/226 | 1.69 | 1.27 | 2.24 | 3.58E−04 | Caseonly |
| rs9292827 | A | G | 0.34 | 0.20 | 0.56 | 3.46E−05 | 1/14/342 | 1/47/395 | 0.37 | 0.20 | 0.67 | 1.08E−03 | Caseonly |
| rs2695026 | A | G | 0.67 | 0.55 | 0.81 | 3.85E−05 | 18/116/221 | 43/164/236 | 0.70 | 0.55 | 0.88 | 2.23E−03 | Caseonly |
| rs205279 | A | G | 1.81 | 1.36 | 2.41 | 4.59E−05 | 5/78/274 | 2/61/381 | 1.94 | 1.36 | 2.76 | 2.54E−04 | Caseonly |
| rs17706237 | G | A | 1.69 | 1.31 | 2.19 | 5.77E−05 | 13/111/176 | 13/94/275 | 1.80 | 1.31 | 2.49 | 3.42E−04 | CaseOnly |
| rs10120126 | G | A | 0.51 | 0.37 | 0.71 | 5.98E−05 | 4/43/253 | 11/87/284 | 0.53 | 0.36 | 0.78 | 1.55E−03 | CaseOnly |
| rs1948 | A | G | 1.66 | 1.29 | 2.13 | 6.47E−05 | 40/134/126 | 38/146/198 | 1.52 | 1.12 | 2.07 | 7.49E−03 | CaseOnly |
| rs10088505 | A | G | 1.61 | 1.27 | 2.03 | 6.58E−05 | 38/180/139 | 51/177/215 | 1.52 | 1.14 | 2.03 | 4.28E−03 | Caseonly |
| rs354342 | A | G | 0.67 | 0.55 | 0.82 | 6.82E−05 | 17/115/225 | 37/171/236 | 0.70 | 0.55 | 0.89 | 3.07E−03 | Caseonly |
| rs1035618 | A | C | 1.42 | 1.19 | 1.68 | 6.96E−05 | 45/169/140 | 39/181/219 | 1.38 | 1.12 | 1.71 | 2.98E−03 | Caseonly |
| rs238272 | A | G | 1.45 | 1.21 | 1.74 | 7.57E−05 | 35/139/126 | 28/149/205 | 1.44 | 1.14 | 1.82 | 2.44E−03 | CaseOnly |
| rs10849442 | A | G | 0.57 | 0.43 | 0.75 | 8.56E−05 | 57/207/93 | 112/220/112 | 0.56 | 0.39 | 0.80 | 1.36E−03 | Caseonly |
| rs2376764 | A | G | 0.56 | 0.41 | 0.74 | 8.56E−05 | 55/185/117 | 103/220/121 | 0.61 | 0.42 | 0.88 | 8.65E−03 | Caseonly |
| rs2273816 | A | G | 1.61 | 1.27 | 2.05 | 8.70E−05 | 9/87/204 | 5/81/296 | 1.56 | 1.15 | 2.12 | 4.66E−03 | CaseOnly |
| rs2941528 | A | G | 0.67 | 0.54 | 0.82 | 1.79E−04 | 13/111/176 | 29/162/191 | 0.72 | 0.56 | 0.93 | 1.31E−02 | CaseOnly |
| rs1615197 | G | A | 1.80 | 1.25 | 2.60 | 1.71E−03 | 56/146/98 | 61/158/163 | 1.54 | 1.12 | 2.11 | 7.76E−03 | CaseOnly |
| rs1349282 | A | G | 0.55 | 0.44 | 0.69 | 3.97E−07 | 254/731/509 | 290/709/472 | 0.55 | 0.41 | 0.74 | 1.05E−04 | cohort |
| rs4986146 | A | G | 0.63 | 0.53 | 0.76 | 4.36E−07 | 109/579/807 | 89/562/818 | 0.62 | 0.49 | 0.77 | 2.63E−05 | cohort |
| rs3213616 | A | G | 0.62 | 0.51 | 0.76 | 2.68E−06 | 74/479/933 | 75/465/920 | 0.62 | 0.49 | 0.80 | 1.60E−04 | cohort |
| rs2008165 | G | A | 0.59 | 0.47 | 0.73 | 2.77E−06 | 650/115/728 | 676/99/695 | 0.57 | 0.43 | 0.76 | 1.06E−04 | cohort |
| rs10500736 | G | A | 0.57 | 0.45 | 0.72 | 2.82E−06 | 254/1214/1417 | 130/603/700 | 0.61 | 0.45 | 0.83 | 1.62E−03 | cohort |
| rs7705993 | G | A | 1.48 | 1.24 | 1.76 | 9.34E−06 | 370/724/401 | 333/755/382 | 1.50 | 1.21 | 1.85 | 1.98E−04 | cohort |
| rs12556591 | G | A | 0.59 | 0.47 | 0.75 | 1.04E−05 | 625/114/755 | 665/95/710 | 0.57 | 0.43 | 0.75 | 7.93E−05 | cohort |
| rs2534752 | G | A | 1.65 | 1.32 | 2.07 | 1.17E−05 | 63/485/947 | 51/467/951 | 1.60 | 1.19 | 2.15 | 1.67E−03 | cohort |
| rs4830819 | G | A | 0.60 | 0.48 | 0.75 | 1.36E−05 | 641/113/740 | 673/97/699 | 0.57 | 0.43 | 0.76 | 8.61E−05 | cohort |
| rs10189905 | C | A | 0.52 | 0.39 | 0.70 | 1.52E−05 | 12/256/1227 | 13/281/1177 | 0.50 | 0.34 | 0.73 | 3.92E−04 | cohort |
| rs316720 | G | A | 0.71 | 0.61 | 0.83 | 2.28E−05 | 223/758/514 | 265/690/516 | 0.67 | 0.55 | 0.82 | 1.19E−04 | cohort |
| rs3998860 | A | G | 0.61 | 0.49 | 0.77 | 2.29E−05 | 129/851/1903 | 75/416/941 | 0.58 | 0.44 | 0.76 | 7.97E−05 | cohort |
| rs3732788 | G | A | 0.51 | 0.38 | 0.70 | 2.57E−05 | 16/212/1267 | 14/275/1180 | 0.56 | 0.38 | 0.81 | 2.46E−03 | cohort |
| rs669684 | G | A | 0.72 | 0.62 | 0.84 | 2.85E−05 | 260/758/476 | 309/690/472 | 0.69 | 0.56 | 0.84 | 2.75E−04 | cohort |
| rs2418412 | G | A | 1.94 | 1.42 | 2.65 | 3.05E−05 | 270/722/502 | 272/703/494 | 2.20 | 1.48 | 3.25 | 8.63E−05 | cohort |
| rs13279522 | G | A | 0.62 | 0.50 | 0.78 | 3.67E−05 | 51/391/1053 | 51/438/971 | 0.62 | 0.47 | 0.83 | 1.13E−03 | cohort |
| rs7193741 | A | C | 2.04 | 1.45 | 2.86 | 3.91E−05 | 233/716/546 | 212/700/559 | 2.16 | 1.39 | 3.36 | 6.33E−04 | cohort |
| rs151806 | G | A | 0.63 | 0.50 | 0.78 | 4.01E−05 | 78/545/871 | 75/578/816 | 0.60 | 0.45 | 0.80 | 4.38E−04 | cohort |
| rs9446187 | A | G | 1.96 | 1.42 | 2.72 | 4.36E−05 | 19/268/1208 | 16/238/1217 | 1.92 | 1.28 | 2.87 | 1.53E−03 | cohort |
| rs2793086 | C | A | 0.65 | 0.53 | 0.80 | 4.71E−05 | 53/498/944 | 55/441/975 | 0.61 | 0.47 | 0.80 | 2.19E−04 | cohort |
| rs17076974 | A | G | 1.40 | 1.19 | 1.65 | 5.58E−05 | 361/727/405 | 323/756/392 | 1.46 | 1.18 | 1.81 | 4.91E−04 | cohort |
| rs4924215 | A | G | 1.65 | 1.29 | 2.11 | 5.58E−05 | 215/1214/1535 | 106/594/769 | 1.77 | 1.30 | 2.39 | 2.41E−04 | cohort |
| rs1884897 | A | G | 2.07 | 1.45 | 2.95 | 5.65E−05 | 214/702/578 | 192/687/591 | 2.24 | 1.45 | 3.46 | 2.93E−04 | cohort |
| rs610118 | G | A | 0.49 | 0.34 | 0.69 | 5.81E−05 | 24/201/1269 | 15/201/1253 | 0.43 | 0.28 | 0.66 | 1.35E−04 | cohort |
| rs7179134 | A | G | 3.52 | 1.90 | 6.52 | 6.11E−05 | 67/464/964 | 64/466/941 | 3.54 | 1.54 | 8.15 | 2.91E−03 | cohort |
| rs4993917 | A | C | 0.60 | 0.47 | 0.77 | 6.48E−05 | 322/746/427 | 320/722/429 | 0.57 | 0.42 | 0.77 | 3.33E−04 | cohort |
| rs7671659 | A | G | 1.60 | 1.27 | 2.02 | 6.68E−05 | 59/427/1009 | 58/430/983 | 1.72 | 1.28 | 2.32 | 3.19E−04 | cohort |
| rs10889215 | A | G | 1.63 | 1.28 | 2.06 | 6.72E−05 | 35/297/1162 | 30/280/1158 | 1.50 | 1.13 | 1.99 | 5.01E−03 | cohort |
| rs9487284 | A | G | 0.64 | 0.52 | 0.80 | 6.85E−05 | 212/634/648 | 163/669/673 | 0.61 | 0.46 | 0.81 | 4.52E−04 | cohort |
| rs7742508 | A | G | 2.08 | 1.45 | 2.99 | 6.86E−05 | 13/205/1277 | 6/192/1272 | 2.19 | 1.37 | 3.49 | 9.74E−04 | cohort |
| rs2492367 | A | G | 0.61 | 0.47 | 0.78 | 7.23E−05 | 16/325/1153 | 17/307/1146 | 0.56 | 0.40 | 0.77 | 4.19E−04 | cohort |
| rs10429616 | G | A | 1.85 | 1.36 | 2.50 | 7.30E−05 | 276/736/481 | 282/699/488 | 2.07 | 1.41 | 3.04 | 2.21E−04 | cohort |
| rs2069542 | A | G | 1.62 | 1.28 | 2.05 | 7.35E−05 | 103/802/2061 | 44/398/1029 | 1.67 | 1.26 | 2.22 | 3.45E−04 | cohort |
| rs10155047 | A | G | 0.55 | 0.41 | 0.74 | 7.66E−05 | 18/215/1262 | 15/273/1183 | 0.59 | 0.40 | 0.85 | 5.11E−03 | cohort |
| rs4626316 | A | G | 0.35 | 0.21 | 0.59 | 8.00E−05 | 10/94/1388 | 13/98/1358 | 0.34 | 0.18 | 0.64 | 7.09E−04 | cohort |
| rs17138705 | A | G | 0.59 | 0.45 | 0.77 | 8.17E−05 | 25/336/1134 | 36/343/1092 | 0.54 | 0.39 | 0.74 | 1.78E−04 | cohort |
| rs10494924 | C | A | 0.64 | 0.51 | 0.80 | 9.70E−05 | 143/606/744 | 141/639/760 | 0.61 | 0.46 | 0.81 | 6.69E−04 | cohort |
| rs33910446 | A | G | 2.24 | 1.49 | 3.36 | 1.02E−04 | 128/573/791 | 107/558/804 | 2.24 | 1.34 | 3.75 | 1.99E−03 | cohort |
| rs1051344 | G | C | 0.64 | 0.51 | 0.80 | 1.07E−04 | 262/694/537 | 253/734/484 | 0.64 | 0.48 | 0.86 | 2.62E−03 | cohort |
| rs10444402 | G | A | 0.69 | 0.57 | 0.83 | 1.16E−04 | 74/522/899 | 102/500/868 | 0.71 | 0.57 | 0.89 | 3.33E−03 | cohort |
| rs7612715 | A | G | 0.50 | 0.35 | 0.71 | 1.21E−04 | 18/161/1316 | 8/160/1303 | 0.47 | 0.30 | 0.73 | 9.43E−04 | cohort |
| rs4243071 | G | A | 0.43 | 0.28 | 0.66 | 1.22E−04 | 274/1165/1527 | 143/535/793 | 0.44 | 0.26 | 0.76 | 2.80E−03 | cohort |
| rs624460 | A | G | 0.73 | 0.63 | 0.86 | 1.24E−04 | 208/651/635 | 216/667/588 | 0.73 | 0.60 | 0.90 | 2.54E−03 | cohort |
| rs4866354 | G | A | 0.35 | 0.20 | 0.59 | 1.25E−04 | 0/102/1392 | 0/107/1363 | 0.36 | 0.19 | 0.67 | 1.19E−03 | cohort |
| rs945020 | A | G | 0.65 | 0.52 | 0.81 | 1.33E−04 | 390/1333/1162 | 203/669/561 | 0.61 | 0.45 | 0.81 | 6.95E−04 | cohort |
| rs9859901 | A | C | 0.52 | 0.38 | 0.73 | 1.37E−04 | 17/214/1264 | 16/270/1185 | 0.59 | 0.41 | 0.86 | 5.91E−03 | cohort |

TABLE 4-continued

| | | | | | | | | | | | | | |
|---|---|---|---|---|---|---|---|---|---|---|---|---|---|
| rs7629632 | G | A | 1.62 | 1.26 | 2.07 | 1.38E−04 | 171/687/637 | 169/638/664 | 1.56 | 1.15 | 2.12 | 4.23E−03 | cohort |
| rs17740227 | G | A | 1.70 | 1.29 | 2.23 | 1.45E−04 | 21/306/1166 | 21/295/1155 | 1.80 | 1.28 | 2.53 | 6.94E−04 | cohort |
| rs2263920 | G | A | 0.46 | 0.31 | 0.69 | 1.45E−04 | 197/704/593 | 207/668/596 | 0.49 | 0.30 | 0.79 | 3.40E−03 | cohort |
| rs1538185 | A | G | 1.60 | 1.26 | 2.05 | 1.51E−04 | 69/499/927 | 52/432/987 | 1.75 | 1.28 | 2.41 | 5.47E−04 | cohort |
| rs2843171 | A | G | 0.64 | 0.51 | 0.81 | 1.54E−04 | 103/585/806 | 124/584/761 | 0.67 | 0.50 | 0.88 | 4.44E−03 | cohort |
| rs4726711 | G | A | 0.71 | 0.59 | 0.85 | 1.61E−04 | 217/674/604 | 197/712/562 | 0.75 | 0.60 | 0.94 | 1.19E−02 | cohort |
| rs2263901 | G | A | 1.48 | 1.21 | 1.81 | 1.63E−04 | 84/533/876 | 61/508/899 | 1.43 | 1.11 | 1.84 | 5.41E−03 | cohort |
| rs5021480 | A | C | 1.78 | 1.32 | 2.40 | 1.67E−04 | 544/1410/929 | 254/697/481 | 1.72 | 1.18 | 2.52 | 4.85E−03 | cohort |
| rs1877986 | A | G | 0.62 | 0.48 | 0.80 | 1.73E−04 | 569/1391/924 | 283/699/451 | 0.57 | 0.41 | 0.78 | 5.70E−04 | cohort |
| rs11610993 | G | A | 0.43 | 0.28 | 0.67 | 1.76E−04 | 6/131/1358 | 3/140/1328 | 0.41 | 0.25 | 0.69 | 7.19E−04 | cohort |
| rs1864924 | G | A | 1.40 | 1.17 | 1.67 | 1.78E−04 | 210/620/664 | 192/652/627 | 1.42 | 1.15 | 1.77 | 1.40E−03 | cohort |
| rs17347854 | G | A | 0.61 | 0.48 | 0.79 | 1.79E−04 | 40/356/1099 | 38/404/1028 | 0.61 | 0.44 | 0.84 | 2.13E−03 | cohort |
| rs13137776 | G | A | 0.70 | 0.58 | 0.84 | 1.83E−04 | 148/636/711 | 158/661/652 | 0.74 | 0.59 | 0.94 | 1.18E−02 | cohort |
| rs3759607 | G | A | 1.96 | 1.38 | 2.78 | 1.90E−04 | 4/209/1281 | 4/165/1302 | 2.10 | 1.35 | 3.28 | 1.06E−03 | cohort |
| rs9896077 | G | A | 0.66 | 0.53 | 0.82 | 2.07E−04 | 209/677/608 | 196/699/576 | 0.63 | 0.47 | 0.83 | 1.35E−03 | cohort |
| rs10935907 | G | A | 1.59 | 1.24 | 2.03 | 2.12E−04 | 112/544/838 | 80/535/856 | 1.65 | 1.21 | 2.23 | 1.37E−03 | cohort |
| rs7625204 | A | G | 1.45 | 1.19 | 1.77 | 2.24E−04 | 119/980/1866 | 52/488/931 | 1.51 | 1.16 | 1.96 | 2.11E−03 | cohort |
| rs13431868 | A | G | 1.59 | 1.24 | 2.03 | 2.24E−04 | 82/554/857 | 71/538/860 | 1.70 | 1.25 | 2.31 | 7.44E−04 | cohort |
| rs2231496 | G | A | 0.72 | 0.60 | 0.86 | 2.27E−04 | 133/622/740 | 140/618/713 | 0.74 | 0.60 | 0.92 | 6.39E−03 | cohort |
| rs1705244 | G | A | 0.60 | 0.46 | 0.79 | 2.28E−04 | 650/1518/798 | 307/782/382 | 0.65 | 0.46 | 0.91 | 1.20E−02 | cohort |
| rs2274473 | G | A | 0.55 | 0.40 | 0.75 | 2.28E−04 | 27/264/1202 | 26/297/1147 | 0.58 | 0.39 | 0.85 | 5.84E−03 | cohort |
| rs5750116 | G | A | 1.55 | 1.23 | 1.97 | 2.28E−04 | 139/685/671 | 129/641/701 | 1.63 | 1.20 | 2.22 | 1.69E−03 | cohort |
| rs912366 | G | A | 1.66 | 1.27 | 2.18 | 2.29E−04 | 31/393/1071 | 21/357/1093 | 1.60 | 1.14 | 2.24 | 6.82E−03 | cohort |
| rs1544214 | A | G | 1.38 | 1.16 | 1.64 | 2.36E−04 | 461/1344/1080 | 212/678/543 | 1.40 | 1.13 | 1.74 | 2.38E−03 | cohort |
| rs1861326 | A | G | 0.64 | 0.51 | 0.82 | 2.44E−04 | 226/692/577 | 238/710/521 | 0.63 | 0.47 | 0.85 | 1.90E−03 | cohort |
| rs2265346 | C | A | 0.54 | 0.39 | 0.75 | 2.59E−04 | 20/249/1226 | 20/287/1164 | 0.60 | 0.40 | 0.90 | 1.27E−02 | cohort |
| rs7521242 | A | G | 0.72 | 0.61 | 0.86 | 2.77E−04 | 630/1424/829 | 326/707/398 | 0.71 | 0.57 | 0.88 | 2.19E−03 | cohort |
| rs10305439 | A | C | 0.62 | 0.48 | 0.80 | 2.78E−04 | 245/729/521 | 269/745/457 | 0.62 | 0.45 | 0.85 | 2.76E−03 | cohort |
| rs1167245 | A | G | 0.62 | 0.47 | 0.80 | 2.79E−04 | 350/728/417 | 369/693/408 | 0.68 | 0.50 | 0.92 | 1.29E−02 | cohort |
| rs2495295 | G | A | 0.66 | 0.52 | 0.82 | 2.89E−04 | 136/608/751 | 143/629/697 | 0.65 | 0.49 | 0.87 | 3.00E−03 | cohort |
| rs312929 | G | A | 0.75 | 0.64 | 0.87 | 2.96E−04 | 202/704/589 | 224/698/549 | 0.72 | 0.59 | 0.88 | 1.71E−03 | cohort |
| rs969356 | G | A | 0.63 | 0.49 | 0.81 | 3.10E−04 | 207/675/612 | 192/716/561 | 0.69 | 0.51 | 0.94 | 2.00E−02 | cohort |
| rs5017584 | A | G | 1.74 | 1.29 | 2.36 | 3.25E−04 | 279/720/496 | 245/694/531 | 1.61 | 1.10 | 2.37 | 1.46E−02 | cohort |
| rs6491586 | G | A | 1.65 | 1.26 | 2.18 | 3.26E−04 | 28/377/1090 | 21/336/1114 | 1.59 | 1.13 | 2.24 | 8.26E−03 | cohort |
| rs842796 | A | G | 1.59 | 1.23 | 2.05 | 3.30E−04 | 248/697/550 | 219/684/568 | 1.72 | 1.26 | 2.37 | 7.49E−04 | cohort |
| rs4869033 | G | A | 0.36 | 0.21 | 0.63 | 3.53E−04 | 244/1142/1580 | 135/569/767 | 0.31 | 0.16 | 0.63 | 1.20E−03 | cohort |
| rs10973013 | A | G | 0.55 | 0.40 | 0.77 | 3.59E−04 | 21/256/1218 | 21/297/1153 | 0.59 | 0.40 | 0.88 | 9.32E−03 | cohort |
| rs886469 | G | A | 0.64 | 0.50 | 0.82 | 3.96E−04 | 199/671/625 | 184/708/579 | 0.70 | 0.51 | 0.95 | 2.12E−02 | cohort |
| rs11076320 | C | A | 0.65 | 0.52 | 0.83 | 4.01E−04 | 233/691/568 | 249/708/512 | 0.64 | 0.48 | 0.86 | 2.64E−03 | cohort |
| rs2145540 | A | G | 0.56 | 0.40 | 0.77 | 4.02E−04 | 18/247/1230 | 14/282/1175 | 0.51 | 0.35 | 0.75 | 5.69E−04 | cohort |
| rs6505669 | G | A | 1.58 | 1.22 | 2.03 | 4.18E−04 | 59/496/940 | 52/463/956 | 1.70 | 1.24 | 2.34 | 9.67E−04 | cohort |
| rs9375683 | G | A | 1.49 | 1.19 | 1.87 | 4.39E−04 | 86/527/882 | 67/465/939 | 1.63 | 1.22 | 2.18 | 8.91E−04 | cohort |
| rs10814422 | G | A | 0.57 | 0.42 | 0.78 | 4.75E−04 | 28/284/1182 | 30/309/1130 | 0.64 | 0.44 | 0.92 | 1.72E−02 | cohort |
| rs72746987 | A | G | 0.40 | 0.24 | 0.67 | 4.89E−04 | 3/96/1396 | 4/139/1328 | 0.43 | 0.24 | 0.80 | 7.44E−03 | cohort |
| rs13318232 | G | A | 0.52 | 0.36 | 0.75 | 5.01E−04 | 17/212/1266 | 18/264/1189 | 0.60 | 0.40 | 0.90 | 1.34E−02 | cohort |
| rs2268650 | A | G | 0.66 | 0.53 | 0.84 | 5.28E−04 | 190/697/608 | 215/695/560 | 0.64 | 0.48 | 0.85 | 2.27E−03 | cohort |
| rs4682522 | C | A | 0.55 | 0.39 | 0.77 | 5.52E−04 | 29/417/2519 | 18/224/1229 | 0.59 | 0.39 | 0.90 | 1.55E−02 | cohort |
| rs3798544 | A | G | 1.57 | 1.21 | 2.03 | 5.87E−04 | 32/400/1062 | 42/342/1087 | 1.47 | 1.08 | 2.02 | 1.55E−02 | cohort |
| rs6080603 | A | C | 0.62 | 0.47 | 0.81 | 5.91E−04 | 93/835/2038 | 46/443/982 | 0.59 | 0.42 | 0.83 | 2.06E−03 | cohort |
| rs10517923 | A | G | 1.61 | 1.23 | 2.12 | 5.93E−04 | 352/720/422 | 311/730/429 | 1.62 | 1.16 | 2.26 | 4.84E−03 | cohort |
| rs2104506 | A | C | 0.71 | 0.59 | 0.87 | 5.99E−04 | 114/593/788 | 106/608/757 | 0.75 | 0.59 | 0.96 | 2.07E−02 | cohort |
| rs2023650 | A | G | 0.71 | 0.59 | 0.87 | 6.11E−04 | 81/533/878 | 98/523/846 | 0.76 | 0.60 | 0.96 | 2.20E−02 | cohort |
| rs8051893 | A | G | 0.67 | 0.53 | 0.84 | 6.22E−04 | 424/1374/1167 | 216/699/555 | 0.69 | 0.52 | 0.92 | 1.05E−02 | cohort |
| rs8109631 | A | G | 1.53 | 1.20 | 1.96 | 6.35E−04 | 119/625/749 | 109/573/789 | 1.53 | 1.13 | 2.07 | 6.36E−03 | cohort |
| rs331555 | A | C | 0.74 | 0.62 | 0.88 | 6.42E−04 | 245/1285/1432 | 141/632/695 | 0.72 | 0.58 | 0.89 | 2.91E−03 | cohort |
| rs1343563 | C | A | 0.60 | 0.45 | 0.81 | 6.82E−04 | 22/273/1199 | 23/301/1145 | 0.61 | 0.43 | 0.88 | 6.99E−03 | cohort |
| rs11082492 | A | C | 1.55 | 1.20 | 2.00 | 6.99E−04 | 31/369/1095 | 27/347/1095 | 1.46 | 1.07 | 1.99 | 1.65E−02 | cohort |
| rs17546598 | A | G | 1.71 | 1.25 | 2.33 | 7.18E−04 | 22/465/2471 | 10/210/1247 | 1.57 | 1.08 | 2.28 | 1.91E−02 | cohort |
| rs1382787 | G | A | 1.35 | 1.13 | 1.61 | 7.52E−04 | 558/1447/961 | 288/679/504 | 1.37 | 1.10 | 1.69 | 4.46E−03 | cohort |
| rs6075209 | A | G | 0.64 | 0.50 | 0.83 | 7.71E−04 | 499/1425/1042 | 275/687/509 | 0.63 | 0.46 | 0.86 | 3.35E−03 | cohort |
| rs11925875 | A | G | 0.66 | 0.52 | 0.84 | 7.79E−04 | 271/707/516 | 304/700/467 | 0.72 | 0.53 | 0.97 | 3.13E−02 | cohort |
| rs13314266 | G | A | 0.51 | 0.35 | 0.76 | 8.20E−04 | 9/185/1301 | 11/228/1231 | 0.60 | 0.40 | 0.91 | 1.49E−02 | cohort |
| rs3000490 | G | A | 1.38 | 1.14 | 1.66 | 8.36E−04 | 248/1186/1532 | 118/575/778 | 1.45 | 1.15 | 1.83 | 1.71E−03 | cohort |
| rs4289236 | A | G | 1.41 | 1.15 | 1.72 | 8.44E−04 | 68/450/975 | 74/406/990 | 1.37 | 1.08 | 1.75 | 1.04E−02 | cohort |
| rs2060411 | A | G | 1.39 | 1.15 | 1.69 | 8.75E−04 | 228/1159/1579 | 97/568/806 | 1.37 | 1.07 | 1.74 | 1.10E−02 | cohort |
| rs4643388 | G | A | 1.34 | 1.12 | 1.59 | 9.82E−04 | 166/639/690 | 123/628/720 | 1.32 | 1.07 | 1.62 | 1.06E−02 | cohort |
| rs9436636 | A | G | 1.35 | 1.13 | 1.61 | 1.02E−03 | 446/1361/1079 | 200/680/554 | 1.34 | 1.08 | 1.67 | 8.75E−03 | cohort |
| rs7327364 | A | G | 0.68 | 0.53 | 0.85 | 1.05E−03 | 249/686/560 | 218/746/507 | 0.69 | 0.52 | 0.93 | 1.30E−02 | cohort |
| rs2626130 | G | A | 1.32 | 1.11 | 1.55 | 1.17E−03 | 471/1436/978 | 220/698/515 | 1.29 | 1.05 | 1.58 | 1.61E−02 | cohort |
| rs4611134 | A | G | 1.55 | 1.19 | 2.01 | 1.20E−03 | 388/723/377 | 322/721/419 | 1.54 | 1.11 | 2.14 | 1.05E−02 | cohort |
| rs17716275 | A | G | 2.03 | 1.32 | 3.13 | 1.32E−03 | 7/286/2593 | 3/128/1303 | 1.91 | 1.11 | 3.29 | 2.01E−02 | cohort |
| rs7094941 | G | A | 0.74 | 0.62 | 0.89 | 1.36E−03 | 160/670/665 | 188/640/643 | 0.78 | 0.63 | 0.98 | 3.41E−02 | cohort |
| rs1076733 | A | G | 0.67 | 0.53 | 0.86 | 1.37E−03 | 258/765/471 | 294/740/433 | 0.70 | 0.52 | 0.95 | 2.12E−02 | cohort |
| rs2290193 | C | A | 0.47 | 0.30 | 0.75 | 1.38E−03 | 253/1183/1529 | 142/574/755 | 0.53 | 0.31 | 0.92 | 2.33E−02 | cohort |
| rs10103297 | A | G | 2.03 | 1.31 | 3.13 | 1.46E−03 | 9/146/1339 | 7/114/1348 | 1.84 | 1.12 | 3.04 | 1.64E−02 | cohort |
| rs12657484 | G | A | 1.49 | 1.16 | 1.90 | 1.49E−03 | 133/632/727 | 107/581/782 | 1.36 | 1.01 | 1.85 | 4.48E−02 | cohort |
| rs7910196 | G | A | 1.47 | 1.16 | 1.87 | 1.59E−03 | 42/391/1062 | 26/338/1106 | 1.36 | 1.01 | 1.82 | 4.11E−02 | cohort |
| rs7767024 | A | G | 1.42 | 1.14 | 1.77 | 1.78E−03 | 37/388/1070 | 45/361/1065 | 1.32 | 1.01 | 1.72 | 4.01E−02 | cohort |
| rs1474396 | A | C | 1.46 | 1.15 | 1.86 | 1.87E−03 | 277/717/501 | 272/684/515 | 1.35 | 1.00 | 1.81 | 4.91E−02 | cohort |
| rs1182878 | A | G | 0.78 | 0.66 | 0.91 | 1.97E−03 | 314/718/462 | 319/711/440 | 0.79 | 0.65 | 0.96 | 1.81E−02 | cohort |

TABLE 4-continued

| | | | | | | | | | | | | | |
|---|---|---|---|---|---|---|---|---|---|---|---|---|---|
| rs2483641 | A | G | 0.59 | 0.43 | 0.83 | 2.06E−03 | 14/230/1250 | 16/279/1174 | 0.65 | 0.43 | 0.97 | 3.34E−02 | cohort |
| rs453625 | A | G | 0.62 | 0.46 | 0.85 | 2.44E−03 | 18/236/1240 | 19/288/1164 | 0.66 | 0.46 | 0.95 | 2.70E−02 | cohort |
| rs7497613 | A | G | 0.55 | 0.37 | 0.81 | 2.66E−03 | 649/1470/765 | 331/720/382 | 0.65 | 0.46 | 0.91 | 1.17E−02 | cohort |
| rs2129571 | A | G | 0.53 | 0.34 | 0.80 | 2.81E−03 | 17/215/1263 | 14/269/1186 | 0.62 | 0.43 | 0.90 | 1.22E−02 | cohort |
| rs16861467 | G | A | 0.49 | 0.31 | 0.78 | 2.93E−03 | 15/205/1275 | 12/258/1201 | 0.60 | 0.41 | 0.87 | 7.69E−03 | cohort |
| rs10088524 | G | A | 1.57 | 1.17 | 2.11 | 3.00E−03 | 14/255/1226 | 10/212/1249 | 1.46 | 1.00 | 2.11 | 4.73E−02 | cohort |
| rs10875941 | G | A | 0.63 | 0.45 | 0.89 | 9.49E−03 | 118/582/795 | 141/581/748 | 0.73 | 0.54 | 0.99 | 4.41E−02 | cohort |
| rs7616936 | C | A | 1.77 | 1.15 | 2.72 | 9.52E−03 | 26/335/1133 | 24/279/1166 | 1.47 | 1.01 | 2.14 | 4.46E−02 | cohort |
| rs6911817 | A | G | 2.85 | 1.25 | 6.50 | 1.28E−02 | 2/80/1413 | 2/58/1411 | 2.15 | 1.08 | 4.25 | 2.83E−02 | cohort |
| rs9658127 | A | G | 2.79 | 1.15 | 6.77 | 2.36E−02 | 2/83/1409 | 2/60/1409 | 2.03 | 1.05 | 3.93 | 3.58E−02 | cohort |

WOSCOPS

| Marker | Prava Count | Placebo Count | OR | OR L95 | OR U95 | P value | Source | Model | End-point |
|---|---|---|---|---|---|---|---|---|---|
| rs2157673 | 24/85/75 | 19/93/135 | 1.56 | 1.16 | 2.09 | 2.99E−03 | Caseonly | add | CVD |
| rs12155847 | 18/90/76 | 19/99/129 | 1.61 | 1.09 | 2.37 | 1.71E−02 | Caseonly | dom | CVD |
| rs9292827 | 2/3/179 | 1/22/224 | 0.27 | 0.10 | 0.73 | 9.50E−03 | Caseonly | dom | CVD |
| rs2695026 | 5/52/124 | 16/92/137 | 0.61 | 0.43 | 0.86 | 4.67E−03 | Caseonly | add | CVD |
| rs205279 | 0/43/141 | 0/39/208 | 1.60 | 0.99 | 2.60 | 5.76E−02 | Caseonly | add | CVD |
| rs17706237 | 7/61/91 | 9/65/150 | 1.52 | 1.00 | 2.31 | 5.28E−02 | CaseOnly | dom | CHD |
| rs10120126 | 3/16/139 | 5/44/175 | 0.48 | 0.27 | 0.86 | 1.30E−02 | CaseOnly | dom | CHD |
| rs1948 | 19/88/52 | 27/88/109 | 1.96 | 1.29 | 3.00 | 1.83E−03 | CaseOnly | dom | CHD |
| rs10088505 | 24/87/70 | 23/93/127 | 1.78 | 1.20 | 2.63 | 4.27E−03 | Caseonly | dom | CVD |
| rs354342 | 5/51/128 | 15/90/142 | 0.62 | 0.44 | 0.87 | 6.35E−03 | Caseonly | add | CVD |
| rs1035618 | 31/86/66 | 23/111/111 | 1.48 | 1.11 | 1.98 | 7.61E−03 | Caseonly | add | CVD |
| rs238272 | 32/64/63 | 22/94/108 | 1.46 | 1.09 | 1.96 | 1.07E−02 | CaseOnly | add | CHD |
| rs10849442 | 37/100/46 | 73/100/74 | 0.59 | 0.37 | 0.93 | 2.26E−02 | Caseonly | rec | CVD |
| rs2376764 | 30/99/55 | 71/117/58 | 0.48 | 0.29 | 0.77 | 2.46E−03 | Caseonly | rec | CVD |
| rs2273816 | 10/46/103 | 5/49/170 | 1.69 | 1.16 | 2.47 | 6.17E−03 | CaseOnly | add | CHD |
| rs2941528 | 12/50/96 | 21/112/91 | 0.58 | 0.41 | 0.81 | 1.38E−03 | CaseOnly | add | CHD |
| rs1615197 | 38/81/40 | 28/98/98 | 2.25 | 1.44 | 3.52 | 3.75E−04 | CaseOnly | dom | CHD |
| rs1349282 | 459/1274/924 | 469/1271/918 | 0.55 | 0.38 | 0.79 | 1.10E−03 | cohort | dom | CVD |
| rs4986146 | 175/1031/1436 | 181/1039/1427 | 0.66 | 0.50 | 0.88 | 4.63E−03 | cohort | add | CVD |
| rs3213616 | 77/807/1767 | 79/852/1727 | 0.62 | 0.45 | 0.87 | 5.26E−03 | cohort | add | CVD |
| rs2008165 | 1301/6/1343 | 1261/4/1393 | 0.62 | 0.43 | 0.89 | 9.37E−03 | cohort | add | CHD |
| rs10500736 | 230/1135/1290 | 256/1109/1296 | 0.52 | 0.36 | 0.75 | 4.18E−04 | cohort | dom | CHD |
| rs7705993 | 44/77/38 | 38/117/69 | 1.44 | 1.07 | 1.94 | 1.57E−02 | CaseOnly | add | CHD |
| rs12556591 | 66/0/93 | 115/0/109 | 0.66 | 0.44 | 1.00 | 4.88E−02 | CaseOnly | add | CHD |
| rs2534752 | 112/890/1649 | 129/915/1613 | 1.74 | 1.22 | 2.47 | 2.10E−03 | cohort | dom | CVD |
| rs4830819 | 66/0/93 | 115/0/109 | 0.66 | 0.44 | 1.00 | 4.88E−02 | CaseOnly | add | CHD |
| rs10189905 | 15/496/2143 | 30/434/2195 | 0.56 | 0.36 | 0.88 | 1.21E−02 | cohort | add | CHD |
| rs316720 | 531/1320/796 | 540/1301/814 | 0.78 | 0.61 | 1.00 | 4.57E−02 | cohort | add | CVD |
| rs3998860 | 3/44/112 | 6/80/138 | 0.70 | 0.47 | 1.05 | 8.17E−02 | CaseOnly | add | CHD |
| rs3732788 | 0/21/138 | 3/53/168 | 0.44 | 0.26 | 0.75 | 2.64E−03 | CaseOnly | add | CHD |
| rs669684 | 633/1333/689 | 626/1318/715 | 0.77 | 0.60 | 0.97 | 3.00E−02 | cohort | add | CVD |
| rs2418412 | 450/1353/847 | 454/1264/942 | 1.58 | 0.96 | 2.62 | 7.27E−02 | cohort | rec | CHD |
| rs13279522 | 73/693/1889 | 57/696/1911 | 0.63 | 0.44 | 0.90 | 1.12E−02 | cohort | add | CHD |
| rs7193741 | 368/1263/1022 | 372/1225/1064 | 1.87 | 1.10 | 3.18 | 2.01E−02 | cohort | rec | CHD |
| rs151806 | 142/909/1597 | 124/918/1611 | 0.67 | 0.47 | 0.96 | 2.92E−02 | cohort | dom | CVD |
| rs9446187 | 11/338/2307 | 8/305/2347 | 2.05 | 1.19 | 3.53 | 9.61E−03 | cohort | dom | CHD |
| rs2793086 | 3/56/125 | 11/85/151 | 0.72 | 0.50 | 1.02 | 6.63E−02 | Caseonly | add | CVD |
| rs17076974 | 594/1320/729 | 578/1344/726 | 1.32 | 1.02 | 1.71 | 3.48E−02 | cohort | add | CHD |
| rs4924215 | 12/67/80 | 19/71/134 | 1.46 | 0.97 | 2.21 | 6.97E−02 | CaseOnly | dom | CHD |
| rs1884897 | 26/73/60 | 22/116/86 | 1.78 | 0.97 | 3.29 | 6.31E−02 | CaseOnly | rec | CHD |
| rs610118 | 1/18/165 | 1/37/209 | 0.62 | 0.34 | 1.12 | 1.10E−01 | Caseonly | dom | CVD |
| rs7179134 | 102/858/1693 | 109/872/1674 | 3.50 | 1.40 | 8.72 | 7.28E−03 | cohort | rec | CVD |
| rs4993917 | 37/89/58 | 52/136/59 | 0.67 | 0.43 | 1.03 | 6.44E−02 | Caseonly | dom | CVD |
| rs7671659 | 81/726/1845 | 59/733/1863 | 1.43 | 0.99 | 2.07 | 5.96E−02 | cohort | dom | CVD |
| rs10889215 | 30/407/2217 | 21/395/2247 | 1.95 | 1.27 | 3.00 | 2.22E−03 | cohort | add | CVD |
| rs9487284 | 293/1216/1142 | 335/1259/1063 | 0.70 | 0.50 | 0.99 | 4.62E−02 | cohort | dom | CVD |
| rs7742508 | 0/296/2357 | 0/257/2401 | 1.93 | 1.09 | 3.43 | 2.42E−02 | cohort | dom | CHD |
| rs2492367 | 44/578/2033 | 42/585/2033 | 0.68 | 0.46 | 1.00 | 4.80E−02 | cohort | add | CVD |
| rs10429616 | 481/1361/815 | 479/1282/901 | 1.54 | 0.94 | 2.51 | 8.52E−02 | cohort | rec | CHD |
| rs2069542 | 1/49/109 | 1/51/172 | 1.49 | 0.96 | 2.32 | 7.85E−02 | CaseOnly | add | CHD |
| rs10155047 | 18/437/2201 | 30/467/2163 | 0.50 | 0.31 | 0.80 | 4.45E−03 | cohort | add | CVD |
| rs4626316 | 3/118/2537 | 3/111/2547 | 0.38 | 0.15 | 0.97 | 4.23E−02 | cohort | dom | CVD |
| rs17138705 | 0/32/127 | 6/51/167 | 0.70 | 0.44 | 1.11 | 1.28E−01 | CaseOnly | add | CHD |
| rs10494924 | 19/65/100 | 22/115/110 | 0.68 | 0.46 | 1.00 | 5.11E−02 | Caseonly | dom | CVD |
| rs33910446 | 24/74/85 | 16/113/118 | 2.23 | 1.14 | 4.34 | 1.87E−02 | Caseonly | rec | CVD |
| rs1051344 | 431/1243/981 | 416/1234/1008 | 0.64 | 0.45 | 0.92 | 1.47E−02 | cohort | add | CVD |
| rs10444402 | 7/62/115 | 18/103/126 | 0.65 | 0.47 | 0.91 | 1.12E−02 | Caseonly | add | CVD |
| rs7612715 | 6/242/2408 | 12/257/2393 | 0.55 | 0.31 | 0.99 | 4.49E−02 | cohort | add | CVD |
| rs4243071 | 11/76/97 | 32/91/124 | 0.41 | 0.20 | 0.85 | 1.56E−02 | Caseonly | rec | CVD |
| rs624460 | 350/1250/1054 | 389/1245/1022 | 0.74 | 0.57 | 0.95 | 1.78E−02 | cohort | add | CVD |
| rs4866354 | 0/4/180 | 0/16/231 | 0.31 | 0.10 | 0.94 | 3.92E−02 | Caseonly | dom | CVD |
| rs945020 | 385/1221/1049 | 395/1260/1003 | 0.72 | 0.51 | 1.01 | 5.77E−02 | cohort | dom | CVD |
| rs9859901 | 0/20/139 | 3/53/168 | 0.41 | 0.24 | 0.72 | 1.59E−03 | CaseOnly | add | CHD |
| rs7629632 | 15/83/60 | 22/87/115 | 1.72 | 1.13 | 2.60 | 1.10E−02 | CaseOnly | dom | CHD |

TABLE 4-continued

| | | | | | | | | | |
|---|---|---|---|---|---|---|---|---|---|
| rs17740227 | 0/48/136 | 2/45/200 | 1.53 | 0.96 | 2.42 | 7.13E−02 | Caseonly | dom | CVD |
| rs2263920 | 11/71/77 | 36/100/88 | 0.41 | 0.20 | 0.84 | 1.42E−02 | CaseOnly | rec | CHD |
| rs1538185 | 101/868/1686 | 109/864/1680 | 1.41 | 0.96 | 2.07 | 7.60E−02 | cohort | dom | CHD |
| rs2843171 | 15/58/111 | 20/109/118 | 0.61 | 0.41 | 0.89 | 1.16E−02 | Caseonly | dom | CVD |
| rs4726711 | 15/62/82 | 33/109/82 | 0.62 | 0.45 | 0.85 | 2.88E−03 | CaseOnly | add | CHD |
| rs2263901 | 11/62/86 | 10/62/152 | 1.57 | 1.12 | 2.21 | 9.90E−03 | CaseOnly | add | CHD |
| rs5021480 | 45/77/62 | 37/106/104 | 1.87 | 1.15 | 3.04 | 1.21E−02 | Caseonly | rec | CVD |
| rs1877986 | 494/1321/831 | 518/1314/820 | 0.71 | 0.48 | 1.05 | 8.37E−02 | cohort | dom | CHD |
| rs11610993 | 0/8/176 | 0/20/227 | 0.49 | 0.21 | 1.14 | 9.82E−02 | Caseonly | dom | CVD |
| rs1864924 | 28/68/63 | 19/106/99 | 1.36 | 1.00 | 1.84 | 4.79E−02 | CaseOnly | add | CHD |
| rs17347854 | 3/41/140 | 13/70/164 | 0.62 | 0.41 | 0.96 | 3.17E−02 | Caseonly | dom | CVD |
| rs13137776 | 11/47/101 | 27/86/111 | 0.62 | 0.45 | 0.86 | 3.72E−03 | CaseOnly | add | CHD |
| rs3759607 | 0/29/130 | 2/24/198 | 1.73 | 0.97 | 3.09 | 6.18E−02 | CaseOnly | dom | CHD |
| rs9896077 | 353/1151/1146 | 406/1253/996 | 0.71 | 0.50 | 1.00 | 5.20E−02 | cohort | dom | CVD |
| rs10935907 | 5/74/80 | 17/72/135 | 1.49 | 0.99 | 2.25 | 5.72E−02 | CaseOnly | dom | CHD |
| rs7625204 | 131/897/1628 | 118/925/1616 | 1.38 | 1.02 | 1.87 | 3.67E−02 | cohort | add | CHD |
| rs13431868 | 8/68/83 | 10/77/137 | 1.42 | 0.94 | 2.14 | 9.94E−02 | CaseOnly | dom | CHD |
| rs2231496 | 8/73/103 | 26/107/114 | 0.67 | 0.49 | 0.91 | 1.13E−02 | Caseonly | add | CVD |
| rs1705244 | 37/65/57 | 52/123/49 | 0.52 | 0.33 | 0.82 | 5.01E−03 | CaseOnly | dom | CHD |
| rs2274473 | 2/17/140 | 3/46/175 | 0.48 | 0.27 | 0.85 | 1.21E−02 | CaseOnly | dom | CHD |
| rs5750116 | 296/1113/1245 | 232/1174/1254 | 1.45 | 1.01 | 2.09 | 4.63E−02 | cohort | dom | CHD |
| rs912366 | 6/50/103 | 7/45/172 | 1.79 | 1.14 | 2.81 | 1.13E−02 | CaseOnly | dom | CHD |
| rs1544214 | 42/66/51 | 37/102/85 | 1.35 | 1.02 | 1.78 | 3.72E−02 | CaseOnly | add | CHD |
| rs1861326 | 28/84/72 | 32/141/74 | 0.67 | 0.45 | 1.00 | 4.96E−02 | Caseonly | dom | CVD |
| rs2265346 | 2/15/141 | 3/46/173 | 0.42 | 0.23 | 0.76 | 4.46E−03 | CaseOnly | dom | CHD |
| rs7521242 | 31/80/48 | 59/114/51 | 0.74 | 0.55 | 1.00 | 4.85E−02 | CaseOnly | add | CHD |
| rs10305439 | 30/71/58 | 37/125/60 | 0.63 | 0.40 | 0.98 | 3.91E−02 | CaseOnly | dom | CHD |
| rs1167245 | 45/78/61 | 63/134/50 | 0.51 | 0.33 | 0.79 | 2.73E−03 | Caseonly | dom | CVD |
| rs2495295 | 19/63/102 | 22/114/111 | 0.66 | 0.45 | 0.98 | 3.73E−02 | Caseonly | dom | CVD |
| rs312929 | 350/1243/1054 | 406/1240/1014 | 0.79 | 0.61 | 1.01 | 6.04E−02 | cohort | add | CVD |
| rs969356 | 15/62/82 | 31/110/83 | 0.54 | 0.36 | 0.82 | 3.60E−03 | CaseOnly | dom | CHD |
| rs5017584 | 45/76/63 | 35/108/104 | 1.98 | 1.21 | 3.24 | 6.65E−03 | Caseonly | rec | CVD |
| rs6491586 | 6/48/105 | 6/44/174 | 1.78 | 1.13 | 2.80 | 1.37E−02 | CaseOnly | dom | CHD |
| rs842796 | 22/80/57 | 39/88/97 | 1.38 | 0.91 | 2.10 | 1.35E−01 | CaseOnly | dom | CHD |
| rs4869033 | 7/81/96 | 18/106/123 | 0.47 | 0.19 | 1.15 | 9.76E−02 | CaseOnly | rec | CVD |
| rs10973013 | 2/17/140 | 3/46/174 | 0.48 | 0.27 | 0.85 | 1.16E−02 | CaseOnly | dom | CHD |
| rs886469 | 15/62/82 | 29/111/84 | 0.55 | 0.36 | 0.83 | 4.53E−03 | CaseOnly | dom | CHD |
| rs11076320 | 28/85/71 | 31/141/73 | 0.68 | 0.45 | 1.02 | 6.00E−02 | Caseonly | dom | CVD |
| rs2145540 | 1/18/165 | 2/32/213 | 0.70 | 0.38 | 1.27 | 2.37E−01 | Caseonly | dom | CVD |
| rs6505669 | 10/59/90 | 9/71/144 | 1.37 | 0.90 | 2.09 | 1.36E−01 | CaseOnly | dom | CHD |
| rs9375683 | 128/942/1584 | 132/928/1601 | 1.31 | 0.92 | 1.86 | 1.36E−01 | cohort | dom | CVD |
| rs10814422 | 2/18/139 | 3/50/170 | 0.46 | 0.26 | 0.80 | 6.31E−03 | CaseOnly | dom | CHD |
| rs72746987 | 2/4/178 | 1/21/225 | 0.34 | 0.14 | 0.86 | 2.29E−02 | Caseonly | dom | CVD |
| rs13318232 | 0/20/139 | 3/54/167 | 0.40 | 0.23 | 0.71 | 1.55E−03 | CaseOnly | dom | CHD |
| rs2268650 | 29/83/72 | 31/138/78 | 0.71 | 0.47 | 1.06 | 9.15E−02 | Caseonly | dom | CVD |
| rs4682522 | 0/21/138 | 1/51/172 | 0.49 | 0.28 | 0.85 | 1.17E−02 | CaseOnly | dom | CHD |
| rs3798544 | 1/55/128 | 2/46/199 | 1.78 | 1.14 | 2.79 | 1.12E−02 | CaseOnly | dom | CHD |
| rs6080603 | 4/32/123 | 7/61/156 | 0.68 | 0.43 | 1.09 | 1.11E−01 | CaseOnly | dom | CHD |
| rs10517923 | 47/86/49 | 44/131/71 | 1.60 | 1.00 | 2.55 | 4.93E−02 | Caseonly | rec | CVD |
| rs2104506 | 15/47/97 | 23/104/97 | 0.65 | 0.47 | 0.90 | 8.45E−03 | CaseOnly | add | CHD |
| rs2023650 | 5/53/126 | 16/91/139 | 0.62 | 0.44 | 0.87 | 5.84E−03 | Caseonly | add | CVD |
| rs8051893 | 20/81/83 | 34/128/85 | 0.63 | 0.43 | 0.93 | 2.13E−02 | CaseOnly | dom | CVD |
| rs8109631 | 17/73/69 | 19/85/120 | 1.54 | 1.02 | 2.32 | 4.00E−02 | CaseOnly | dom | CHD |
| rs331555 | 12/83/89 | 31/108/108 | 0.77 | 0.57 | 1.04 | 8.69E−02 | Caseonly | add | CVD |
| rs1343563 | 1/20/138 | 3/46/175 | 0.58 | 0.34 | 0.97 | 3.81E−02 | CaseOnly | add | CHD |
| rs11082492 | 4/42/113 | 1/42/181 | 1.76 | 1.13 | 2.74 | 1.28E−02 | CaseOnly | add | CHD |
| rs17546598 | 1/34/149 | 0/25/222 | 2.07 | 1.19 | 3.61 | 1.02E−02 | Caseonly | dom | CVD |
| rs1382787 | 36/85/38 | 40/113/71 | 1.32 | 0.98 | 1.78 | 6.95E−02 | CaseOnly | add | CHD |
| rs6075209 | 26/75/58 | 40/123/61 | 0.68 | 0.44 | 1.07 | 9.33E−02 | CaseOnly | dom | CHD |
| rs11925875 | 26/83/75 | 48/129/70 | 0.57 | 0.38 | 0.85 | 6.05E−03 | Caseonly | dom | CVD |
| rs13314266 | 0/18/141 | 3/49/172 | 0.40 | 0.23 | 0.71 | 1.61E−03 | CaseOnly | add | CHD |
| rs3000490 | 15/72/72 | 16/91/117 | 1.25 | 0.91 | 1.72 | 1.72E−01 | CaseOnly | add | CHD |
| rs4289236 | 8/61/115 | 4/67/176 | 1.49 | 1.04 | 2.13 | 3.03E−02 | Caseonly | add | CVD |
| rs2060411 | 17/71/71 | 12/95/117 | 1.44 | 1.03 | 2.00 | 3.07E−02 | CaseOnly | add | CHD |
| rs4643388 | 20/80/84 | 16/98/133 | 1.38 | 1.02 | 1.86 | 3.61E−02 | CaseOnly | add | CVD |
| rs9436636 | 27/81/51 | 28/102/93 | 1.36 | 1.00 | 1.83 | 4.76E−02 | CaseOnly | add | CHD |
| rs7327364 | 29/81/74 | 37/136/74 | 0.64 | 0.43 | 0.96 | 3.08E−02 | Caseonly | dom | CVD |
| rs2626130 | 37/89/58 | 30/122/95 | 1.37 | 1.04 | 1.82 | 2.74E−02 | Caseonly | add | CVD |
| rs4611134 | 55/79/50 | 55/119/73 | 1.56 | 1.01 | 2.43 | 4.71E−02 | Caseonly | rec | CVD |
| rs17716275 | 1/20/138 | 0/14/210 | 2.26 | 1.11 | 4.62 | 2.45E−02 | CaseOnly | dom | CHD |
| rs7094941 | 14/64/81 | 27/116/81 | 0.66 | 0.48 | 0.91 | 1.06E−02 | CaseOnly | add | CHD |
| rs1076733 | 34/81/69 | 40/139/68 | 0.62 | 0.41 | 0.94 | 2.34E−02 | Caseonly | dom | CVD |
| rs2290193 | 7/80/97 | 26/100/121 | 0.35 | 0.15 | 0.83 | 1.66E−02 | Caseonly | rec | CVD |
| rs10103297 | 1/14/144 | 2/6/216 | 2.74 | 1.13 | 6.65 | 2.60E−02 | CaseOnly | dom | CHD |
| rs12657484 | 18/85/56 | 19/95/110 | 1.76 | 1.16 | 2.68 | 8.14E−03 | CaseOnly | add | CHD |
| rs7910196 | 4/54/101 | 2/54/168 | 1.72 | 1.14 | 2.59 | 1.01E−02 | CaseOnly | add | CHD |
| rs7767024 | 2/61/121 | 4/50/193 | 1.69 | 1.13 | 2.51 | 1.05E−02 | Caseonly | add | CVD |
| rs1474396 | 32/100/52 | 31/118/98 | 1.73 | 1.14 | 2.62 | 9.39E−03 | Caseonly | dom | CVD |
| rs1182878 | 41/80/63 | 57/137/53 | 0.75 | 0.57 | 0.99 | 4.36E−02 | Caseonly | add | CVD |
| rs2483641 | 2/17/140 | 3/44/177 | 0.50 | 0.28 | 0.89 | 1.93E−02 | CaseOnly | dom | CHD |

TABLE 4-continued

| Marker | | | | | | | | |
|---|---|---|---|---|---|---|---|---|
| rs453625 | 1/17/141 | 2/43/179 | 0.54 | 0.31 | 0.95 | 3.10E-02 | CaseOnly | add | CHD |
| rs7497613 | 29/102/53 | 74/125/48 | 0.43 | 0.26 | 0.70 | 6.18E-04 | Caseonly | rec | CVD |
| rs2129571 | 0/19/140 | 3/52/169 | 0.40 | 0.23 | 0.70 | 1.30E-03 | CaseOnly | add | CHD |
| rs16861467 | 0/18/141 | 3/53/168 | 0.37 | 0.21 | 0.65 | 5.20E-04 | CaseOnly | add | CHD |
| rs10088524 | 1/41/142 | 3/32/212 | 1.80 | 1.09 | 2.96 | 2.13E-02 | Caseonly | dom | CVD |
| rs10875941 | 2/55/101 | 20/97/107 | 0.51 | 0.34 | 0.78 | 1.71E-03 | CaseOnly | dom | CHD |
| rs7616936 | 0/42/117 | 2/28/194 | 2.30 | 1.36 | 3.88 | 1.83E-03 | CaseOnly | dom | CHD |
| rs6911817 | 0/12/172 | 0/3/244 | 5.32 | 1.47 | 19.19 | 1.08E-02 | Caseonly | add | CVD |
| rs9658127 | 0/12/172 | 0/3/244 | 5.32 | 1.47 | 19.19 | 1.08E-02 | Caseonly | add | CVD |

TABLE 5

| Marker | allele A1 (non-ref) | allele A2 (ref) | Meta-analysis | | | | CARE | | | | | | |
|---|---|---|---|---|---|---|---|---|---|---|---|---|---|
| | | | OR | OR L95 | OR U95 | P value (random) | Prava Count | Placebo Count | OR | OR L95 | OR U95 | P value | Source |
| rs11124322 | A | G | 0.64 | 0.50 | 0.82 | 3.92E-04 | 292/733/469 | 322/733/416 | 0.70 | 0.51 | 0.95 | 2.18E-02 | cohort |
| rs10193722 | C | A | | | | | 71/167/119 | 100/238/106 | 0.62 | 0.46 | 0.85 | 3.11E-03 | Caseonly |
| rs1051344 | C | G | 0.64 | 0.51 | 0.80 | 1.07E-04 | 262/694/537 | 253/734/484 | 0.64 | 0.48 | 0.86 | 2.62E-03 | cohort |
| rs1051334 | C | A | | | | | 52/149/156 | 73/230/140 | 0.58 | 0.44 | 0.78 | 3.23E-04 | Caseonly |
| rs2030057 | T | C | 0.60 | 0.47 | 0.75 | 1.18E-05 | 47/425/964 | 61/410/959 | 0.56 | 0.42 | 0.75 | 7.88E-05 | cohort |
| rs10740308 | A | C | | | | | 7/79/214 | 28/125/229 | 0.61 | 0.47 | 0.81 | 5.28E-04 | Caseonly |
| rs10831416 | G | A | 1.73 | 1.24 | 2.42 | 1.26E-03 | 253/707/534 | 233/665/573 | 1.61 | 1.08 | 2.42 | 2.09E-02 | cohort |
| rs10831415 | G | A | | | | | 62/144/94 | 50/179/153 | 1.77 | 1.17 | 2.67 | 7.05E-03 | Caseonly |
| rs4657668 | G | A | 1.34 | 1.14 | 1.58 | 4.33E-04 | 255/675/522 | 213/689/532 | 1.32 | 1.08 | 1.61 | 7.53E-03 | cohort |
| rs1229430 | G | A | | | | | 77/170/110 | 59/212/173 | 1.39 | 1.13 | 1.70 | 1.57E-03 | Caseonly |
| rs6497117 | C | T | 0.52 | 0.38 | 0.70 | 2.59E-05 | 308/744/395 | 328/721/382 | 0.58 | 0.40 | 0.85 | 5.29E-03 | cohort |
| rs12914132 | A | G | | | | | 52/159/89 | 97/179/106 | 0.60 | 0.41 | 0.87 | 7.98E-03 | Caseonly |
| rs1529806 | G | A | 1.42 | 1.17 | 1.73 | 3.89E-04 | 130/570/752 | 94/561/779 | 1.43 | 1.12 | 1.82 | 4.17E-03 | cohort |
| rs1594887 | G | A | | | | | 30/126/143 | 19/134/229 | 1.56 | 1.22 | 2.00 | 3.71E-04 | Caseonly |
| rs3732788 | C | T | 0.48 | 0.32 | 0.71 | 2.39E-04 | 16/212/1267 | 14/275/1180 | 0.56 | 0.38 | 0.81 | 2.46E-03 | cohort |
| rs16861476 | C | A | | | | | 1/35/263 | 5/83/294 | 0.47 | 0.31 | 0.71 | 2.92E-04 | Caseonly |
| rs1773549 | C | T | 1.45 | 1.18 | 1.78 | 3.68E-04 | 95/544/812 | 81/527/826 | 1.49 | 1.17 | 1.91 | 1.44E-03 | cohort |
| rs1737478 | A | G | | | | | 29/125/146 | 20/130/232 | 1.54 | 1.20 | 1.96 | 6.39E-04 | Caseonly |
| rs1560901 | A | G | 1.41 | 1.16 | 1.71 | 5.74E-04 | 125/573/753 | 94/551/789 | 1.41 | 1.10 | 1.80 | 5.75E-03 | cohort |
| rs2196180 | A | G | | | | | 28/126/146 | 19/132/231 | 1.53 | 1.20 | 1.96 | 7.53E-04 | Caseonly |
| rs231355 | G | C | 1.38 | 1.16 | 1.64 | 2.11E-04 | 357/708/387 | 325/704/403 | 1.30 | 1.05 | 1.61 | 1.65E-02 | cohort |
| rs231358 | G | A | | | | | 82/159/59 | 78/196/108 | 1.39 | 1.11 | 1.74 | 4.61E-03 | Caseonly |
| rs10875941 | C | T | 0.64 | 0.47 | 0.88 | 5.81E-03 | 118/582/795 | 141/581/748 | 0.73 | 0.54 | 0.99 | 4.41E-02 | cohort |
| rs2335451 | A | C | | | | | 21/111/168 | 44/157/181 | 0.70 | 0.51 | 0.95 | 2.33E-02 | Caseonly |
| rs9834251 | G | T | 1.75 | 1.29 | 2.38 | 3.12E-04 | 291/722/482 | 247/700/524 | 1.64 | 1.11 | 2.41 | 1.22E-02 | cohort |
| rs2358931 | G | A | | | | | 66/175/114 | 47/235/159 | 1.94 | 1.29 | 2.92 | 1.45E-03 | Caseonly |
| rs4765531 | A | C | 0.67 | 0.54 | 0.81 | 6.11E-05 | 91/566/795 | 113/564/757 | 0.70 | 0.55 | 0.90 | 5.60E-03 | cohort |
| rs2593270 | A | G | | | | | 13/111/176 | 33/162/187 | 0.69 | 0.53 | 0.88 | 3.56E-03 | Caseonly |
| rs4765531 | A | C | 0.66 | 0.54 | 0.81 | 4.85E-05 | 91/566/795 | 113/564/757 | 0.70 | 0.55 | 0.90 | 5.60E-03 | cohort |
| rs2656824 | A | G | | | | | 12/111/177 | 31/157/194 | 0.71 | 0.55 | 0.92 | 8.72E-03 | Caseonly |
| rs302290 | C | T | 1.56 | 1.24 | 1.97 | 1.65E-04 | 102/571/775 | 113/529/790 | 1.46 | 1.10 | 1.94 | 9.55E-03 | cohort |
| rs302296 | G | A | | | | | 28/144/183 | 31/140/273 | 1.54 | 1.15 | 2.05 | 3.34E-03 | Caseonly |
| rs3806005 | A | C | 2.25 | 1.58 | 3.21 | 8.04E-06 | 10/239/1203 | 9/207/1218 | 2.03 | 1.32 | 3.11 | 1.26E-03 | cohort |
| rs3793048 | A | C | | | | | 3/68/228 | 6/47/328 | 2.21 | 1.44 | 3.41 | 3.17E-04 | Caseonly |
| rs1560901 | A | G | 1.40 | 1.16 | 1.71 | 6.32E-04 | 125/573/753 | 94/551/789 | 1.41 | 1.10 | 1.80 | 5.75E-03 | cohort |
| rs3861810 | G | A | | | | | 28/127/145 | 19/132/231 | 1.54 | 1.20 | 1.97 | 5.90E-04 | Caseonly |
| rs7179134 | A | G | 3.72 | 2.01 | 6.89 | 2.88E-05 | | | | | | | |
| rs4128766 | A | G | | | | | 65/454/933 | 68/457/909 | 3.92 | 1.70 | 9.02 | 1.31E-03 | cohort |
| rs2148575 | A | G | 0.35 | 0.20 | 0.59 | 1.24E-04 | 7/96/1392 | 12/97/1362 | 0.36 | 0.19 | 0.67 | 1.17E-03 | cohort |
| rs4242084 | A | C | | | | | 0/12/345 | 4/38/402 | 0.26 | 0.12 | 0.55 | 4.34E-04 | Caseonly |
| rs5756670 | G | A | 1.75 | 1.33 | 2.29 | 5.75E-05 | 320/688/443 | 294/689/451 | 1.82 | 1.29 | 2.56 | 6.67E-04 | cohort |
| rs4328731 | A | C | | | | | 66/165/69 | 72/171/133 | 1.77 | 1.26 | 2.51 | 1.15E-03 | Caseonly |
| rs7094941 | G | A | 0.74 | 0.61 | 0.89 | 1.16E-03 | 160/670/665 | 188/640/643 | 0.78 | 0.63 | 0.98 | 3.41E-02 | cohort |
| rs4980176 | C | A | | | | | 26/131/143 | 54/177/151 | 0.75 | 0.59 | 0.95 | 1.67E-02 | Caseonly |
| rs1851830 | A | G | 1.73 | 1.24 | 2.42 | 1.29E-03 | 218/673/560 | 175/648/611 | 1.70 | 1.12 | 2.60 | 1.36E-02 | cohort |
| rs6550706 | A | G | | | | | 60/168/129 | 42/210/192 | 1.91 | 1.25 | 2.93 | 2.76E-03 | Caseonly |
| rs10275879 | T | A | 0.50 | 0.36 | 0.71 | 8.02E-05 | 349/746/400 | 363/746/362 | 0.44 | 0.30 | 0.65 | 3.29E-05 | cohort |
| rs6950121 | A | C | | | | | 44/168/88 | 105/188/89 | 0.44 | 0.29 | 0.66 | 6.20E-05 | Caseonly |
| rs7765440 | T | C | 2.00 | 1.49 | 2.68 | 4.37E-06 | 11/210/1229 | 16/215/1203 | 1.82 | 1.26 | 2.62 | 1.28E-03 | cohort |
| rs7751843 | A | G | | | | | 5/59/236 | 3/52/329 | 1.69 | 1.16 | 2.46 | 6.03E-03 | Caseonly |
| rs2030057 | T | C | 0.60 | 0.47 | 0.75 | 1.18E-03 | 47/425/964 | 61/410/959 | 0.56 | 0.42 | 0.75 | 7.88E-05 | cohort |
| rs7901888 | A | C | | | | | 6/80/214 | 27/124/231 | 0.62 | 0.47 | 0.82 | 6.91E-04 | Caseonly |
| rs3998860 | A | G | 0.61 | 0.49 | 0.77 | 2.29E-05 | 129/851/1903 | 75/416/941 | 0.58 | 0.44 | 0.76 | 7.97E-05 | cohort |
| rs7913568 | G | A | | | | | 6/79/215 | 31/121/228 | 0.57 | 0.43 | 0.76 | 9.24E-05 | Caseonly |
| rs6931627 | G | A | 0.74 | 0.63 | 0.87 | 3.01E-04 | 237/758/500 | 279/720/472 | 0.75 | 0.61 | 0.92 | 5.65E-03 | cohort |
| rs9467561 | A | C | | | | | 54/164/139 | 95/221/128 | 0.71 | 0.58 | 0.87 | 9.73E-04 | Caseonly |
| rs912366 | G | A | 1.61 | 1.23 | 2.11 | 6.04E-04 | 31/393/1071 | 21/357/1093 | 1.60 | 1.14 | 2.24 | 6.82E-03 | cohort |
| rs9554735 | A | G | | | | | 5/95/200 | 7/78/297 | 1.77 | 1.26 | 2.49 | 1.09E-03 | Caseonly |

TABLE 5-continued

| | | WOSCOPS | | | | | | | | |
|---|---|---|---|---|---|---|---|---|---|---|
| | Marker | Prava Count | Placebo Count | OR | OR L95 | OR U95 | P value | Source | Model | End-point |
| | rs11124322 | | | | | | | | dom | CVD |
| | rs10193722 | 32/81/71 | 50/133/64 | 0.55 | 0.36 | 0.83 | 4.27E−03 | Caseonly | dom | CVD |
| | rs1051344 | 431/1243/981 | 416/1234/1008 | 0.64 | 0.45 | 0.92 | 1.47E−02 | cohort | dom | CVD |
| | rs1051334 | 19/85/80 | 41/132/74 | 0.58 | 0.39 | 0.86 | 7.16E−03 | Caseonly | dom | CVD |
| | rs2030057 | | | | | | | | add | CHD |
| | rs10740308 | 3/41/115 | 6/79/139 | 0.66 | 0.44 | 0.99 | 4.49E−02 | Caseonly | add | CHD |
| | rs10831416 | | | | | | | | rec | CHD |
| | rs10831415 | 30/89/40 | 23/118/83 | 2.02 | 1.12 | 3.63 | 1.97E−02 | Caseonly | rec | CHD |
| | rs4657668 | | | | | | | | add | CVD |
| | rs1229430 | 33/87/64 | 31/105/111 | 1.38 | 1.05 | 1.82 | 2.11E−02 | Caseonly | add | CVD |
| | rs6497117 | | | | | | | | rec | CHD |
| | rs12914132 | 26/89/44 | 68/114/40 | 0.42 | 0.25 | 0.70 | 9.73E−04 | Caseonly | rec | CHD |
| | rs1529806 | | | | | | | | add | CHD |
| | rs1594887 | 17/72/70 | 13/95/116 | 1.42 | 1.02 | 1.97 | 3.63E−02 | Caseonly | add | CHD |
| | rs3732788 | | | | | | | | add | CHD |
| | rs16861476 | 0/18/141 | 3/53/168 | 0.37 | 0.21 | 0.65 | 5.20E−04 | Caseonly | add | CHD |
| | rs1773549 | | | | | | | | add | CHD |
| | rs1737478 | 6/62/91 | 8/66/150 | 1.36 | 0.94 | 1.95 | 9.86E−02 | Caseonly | add | CHD |
| | rs1560901 | | | | | | | | add | CHD |
| | rs2196180 | 17/71/71 | 13/94/117 | 1.41 | 1.02 | 1.95 | 3.97E−02 | Caseonly | add | CHD |
| | rs231355 | | | | | | | | add | CHD |
| | rs231358 | 58/70/31 | 53/103/68 | 1.54 | 1.16 | 2.04 | 2.94E−03 | Caseonly | add | CHD |
| | rs10875941 | | | | | | | | dom | CHD |
| | rs2335451 | 3/55/101 | 20/96/108 | 0.53 | 0.35 | 0.80 | 2.80E−03 | Caseonly | dom | CHD |
| | rs9834251 | | | | | | | | rec | CVD |
| | rs2358931 | 44/73/63 | 35/109/100 | 1.96 | 1.19 | 3.21 | 8.02E−03 | Caseonly | rec | CVD |
| | rs4765531 | | | | | | | | add | CHD |
| | rs2593270 | 7/52/100 | 28/84/112 | 0.61 | 0.44 | 0.84 | 2.90E−03 | Caseonly | add | CHD |
| | rs4765531 | | | | | | | | add | CHD |
| | rs2656824 | 7/51/101 | 28/84/112 | 0.60 | 0.43 | 0.83 | 2.14E−03 | Caseonly | add | CHD |
| | rs302290 | | | | | | | | dom | CVD |
| | rs302296 | 7/76/101 | 12/68/167 | 1.79 | 1.20 | 2.66 | 4.39E−03 | Caseonly | dom | CVD |
| | rs3806005 | | | | | | | | dom | CHD |
| | rs3793048 | 1/29/129 | 2/15/207 | 2.83 | 1.50 | 5.36 | 1.36E−03 | Caseonly | dom | CHD |
| | rs1560901 | | | | | | | | add | CHD |
| | rs3861810 | 17/72/70 | 14/94/116 | 1.40 | 1.01 | 1.93 | 4.41E−02 | Caseonly | add | CHD |
| | rs7179134 | 102/858/1693 | 109/872/1674 | 3.50 | 1.40 | 8.72 | 7.28E−03 | cohort | rec | CVD |
| | rs4128766 | 15/62/107 | 7/86/154 | 3.18 | 1.27 | 8.01 | 1.40E−02 | Caseonly | rec | CVD |
| | rs2148575 | | | | | | | | dom | CVD |
| | rs4242084 | 0/4/180 | 0/16/231 | 0.31 | 0.10 | 0.94 | 3.92E−02 | Caseonly | dom | CVD |
| | rs5756670 | | | | | | | | dom | CHD |
| | rs4328731 | 27/88/44 | 43/97/84 | 1.64 | 1.05 | 2.56 | 2.96E−02 | Caseonly | dom | CHD |
| | rs7094941 | | | | | | | | add | CHD |
| | rs4980176 | 13/64/81 | 26/117/81 | 0.64 | 0.47 | 0.89 | 8.15E−03 | Caseonly | add | CHD |
| | rs1851830 | | | | | | | | rec | CVD |
| | rs6550706 | 34/79/71 | 28/94/124 | 1.78 | 1.03 | 3.06 | 3.84E−02 | Caseonly | rec | CVD |
| | rs10275879 | | | | | | | | rec | CHD |
| | rs6950121 | 27/83/49 | 55/99/70 | 0.63 | 0.38 | 1.05 | 7.68E−02 | Caseonly | rec | CHD |
| | rs7765440 | | | | | | | | add | CHD |
| | rs7751843 | 2/41/115 | 1/28/194 | 2.38 | 1.44 | 3.93 | 7.17E−04 | Caseonly | add | CHD |
| | rs2030057 | | | | | | | | add | CHD |
| | rs7901888 | 3/41/115 | 6/79/139 | 0.66 | 0.44 | 0.99 | 4.49E−02 | Caseonly | add | CHD |
| | rs3998860 | | | | | | | | add | CHD |
| | rs7913568 | 3/44/112 | 6/80/138 | 0.70 | 0.47 | 1.05 | 8.17E−02 | Caseonly | add | CHD |
| | rs6931627 | | | | | | | | add | CVD |
| | rs9467561 | 23/94/67 | 55/119/73 | 0.72 | 0.54 | 0.95 | 1.92E−02 | Caseonly | add | CVD |
| | rs912366 | | | | | | | | dom | CHD |
| | rs9554735 | 6/46/107 | 6/45/173 | 1.64 | 1.04 | 2.58 | 3.48E−02 | Caseonly | dom | CHD |

TABLE 6

| Marker | allele A1 (non-ref) | allele A2 (ref) | Meta-analysis | | | | CARE | | | |
|---|---|---|---|---|---|---|---|---|---|---|
| | | | OR | OR L95 | OR U95 | P value (random) | Prava Count | Placebo Count | OR | OR L95 | OR U95 |
| rs13129010 | A | G | 1.65 | 1.30 | 2.08 | 3.28E−05 | 7/89/204 | 8/76/298 | 1.69 | 1.19 | 2.39 |
| rs4242281 | A | C | 1.93 | 1.41 | 2.64 | 3.42E−05 | 51/156/149 | 33/215/196 | 2.12 | 1.33 | 3.38 |
| rs6474228 | A | G | 1.54 | 1.25 | 1.90 | 5.17E−05 | 17/120/163 | 27/108/247 | 1.55 | 1.14 | 2.12 |
| rs4240808 | A | G | 0.61 | 0.48 | 0.77 | 5.59E−05 | 66/181/110 | 115/215/114 | 0.63 | 0.45 | 0.89 |
| rs13126170 | A | G | 0.65 | 0.52 | 0.80 | 6.32E−05 | 6/89/262 | 13/146/285 | 0.64 | 0.47 | 0.87 |

TABLE 6-continued

| | | | | | | | | | | |
|---|---|---|---|---|---|---|---|---|---|---|
| rs7916629 | G | A | 2.09 | 1.45 | 2.99 | 6.46E−05 | 43/136/176 | 25/184/235 | 2.33 | 1.39 | 3.92 |
| rs11721179 | A | C | 0.64 | 0.51 | 0.80 | 6.95E−05 | 11/85/261 | 21/140/283 | 0.65 | 0.48 | 0.89 |
| rs2993156 | A | G | 0.66 | 0.54 | 0.81 | 7.06E−05 | 9/96/252 | 29/157/257 | 0.57 | 0.42 | 0.77 |
| rs10774580 | A | G | 0.65 | 0.53 | 0.81 | 8.25E−05 | 48/125/127 | 56/196/130 | 0.72 | 0.53 | 0.99 |
| rs16885715 | G | A | 1.56 | 1.25 | 1.94 | 8.49E−05 | 17/95/188 | 15/85/282 | 1.71 | 1.23 | 2.38 |
| rs4870109 | A | G | 1.86 | 1.36 | 2.53 | 8.51E−05 | 51/156/148 | 35/213/194 | 2.01 | 1.27 | 3.19 |
| rs17688430 | A | C | 0.69 | 0.58 | 0.83 | 9.66E−05 | 7/96/254 | 18/155/271 | 0.65 | 0.50 | 0.85 |
| rs7332076 | A | G | 2.06 | 1.43 | 2.96 | 9.98E−05 | 35/147/174 | 26/195/223 | 1.83 | 1.07 | 3.13 |
| rs694780 | G | A | 0.55 | 0.41 | 0.75 | 1.26E−04 | 38/157/105 | 72/175/135 | 0.61 | 0.40 | 0.95 |
| rs4836745 | A | G | 0.68 | 0.56 | 0.83 | 1.30E−04 | 27/138/192 | 51/193/200 | 0.72 | 0.54 | 0.95 |
| rs7018577 | A | G | 1.50 | 1.22 | 1.86 | 1.44E−04 | 18/122/160 | 19/130/233 | 1.34 | 0.98 | 1.82 |
| rs11585647 | A | G | 0.62 | 0.48 | 0.79 | 1.46E−04 | 5/64/288 | 11/107/326 | 0.67 | 0.47 | 0.94 |
| rs4420312 | A | G | 0.66 | 0.54 | 0.82 | 1.51E−04 | 17/87/196 | 20/140/222 | 0.73 | 0.53 | 1.00 |
| rs7449527 | G | A | 1.52 | 1.21 | 1.91 | 2.61E−04 | 13/79/208 | 13/79/290 | 1.42 | 1.01 | 1.99 |
| rs7839562 | A | G | 1.52 | 1.21 | 1.91 | 2.75E−04 | 47/177/76 | 62/196/124 | 1.45 | 1.04 | 2.04 |
| rs2655222 | A | G | 0.29 | 0.15 | 0.57 | 3.05E−04 | 6/120/174 | 20/114/248 | 0.38 | 0.15 | 0.97 |
| rs2616548 | G | A | 1.57 | 1.23 | 2.00 | 3.23E−04 | 10/73/217 | 9/75/298 | 1.43 | 1.00 | 2.05 |
| rs10497883 | G | A | 0.71 | 0.59 | 0.86 | 3.37E−04 | 10/90/200 | 20/134/228 | 0.75 | 0.57 | 0.99 |
| rs6998016 | A | G | 3.99 | 1.83 | 8.72 | 5.20E−04 | 13/89/198 | 6/126/250 | 2.76 | 1.02 | 7.46 |
| rs11148285 | A | G | 1.88 | 1.32 | 2.70 | 5.49E−04 | 37/133/187 | 27/182/235 | 1.74 | 1.03 | 2.95 |
| rs7305949 | G | A | 2.22 | 1.62 | 3.04 | 5.97E−07 | 201/674/620 | 171/681/619 | 2.50 | 1.57 | 4.00 |
| rs264122 | A | G | 0.62 | 0.51 | 0.76 | 2.80E−06 | 183/654/658 | 200/642/629 | 0.54 | 0.40 | 0.73 |
| rs1009748 | A | G | 1.37 | 1.19 | 1.57 | 6.63E−06 | 214/663/617 | 176/665/629 | 1.35 | 1.10 | 1.65 |
| rs1336400 | A | G | 1.60 | 1.30 | 1.96 | 6.96E−06 | 306/1284/1371 | 152/631/686 | 1.87 | 1.38 | 2.54 |
| rs2108425 | A | G | 0.63 | 0.51 | 0.77 | 7.94E−06 | 181/652/661 | 201/643/624 | 0.55 | 0.40 | 0.74 |
| rs2327412 | G | A | 1.37 | 1.19 | 1.57 | 1.10E−05 | 215/665/615 | 183/664/623 | 1.34 | 1.10 | 1.64 |
| rs17002013 | A | G | 1.56 | 1.28 | 1.91 | 1.16E−05 | 89/477/929 | 61/487/923 | 1.63 | 1.22 | 2.17 |
| rs1015199 | G | A | 1.72 | 1.35 | 2.20 | 1.49E−05 | 18/281/1196 | 22/266/1183 | 1.63 | 1.14 | 2.33 |
| rs7078016 | C | A | 1.54 | 1.27 | 1.87 | 1.49E−05 | 282/1256/1343 | 136/621/675 | 1.68 | 1.26 | 2.23 |
| rs6585412 | A | G | 1.53 | 1.26 | 1.86 | 1.66E−05 | 281/1256/1347 | 136/618/678 | 1.68 | 1.26 | 2.23 |
| rs198476 | G | A | 1.67 | 1.32 | 2.11 | 1.91E−05 | 340/768/384 | 326/759/385 | 1.58 | 1.09 | 2.30 |
| rs2648694 | A | G | 1.98 | 1.44 | 2.72 | 2.42E−05 | 172/636/683 | 156/625/686 | 2.00 | 1.25 | 3.19 |
| rs10945874 | A | G | 1.58 | 1.28 | 1.96 | 2.89E−05 | 19/277/1197 | 23/270/1178 | 1.72 | 1.26 | 2.36 |
| rs1190706 | A | C | 0.67 | 0.56 | 0.81 | 3.38E−05 | 176/666/653 | 170/666/635 | 0.61 | 0.46 | 0.81 |
| rs3763978 | G | C | 0.75 | 0.66 | 0.86 | 3.75E−05 | 259/676/559 | 243/723/503 | 0.76 | 0.62 | 0.92 |
| rs11138314 | G | A | 0.64 | 0.51 | 0.79 | 3.78E−05 | 57/646/2183 | 29/302/1103 | 0.67 | 0.48 | 0.92 |
| rs13107334 | C | A | 0.65 | 0.53 | 0.80 | 4.01E−05 | 104/895/1967 | 52/452/967 | 0.67 | 0.49 | 0.90 |
| rs6685920 | A | G | 1.60 | 1.28 | 2.01 | 4.01E−05 | 18/382/1092 | 17/347/1104 | 1.83 | 1.32 | 2.54 |
| rs2616552 | A | C | 1.42 | 1.20 | 1.68 | 4.06E−05 | 97/494/904 | 95/475/901 | 1.39 | 1.09 | 1.78 |
| rs2110564 | A | C | 0.66 | 0.54 | 0.81 | 5.17E−05 | 260/679/556 | 227/753/490 | 0.76 | 0.57 | 1.01 |
| rs10012485 | G | A | 0.66 | 0.54 | 0.81 | 5.34E−05 | 66/494/931 | 58/525/885 | 0.76 | 0.57 | 1.01 |
| rs1798093 | G | A | 1.75 | 1.33 | 2.29 | 5.98E−05 | 241/690/564 | 183/758/530 | 1.69 | 1.10 | 2.61 |
| rs4787415 | A | G | 0.60 | 0.46 | 0.77 | 6.30E−05 | 323/714/414 | 325/743/364 | 0.64 | 0.44 | 0.92 |
| rs11734256 | G | A | 0.61 | 0.48 | 0.78 | 7.05E−05 | 645/1484/756 | 324/732/378 | 0.54 | 0.38 | 0.78 |
| rs1266489 | A | G | 0.67 | 0.55 | 0.81 | 7.06E−05 | 257/656/582 | 256/677/538 | 0.63 | 0.47 | 0.84 |
| rs238250 | A | C | 1.46 | 1.21 | 1.76 | 7.50E−05 | 62/704/2117 | 27/322/1083 | 1.65 | 1.23 | 2.22 |
| rs2588350 | A | G | 0.72 | 0.61 | 0.85 | 7.53E−05 | 57/508/928 | 79/507/883 | 0.69 | 0.54 | 0.87 |
| rs498657 | G | A | 1.47 | 1.21 | 1.77 | 9.18E−05 | 43/443/1007 | 46/403/1020 | 1.59 | 1.20 | 2.11 |
| rs6427807 | C | A | 0.68 | 0.56 | 0.83 | 9.43E−05 | 477/1399/1084 | 237/700/529 | 0.70 | 0.53 | 0.93 |
| rs619825 | G | A | 0.56 | 0.41 | 0.75 | 1.01E−04 | 238/719/536 | 247/673/551 | 0.62 | 0.41 | 0.94 |
| rs9478241 | G | A | 1.85 | 1.36 | 2.52 | 1.02E−04 | 193/661/640 | 158/705/605 | 1.86 | 1.18 | 2.95 |
| rs1727746 | A | G | 1.47 | 1.21 | 1.79 | 1.02E−04 | 216/667/612 | 169/670/632 | 1.57 | 1.18 | 2.08 |
| rs2505039 | A | G | 0.76 | 0.66 | 0.87 | 1.04E−04 | 370/670/455 | 300/766/405 | 0.69 | 0.56 | 0.86 |
| rs4472926 | G | A | 0.66 | 0.54 | 0.82 | 1.05E−04 | 154/685/656 | 177/679/615 | 0.74 | 0.54 | 1.00 |
| rs6539231 | A | G | 0.65 | 0.52 | 0.81 | 1.07E−04 | 326/757/412 | 356/736/379 | 0.62 | 0.46 | 0.86 |
| rs7959965 | A | G | 0.76 | 0.66 | 0.87 | 1.09E−04 | 328/718/448 | 319/766/386 | 0.77 | 0.64 | 0.94 |
| rs974950 | A | G | 0.67 | 0.55 | 0.82 | 1.13E−04 | 259/677/558 | 228/750/492 | 0.77 | 0.57 | 1.03 |
| rs1524962 | A | G | 0.72 | 0.60 | 0.85 | 1.14E−04 | 81/566/848 | 122/580/767 | 0.63 | 0.49 | 0.82 |
| rs17821383 | A | C | 0.30 | 0.16 | 0.55 | 1.15E−04 | 148/947/1791 | 78/476/880 | 0.24 | 0.09 | 0.64 |
| rs10518335 | A | G | 0.67 | 0.55 | 0.82 | 1.19E−04 | 59/493/942 | 57/525/889 | 0.76 | 0.57 | 1.02 |
| rs12265891 | A | C | 1.66 | 1.28 | 2.15 | 1.21E−04 | 690/1425/771 | 339/726/369 | 1.65 | 1.16 | 2.36 |
| rs4807536 | A | G | 2.00 | 1.40 | 2.85 | 1.22E−04 | 4/144/1346 | 7/126/1338 | 2.20 | 1.33 | 3.64 |
| rs9914580 | A | G | 0.64 | 0.51 | 0.80 | 1.22E−04 | 34/363/1098 | 29/380/1062 | 0.72 | 0.51 | 1.01 |
| rs646749 | A | G | 0.56 | 0.41 | 0.75 | 1.24E−04 | 236/723/536 | 239/683/548 | 0.62 | 0.41 | 0.95 |
| rs1003322 | A | C | 1.51 | 1.22 | 1.86 | 1.25E−04 | 72/516/907 | 67/505/899 | 1.57 | 1.15 | 2.13 |
| rs4660234 | A | G | 1.56 | 1.24 | 1.96 | 1.26E−04 | 18/382/1095 | 17/347/1105 | 1.86 | 1.31 | 2.65 |
| rs4038018 | G | A | 0.65 | 0.52 | 0.81 | 1.27E−04 | 304/693/498 | 271/747/453 | 0.65 | 0.47 | 0.90 |
| rs7710039 | G | A | 0.68 | 0.56 | 0.83 | 1.32E−04 | 137/588/769 | 134/612/725 | 0.69 | 0.52 | 0.91 |
| rs13150189 | A | G | 1.48 | 1.21 | 1.81 | 1.33E−04 | 111/911/1941 | 43/443/983 | 1.38 | 1.04 | 1.85 |
| rs12646525 | A | G | 0.68 | 0.55 | 0.83 | 1.34E−04 | 65/504/926 | 60/526/885 | 0.75 | 0.57 | 1.01 |
| rs2113334 | A | G | 0.41 | 0.26 | 0.65 | 1.36E−04 | 180/1056/1730 | 97/534/840 | 0.43 | 0.23 | 0.83 |
| rs251817 | A | G | 2.19 | 1.46 | 3.27 | 1.37E−04 | 0/84/1359 | 3/83/1341 | 2.09 | 1.15 | 3.80 |
| rs2574 | C | G | 1.53 | 1.23 | 1.91 | 1.39E−04 | 377/740/378 | 338/715/418 | 1.48 | 1.07 | 2.04 |
| rs12679254 | A | G | 0.68 | 0.56 | 0.83 | 1.40E−04 | 146/640/709 | 167/647/657 | 0.65 | 0.49 | 0.87 |
| rs12341095 | A | G | 2.10 | 1.43 | 3.09 | 1.47E−04 | 138/583/774 | 98/607/766 | 2.35 | 1.30 | 4.27 |
| rs17048681 | C | A | 1.31 | 1.14 | 1.51 | 1.47E−04 | 239/709/546 | 219/690/562 | 1.26 | 1.03 | 1.54 |
| rs1942876 | A | G | 0.56 | 0.42 | 0.76 | 1.48E−04 | 228/724/543 | 237/679/554 | 0.62 | 0.40 | 0.95 |
| rs2657940 | A | G | 1.40 | 1.18 | 1.66 | 1.52E−04 | 82/530/882 | 59/504/908 | 1.43 | 1.11 | 1.85 |
| rs494111 | G | A | 0.57 | 0.42 | 0.76 | 1.54E−04 | 237/727/531 | 241/690/540 | 0.63 | 0.42 | 0.96 |
| rs2060022 | G | A | 0.64 | 0.51 | 0.81 | 1.59E−04 | 320/753/422 | 364/713/393 | 0.58 | 0.41 | 0.81 |

TABLE 6-continued

| | | | | | | | | | | | |
|---|---|---|---|---|---|---|---|---|---|---|---|
| rs7338174 | A | G | 2.16 | 1.45 | 3.22 | 1.59E−04 | 3/121/1371 | 0/101/1370 | 2.01 | 1.13 | 3.57 |
| rs12048902 | G | A | 0.76 | 0.66 | 0.88 | 1.61E−04 | 220/701/574 | 246/692/532 | 0.74 | 0.60 | 0.90 |
| rs6746182 | A | G | 1.49 | 1.21 | 1.83 | 1.63E−04 | 99/581/814 | 92/528/851 | 1.52 | 1.12 | 2.06 |
| rs7276749 | A | C | 0.46 | 0.31 | 0.69 | 1.68E−04 | 3/109/1378 | 5/133/1328 | 0.37 | 0.19 | 0.69 |
| rs198460 | G | A | 1.56 | 1.24 | 1.97 | 1.68E−04 | 339/773/382 | 327/761/382 | 1.59 | 1.09 | 2.30 |
| rs7785499 | A | G | 1.53 | 1.23 | 1.92 | 1.75E−04 | 362/729/404 | 343/725/403 | 1.41 | 1.02 | 1.96 |
| rs996022 | C | A | 0.57 | 0.42 | 0.76 | 1.76E−04 | 227/724/543 | 237/677/555 | 0.63 | 0.41 | 0.96 |
| rs7222186 | A | G | 0.64 | 0.51 | 0.81 | 1.79E−04 | 34/352/1109 | 25/379/1067 | 0.73 | 0.52 | 1.04 |
| rs198464 | G | A | 1.57 | 1.24 | 1.99 | 1.80E−04 | 349/771/374 | 336/765/369 | 1.44 | 1.00 | 2.07 |
| rs16934059 | C | A | 0.68 | 0.55 | 0.83 | 1.80E−04 | 197/673/625 | 205/670/595 | 0.75 | 0.55 | 1.02 |
| rs1566221 | G | A | 0.56 | 0.42 | 0.76 | 1.84E−04 | 14/347/2605 | 8/175/1288 | 0.59 | 0.39 | 0.88 |
| rs8129810 | A | G | 0.46 | 0.31 | 0.69 | 1.85E−04 | 3/108/1384 | 5/133/1328 | 0.37 | 0.19 | 0.69 |
| rs1344081 | G | A | 1.45 | 1.19 | 1.77 | 1.89E−04 | 60/459/976 | 74/439/958 | 1.45 | 1.09 | 1.93 |
| rs7918692 | A | G | 1.54 | 1.23 | 1.94 | 1.96E−04 | 26/352/1117 | 21/324/1126 | 1.47 | 1.07 | 2.03 |
| rs4686740 | A | G | 1.55 | 1.23 | 1.95 | 2.04E−04 | 341/721/433 | 302/709/460 | 1.42 | 1.02 | 1.99 |
| rs12817873 | A | G | 0.77 | 0.67 | 0.88 | 2.05E−04 | 262/693/538 | 249/739/481 | 0.76 | 0.62 | 0.93 |
| rs7508 | G | A | 1.48 | 1.20 | 1.82 | 2.08E−04 | 125/612/758 | 120/550/801 | 1.42 | 1.05 | 1.93 |
| rs271046 | A | G | 0.57 | 0.43 | 0.77 | 2.13E−04 | 189/670/636 | 216/652/603 | 0.51 | 0.33 | 0.78 |
| rs2011318 | A | G | 0.64 | 0.51 | 0.81 | 2.15E−04 | 21/274/1155 | 18/268/1147 | 0.67 | 0.47 | 0.95 |
| rs1136046 | A | G | 1.48 | 1.20 | 1.83 | 2.29E−04 | 59/663/2244 | 29/317/1125 | 1.64 | 1.23 | 2.18 |
| rs1450092 | G | A | 0.69 | 0.57 | 0.84 | 2.29E−04 | 43/415/1037 | 43/464/962 | 0.63 | 0.47 | 0.84 |
| rs7070244 | G | A | 1.45 | 1.19 | 1.78 | 2.37E−04 | 37/350/1107 | 32/325/1114 | 1.42 | 1.07 | 1.88 |
| rs892162 | G | A | 0.60 | 0.46 | 0.79 | 2.39E−04 | 273/736/485 | 279/695/496 | 0.64 | 0.43 | 0.96 |
| rs6563805 | A | G | 0.65 | 0.52 | 0.82 | 2.41E−04 | 42/350/1102 | 35/383/1052 | 0.76 | 0.56 | 1.04 |
| rs9906737 | G | A | 0.65 | 0.52 | 0.82 | 2.42E−04 | 35/355/1104 | 30/376/1064 | 0.71 | 0.50 | 1.01 |
| rs475420 | G | A | 1.63 | 1.25 | 2.12 | 2.49E−04 | 20/235/1237 | 8/198/1263 | 1.79 | 1.24 | 2.59 |
| rs17644708 | G | A | 0.51 | 0.36 | 0.73 | 2.61E−04 | 156/606/732 | 168/601/702 | 0.58 | 0.36 | 0.94 |
| rs7067780 | A | G | 1.53 | 1.22 | 1.91 | 2.61E−04 | 33/353/1109 | 30/321/1119 | 1.43 | 1.03 | 1.97 |
| rs4773 | A | G | 0.69 | 0.56 | 0.84 | 2.68E−04 | 249/694/552 | 250/712/509 | 0.65 | 0.48 | 0.87 |
| rs6742894 | G | A | 1.53 | 1.22 | 1.92 | 2.69E−04 | 395/755/343 | 335/732/404 | 1.33 | 0.96 | 1.85 |
| rs1045916 | G | A | 0.74 | 0.62 | 0.87 | 2.70E−04 | 225/1125/1533 | 118/555/760 | 0.67 | 0.52 | 0.86 |
| rs6435378 | A | G | 0.67 | 0.53 | 0.83 | 2.76E−04 | 298/688/509 | 264/756/451 | 0.70 | 0.51 | 0.97 |
| rs13411119 | A | G | 1.44 | 1.18 | 1.75 | 2.78E−04 | 121/612/762 | 118/565/788 | 1.33 | 1.01 | 1.76 |
| rs1531842 | A | C | 0.68 | 0.56 | 0.84 | 2.79E−04 | 330/1271/1365 | 180/641/650 | 0.65 | 0.48 | 0.88 |
| rs9857 | G | A | 0.74 | 0.63 | 0.87 | 2.85E−04 | 96/554/844 | 120/608/741 | 0.68 | 0.54 | 0.86 |
| rs9960 | A | G | 1.47 | 1.19 | 1.80 | 2.88E−04 | 54/483/958 | 41/442/987 | 1.55 | 1.15 | 2.08 |
| rs13103899 | G | A | 0.67 | 0.54 | 0.83 | 2.88E−04 | 81/850/1955 | 39/434/961 | 0.70 | 0.52 | 0.95 |
| rs6848512 | G | A | 0.66 | 0.53 | 0.83 | 2.88E−04 | 316/740/394 | 329/731/373 | 0.75 | 0.55 | 1.02 |
| rs10181805 | A | C | 1.36 | 1.15 | 1.61 | 2.95E−04 | 64/473/957 | 54/454/963 | 1.31 | 1.02 | 1.67 |
| rs1129570 | C | A | 1.42 | 1.17 | 1.71 | 3.02E−04 | 47/455/950 | 50/410/974 | 1.34 | 1.01 | 1.77 |
| rs9986576 | A | C | 1.77 | 1.30 | 2.41 | 3.07E−04 | 349/1376/1241 | 156/710/605 | 1.79 | 1.13 | 2.84 |
| rs1352236 | A | G | 0.44 | 0.28 | 0.69 | 3.07E−04 | 133/614/746 | 145/609/716 | 0.59 | 0.34 | 1.03 |
| rs7770578 | A | G | 0.65 | 0.52 | 0.82 | 3.13E−04 | 20/302/1128 | 20/324/1087 | 0.69 | 0.50 | 0.97 |
| rs2748901 | G | A | 1.58 | 1.23 | 2.03 | 3.14E−04 | 326/750/419 | 314/702/454 | 1.57 | 1.07 | 2.30 |
| rs1155875 | G | A | 0.77 | 0.67 | 0.89 | 3.21E−04 | 286/710/499 | 298/652/521 | 0.81 | 0.66 | 1.01 |
| rs675163 | C | A | 0.67 | 0.54 | 0.83 | 3.25E−04 | 15/305/1175 | 25/315/1131 | 0.70 | 0.51 | 0.95 |
| rs1068705 | G | A | 0.66 | 0.53 | 0.83 | 3.29E−04 | 335/738/421 | 342/724/405 | 0.67 | 0.48 | 0.95 |
| rs1505469 | G | A | 1.50 | 1.20 | 1.88 | 3.45E−04 | 26/322/1147 | 21/320/1130 | 1.36 | 0.99 | 1.87 |
| rs623400 | A | G | 0.70 | 0.57 | 0.85 | 3.56E−04 | 107/559/786 | 115/547/772 | 0.77 | 0.58 | 1.03 |
| rs6040760 | G | A | 1.47 | 1.19 | 1.82 | 3.60E−04 | 128/565/801 | 110/562/799 | 1.72 | 1.30 | 2.28 |
| rs17310169 | A | G | 0.68 | 0.55 | 0.84 | 3.68E−04 | 47/422/1025 | 63/453/955 | 0.65 | 0.48 | 0.89 |
| rs7623808 | A | C | 4.25 | 1.92 | 9.43 | 3.74E−04 | 44/369/1081 | 37/324/1109 | 4.02 | 1.31 | 12.33 |
| rs77638540 | A | G | 0.48 | 0.32 | 0.72 | 3.78E−04 | 3/110/1382 | 5/129/1337 | 0.38 | 0.21 | 0.71 |
| rs581401 | A | G | 0.59 | 0.44 | 0.79 | 3.85E−04 | 239/715/539 | 240/683/548 | 0.62 | 0.41 | 0.94 |
| rs4251580 | A | G | 0.69 | 0.56 | 0.84 | 3.90E−04 | 34/355/1106 | 29/377/1065 | 0.78 | 0.59 | 1.04 |
| rs603940 | G | A | 0.59 | 0.44 | 0.79 | 3.91E−04 | 238/721/534 | 242/677/552 | 0.62 | 0.40 | 0.94 |
| rs13117043 | G | A | 1.50 | 1.20 | 1.88 | 4.01E−04 | 43/468/984 | 42/389/1039 | 1.29 | 0.93 | 1.79 |
| rs3800202 | A | G | 0.48 | 0.32 | 0.72 | 4.10E−04 | 3/114/1375 | 2/136/1329 | 0.39 | 0.20 | 0.76 |
| rs10738948 | A | G | 0.76 | 0.65 | 0.88 | 4.18E−04 | 202/706/587 | 231/708/530 | 0.82 | 0.65 | 1.02 |
| rs623584 | A | G | 0.59 | 0.45 | 0.79 | 4.21E−04 | 238/724/532 | 243/682/546 | 0.62 | 0.41 | 0.94 |
| rs9557509 | A | G | 1.49 | 1.20 | 1.87 | 4.24E−04 | 27/383/1084 | 24/334/1112 | 1.70 | 1.21 | 2.39 |
| rs11668038 | G | A | 1.35 | 1.14 | 1.60 | 4.29E−04 | 168/985/1731 | 79/486/868 | 1.31 | 1.02 | 1.69 |
| rs10802865 | A | C | 1.29 | 1.12 | 1.49 | 4.62E−04 | 697/1481/705 | 328/745/360 | 1.40 | 1.12 | 1.74 |
| rs17035071 | A | G | 1.44 | 1.17 | 1.77 | 5.05E−04 | 49/471/975 | 57/435/979 | 1.52 | 1.11 | 2.09 |
| rs1439269 | A | G | 1.39 | 1.16 | 1.68 | 5.20E−04 | 118/612/765 | 113/587/770 | 1.29 | 1.02 | 1.64 |
| rs208025 | A | G | 1.41 | 1.16 | 1.72 | 5.61E−04 | 93/537/861 | 96/473/897 | 1.30 | 0.98 | 1.72 |
| rs12608167 | G | A | 0.67 | 0.53 | 0.84 | 5.65E−04 | 21/337/1137 | 26/366/1078 | 0.70 | 0.50 | 0.98 |
| rs133871 | G | A | 0.70 | 0.57 | 0.85 | 5.74E−04 | 173/606/716 | 182/638/651 | 0.81 | 0.60 | 1.09 |
| rs7068975 | A | C | 1.65 | 1.24 | 2.19 | 5.82E−04 | 11/240/1244 | 9/204/1258 | 1.69 | 1.10 | 2.59 |
| rs1866386 | A | G | 0.74 | 0.62 | 0.88 | 5.84E−04 | 70/500/925 | 93/548/829 | 0.69 | 0.53 | 0.88 |
| rs1580713 | A | G | 1.57 | 1.21 | 2.03 | 6.11E−04 | 552/1477/937 | 251/764/456 | 1.52 | 1.04 | 2.22 |
| rs936671 | G | A | 0.70 | 0.57 | 0.86 | 6.61E−04 | 93/549/852 | 109/559/801 | 0.73 | 0.54 | 0.99 |
| rs3732136 | A | G | 1.51 | 1.19 | 1.91 | 6.62E−04 | 118/604/772 | 117/568/786 | 1.32 | 0.98 | 1.79 |
| rs17718867 | A | G | 0.72 | 0.59 | 0.87 | 6.84E−04 | 50/407/1038 | 46/464/961 | 0.67 | 0.51 | 0.89 |
| rs5764592 | G | A | 1.53 | 1.20 | 1.95 | 7.02E−04 | 23/261/1211 | 18/240/1212 | 1.40 | 0.99 | 1.98 |
| rs2880563 | G | A | 1.41 | 1.16 | 1.72 | 7.07E−04 | 119/563/770 | 92/541/801 | 1.31 | 0.98 | 1.74 |
| rs1564078 | G | A | 0.78 | 0.68 | 0.90 | 7.07E−04 | 279/650/563 | 205/735/530 | 0.73 | 0.58 | 0.90 |
| rs10817479 | A | G | 1.66 | 1.24 | 2.23 | 7.22E−04 | 0/203/1280 | 0/157/1305 | 1.83 | 1.19 | 2.81 |
| rs478859 | A | G | 1.26 | 1.10 | 1.45 | 7.28E−04 | 341/724/430 | 324/705/442 | 1.20 | 0.99 | 1.46 |
| rs10106852 | G | A | 1.64 | 1.23 | 2.19 | 7.44E−04 | 190/675/630 | 167/704/599 | 1.40 | 0.92 | 2.14 |

TABLE 6-continued

| Marker | | | | | | | | | | | | |
|---|---|---|---|---|---|---|---|---|---|---|---|---|
| rs12659030 | A | G | 1.43 | 1.16 | 1.75 | 7.50E-04 | 105/584/806 | 85/532/854 | 1.48 | 1.09 | 2.00 |
| rs1536506 | A | G | 1.49 | 1.18 | 1.89 | 7.74E-04 | 369/716/408 | 271/747/453 | 1.57 | 1.11 | 2.23 |
| rs2184393 | G | A | 0.70 | 0.57 | 0.86 | 7.76E-04 | 437/1361/1166 | 218/711/540 | 0.66 | 0.48 | 0.90 |
| rs11077308 | G | A | 1.47 | 1.17 | 1.84 | 7.81E-04 | 42/404/1005 | 33/375/1026 | 1.26 | 0.90 | 1.75 |
| rs7915250 | C | G | 0.71 | 0.58 | 0.87 | 8.35E-04 | 225/681/589 | 260/682/529 | 0.69 | 0.51 | 0.92 |
| rs4689078 | G | A | 1.27 | 1.10 | 1.46 | 8.63E-04 | 319/719/454 | 266/733/469 | 1.23 | 1.01 | 1.50 |
| rs2869680 | A | G | 0.75 | 0.64 | 0.89 | 9.44E-04 | 68/511/872 | 79/508/847 | 0.81 | 0.64 | 1.03 |
| rs12286877 | A | G | 2.18 | 1.37 | 3.45 | 9.89E-04 | 0/150/2726 | 0/62/1368 | 2.20 | 1.07 | 4.55 |
| rs10460737 | A | G | 0.24 | 0.08 | 0.70 | 9.13E-03 | 0/58/1394 | 1/68/1365 | 0.43 | 0.20 | 0.92 |

| | CARE | | | | WOSCOPS | | | | |
|---|---|---|---|---|---|---|---|---|---|
| Marker | P value | Source | Prava Count | Placebo Count | OR | OR L95 | OR U95 | P value | Source |
| rs13129010 | 3.07E-03 | caseonly | 4/48/107 | 2/44/178 | 1.90 | 1.19 | 3.03 | 6.81E-03 | caseonly |
| rs4242281 | 1.64E-03 | caseonly | 21/76/87 | 20/109/118 | 1.46 | 0.76 | 2.79 | 2.51E-01 | caseonly |
| rs6474228 | 5.78E-03 | caseonly | 14/62/83 | 8/66/150 | 1.83 | 1.21 | 2.79 | 4.63E-03 | caseonly |
| rs4240808 | 8.21E-03 | caseonly | 32/99/53 | 65/118/64 | 0.61 | 0.38 | 0.98 | 4.06E-02 | caseonly |
| rs13126170 | 4.55E-03 | caseonly | 5/53/126 | 9/82/156 | 0.78 | 0.52 | 1.17 | 2.36E-01 | caseonly |
| rs7916629 | 1.37E-03 | caseonly | 18/75/90 | 15/98/130 | 1.66 | 0.81 | 3.41 | 1.64E-01 | caseonly |
| rs11721179 | 7.62E-03 | caseonly | 2/34/148 | 7/65/175 | 0.60 | 0.38 | 0.95 | 2.87E-02 | caseonly |
| rs2993156 | 2.36E-04 | caseonly | 8/58/118 | 14/92/141 | 0.76 | 0.51 | 1.13 | 1.73E-01 | caseonly |
| rs10774580 | 4.35E-02 | caseonly | 25/64/70 | 37/119/68 | 0.56 | 0.37 | 0.86 | 7.45E-03 | caseonly |
| rs16885715 | 1.34E-03 | caseonly | 7/49/103 | 6/52/166 | 1.58 | 1.01 | 2.46 | 4.38E-02 | caseonly |
| rs4870109 | 2.98E-03 | caseonly | 21/75/87 | 20/109/118 | 1.47 | 0.77 | 2.80 | 2.45E-01 | caseonly |
| rs17688430 | 1.46E-03 | caseonly | 5/50/129 | 10/86/151 | 0.71 | 0.50 | 1.01 | 5.62E-02 | caseonly |
| rs7332076 | 2.75E-02 | caseonly | 22/69/93 | 15/103/129 | 2.18 | 1.09 | 4.34 | 2.70E-02 | caseonly |
| rs694780 | 2.89E-02 | caseonly | 20/76/63 | 43/103/78 | 0.62 | 0.35 | 1.10 | 1.02E-01 | caseonly |
| rs4836745 | 1.94E-02 | caseonly | 17/78/89 | 25/128/94 | 0.65 | 0.44 | 0.97 | 3.26E-02 | caseonly |
| rs7018577 | 6.27E-02 | caseonly | 13/75/71 | 13/75/136 | 1.94 | 1.28 | 2.94 | 1.68E-03 | caseonly |
| rs11585647 | 2.23E-02 | caseonly | 5/22/157 | 1/50/196 | 0.67 | 0.40 | 1.12 | 1.25E-01 | caseonly |
| rs4420312 | 5.30E-02 | caseonly | 11/49/99 | 16/91/117 | 0.64 | 0.42 | 0.97 | 3.58E-02 | caseonly |
| rs7449527 | 4.61E-02 | caseonly | 7/53/99 | 3/57/164 | 1.71 | 1.10 | 2.65 | 1.72E-02 | caseonly |
| rs7839562 | 3.10E-02 | caseonly | 29/86/44 | 46/91/87 | 1.63 | 1.05 | 2.53 | 3.07E-02 | caseonly |
| rs2655222 | 4.34E-02 | caseonly | 2/46/111 | 14/71/139 | 0.20 | 0.05 | 0.91 | 3.78E-02 | caseonly |
| rs2616548 | 4.98E-02 | caseonly | 3/35/121 | 1/40/183 | 1.37 | 0.83 | 2.26 | 2.18E-01 | caseonly |
| rs10497883 | 3.91E-02 | caseonly | 4/46/109 | 8/88/128 | 0.67 | 0.46 | 0.98 | 4.15E-02 | caseonly |
| rs6998016 | 4.55E-02 | caseonly | 7/44/108 | 1/64/159 | 9.63 | 1.17 | 79.34 | 3.53E-02 | caseonly |
| rs11148285 | 3.92E-02 | caseonly | 17/76/91 | 10/124/113 | 2.30 | 1.02 | 5.16 | 4.42E-02 | caseonly |
| rs7305949 | 1.26E-04 | cohort | 27/74/58 | 23/115/86 | 1.74 | 0.95 | 3.17 | 7.16E-02 | caseonly |
| rs264122 | 7.41E-05 | cohort | 273/1142/1235 | 279/1125/1251 | 0.66 | 0.46 | 0.95 | 2.58E-02 | cohort |
| rs1009748 | 3.95E-03 | cohort | 400/1202/1054 | 384/1214/1064 | 1.35 | 1.05 | 1.72 | 1.81E-02 | cohort |
| rs1336400 | 5.89E-05 | cohort | 19/67/73 | 19/87/118 | 1.35 | 0.90 | 2.04 | 1.53E-01 | caseonly |
| rs2108425 | 1.10E-04 | cohort | 17/56/83 | 24/106/92 | 0.62 | 0.41 | 0.94 | 2.45E-02 | caseonly |
| rs2327412 | 4.19E-03 | cohort | 30/86/68 | 31/96/120 | 1.41 | 1.07 | 1.86 | 1.56E-02 | caseonly |
| rs17002013 | 1.00E-03 | cohort | 8/70/105 | 6/71/170 | 1.66 | 1.11 | 2.48 | 1.28E-02 | caseonly |
| rs1015199 | 7.11E-03 | cohort | 1/36/147 | 3/29/215 | 1.66 | 0.98 | 2.78 | 5.77E-02 | caseonly |
| rs7078016 | 3.59E-04 | cohort | 19/81/84 | 23/90/134 | 1.44 | 0.98 | 2.12 | 6.19E-02 | caseonly |
| rs6585412 | 3.56E-04 | cohort | 19/81/84 | 23/90/134 | 1.44 | 0.98 | 2.12 | 6.19E-02 | caseonly |
| rs198476 | 1.68E-02 | cohort | 613/1353/665 | 588/1343/710 | 1.61 | 1.06 | 2.46 | 2.63E-02 | cohort |
| rs2648694 | 3.71E-03 | cohort | 28/75/81 | 18/125/104 | 2.29 | 1.22 | 4.29 | 9.83E-03 | caseonly |
| rs10945874 | 8.43E-04 | cohort | 2/42/140 | 3/45/198 | 1.24 | 0.81 | 1.91 | 3.19E-01 | caseonly |
| rs1190706 | 5.65E-04 | cohort | 285/1100/1252 | 285/1176/1190 | 0.70 | 0.50 | 0.99 | 4.37E-02 | cohort |
| rs3763978 | 6.03E-03 | cohort | 417/1255/984 | 411/1224/1024 | 0.68 | 0.53 | 0.87 | 2.46E-03 | cohort |
| rs11138314 | 1.34E-02 | cohort | 34/563/2059 | 46/555/2057 | 0.59 | 0.39 | 0.89 | 1.22E-02 | cohort |
| rs13107334 | 8.24E-03 | cohort | 8/52/124 | 12/85/150 | 0.74 | 0.50 | 1.11 | 1.49E-01 | caseonly |
| rs6685920 | 2.93E-04 | cohort | 7/45/132 | 5/49/193 | 1.40 | 0.90 | 2.18 | 1.35E-01 | caseonly |
| rs2616552 | 8.81E-03 | cohort | 9/52/98 | 6/68/150 | 1.32 | 0.92 | 1.89 | 1.37E-01 | caseonly |
| rs2110564 | 6.27E-02 | cohort | 28/74/82 | 31/139/77 | 0.56 | 0.37 | 0.83 | 3.82E-03 | caseonly |
| rs10012485 | 5.90E-02 | cohort | 10/52/122 | 12/97/138 | 0.64 | 0.43 | 0.95 | 2.56E-02 | caseonly |
| rs1798093 | 1.71E-02 | cohort | 473/1222/957 | 491/1279/890 | 1.63 | 1.03 | 2.59 | 3.71E-02 | cohort |
| rs4787415 | 1.72E-02 | cohort | 29/89/41 | 69/99/56 | 0.52 | 0.31 | 0.85 | 8.69E-03 | caseonly |
| rs11734256 | 8.84E-04 | cohort | 37/100/47 | 59/111/77 | 0.81 | 0.51 | 1.30 | 3.88E-01 | caseonly |
| rs1266489 | 1.89E-03 | cohort | 20/73/91 | 32/113/102 | 0.74 | 0.50 | 1.09 | 1.26E-01 | caseonly |
| rs238250 | 8.40E-04 | cohort | 55/719/1881 | 68/672/1921 | 1.43 | 1.03 | 1.97 | 3.13E-02 | cohort |
| rs2588350 | 1.62E-03 | cohort | 7/63/114 | 17/102/128 | 0.68 | 0.49 | 0.95 | 2.31E-02 | caseonly |
| rs498657 | 1.33E-03 | cohort | 4/55/100 | 7/63/154 | 1.18 | 0.81 | 1.72 | 4.00E-01 | caseonly |
| rs6427807 | 1.46E-02 | cohort | 391/1269/993 | 439/1236/983 | 0.67 | 0.47 | 0.96 | 2.85E-02 | cohort |
| rs619825 | 2.29E-02 | cohort | 20/76/63 | 43/102/78 | 0.61 | 0.34 | 1.09 | 9.80E-02 | caseonly |
| rs9478241 | 7.99E-03 | cohort | 21/76/86 | 19/108/118 | 1.54 | 0.80 | 2.96 | 1.97E-01 | caseonly |
| rs1727746 | 1.90E-03 | cohort | 21/86/76 | 22/98/127 | 1.50 | 1.02 | 2.20 | 4.18E-02 | caseonly |
| rs2505039 | 7.20E-04 | cohort | 486/1334/834 | 527/1350/786 | 0.78 | 0.60 | 1.02 | 6.83E-02 | cohort |
| rs4472926 | 4.86E-02 | cohort | 20/66/73 | 23/115/86 | 0.71 | 0.47 | 1.08 | 1.10E-01 | caseonly |
| rs6539231 | 3.59E-03 | cohort | 40/88/56 | 52/140/55 | 0.66 | 0.43 | 1.02 | 5.92E-02 | caseonly |
| rs7959965 | 1.14E-02 | cohort | 30/82/72 | 44/137/66 | 0.75 | 0.57 | 1.00 | 4.97E-02 | caseonly |
| rs974950 | 7.47E-02 | cohort | 28/74/82 | 31/139/77 | 0.56 | 0.37 | 0.83 | 3.82E-03 | caseonly |
| rs1524962 | 4.61E-04 | cohort | 9/60/90 | 23/86/115 | 0.78 | 0.56 | 1.08 | 1.28E-01 | caseonly |
| rs17821383 | 4.37E-03 | cohort | 3/60/96 | 13/70/141 | 0.33 | 0.09 | 1.18 | 8.85E-02 | caseonly |

TABLE 6-continued

| | | | | | | | | | |
|---|---|---|---|---|---|---|---|---|---|
| rs10518335 | 6.53E−02 | cohort | 11/52/121 | 13/96/138 | 0.65 | 0.44 | 0.97 | 3.35E−02 | caseonly |
| rs12265891 | 5.58E−03 | cohort | 38/76/45 | 43/100/79 | 1.27 | 0.77 | 2.09 | 3.43E−01 | caseonly |
| rs4807536 | 2.01E−03 | cohort | 3/19/162 | 1/14/232 | 2.13 | 1.07 | 4.24 | 3.22E−02 | caseonly |
| rs9914580 | 5.56E−03 | cohort | 5/36/117 | 6/72/146 | 0.67 | 0.42 | 1.05 | 7.85E−02 | caseonly |
| rs646749 | 2.76E−02 | cohort | 20/75/63 | 43/101/78 | 0.62 | 0.35 | 1.10 | 9.97E−02 | caseonly |
| rs1003322 | 4.17E−03 | cohort | 9/58/92 | 8/64/152 | 1.52 | 0.99 | 2.32 | 5.29E−02 | caseonly |
| rs4660234 | 5.46E−04 | cohort | 53/567/2036 | 57/576/2031 | 1.32 | 0.88 | 1.97 | 1.80E−01 | cohort |
| rs4038018 | 8.85E−03 | cohort | 27/65/63 | 55/105/64 | 0.55 | 0.36 | 0.85 | 6.49E−03 | caseonly |
| rs7710039 | 8.96E−03 | cohort | 7/67/110 | 18/106/123 | 0.65 | 0.44 | 0.96 | 3.15E−02 | caseonly |
| rs13150189 | 2.74E−02 | cohort | 12/70/102 | 9/67/171 | 1.83 | 1.23 | 2.72 | 3.06E−03 | caseonly |
| rs12646525 | 5.51E−02 | cohort | 10/52/122 | 13/96/138 | 0.64 | 0.43 | 0.95 | 2.56E−02 | caseonly |
| rs2113334 | 1.18E−02 | cohort | 6/73/105 | 15/84/148 | 0.53 | 0.20 | 1.41 | 2.06E−01 | caseonly |
| rs251817 | 1.59E−02 | cohort | 0/13/170 | 0/6/241 | 2.98 | 1.11 | 8.03 | 3.08E−02 | caseonly |
| rs2574 | 1.77E−02 | cohort | 57/87/39 | 56/128/63 | 1.54 | 1.00 | 2.38 | 5.03E−02 | caseonly |
| rs12679254 | 2.98E−03 | cohort | 14/76/94 | 30/117/100 | 0.65 | 0.44 | 0.95 | 2.77E−02 | caseonly |
| rs12341095 | 4.90E−03 | cohort | 180/1006/1468 | 154/1001/1503 | 2.38 | 1.14 | 4.96 | 2.05E−02 | cohort |
| rs17048681 | 2.34E−03 | cohort | 44/90/50 | 34/125/88 | 1.49 | 1.13 | 1.98 | 5.10E−03 | caseonly |
| rs1942876 | 2.82E−02 | cohort | 20/75/64 | 43/102/79 | 0.62 | 0.35 | 1.10 | 1.02E−01 | caseonly |
| rs2657940 | 5.19E−03 | cohort | 11/62/86 | 10/62/152 | 1.57 | 1.12 | 2.21 | 9.90E−03 | caseonly |
| rs494111 | 3.08E−02 | cohort | 19/77/62 | 43/104/77 | 0.59 | 0.33 | 1.06 | 7.90E−02 | caseonly |
| rs2060022 | 1.54E−02 | cohort | 45/94/45 | 79/109/59 | 0.69 | 0.45 | 1.07 | 9.41E−02 | caseonly |
| rs7338174 | 1.75E−02 | cohort | 1/10/148 | 1/7/216 | 2.01 | 0.79 | 5.14 | 1.44E−01 | caseonly |
| rs12048902 | 2.93E−03 | cohort | 24/90/70 | 41/120/86 | 0.87 | 0.66 | 1.16 | 3.46E−01 | caseonly |
| rs6746182 | 7.63E−03 | cohort | 6/66/87 | 9/62/153 | 1.79 | 1.17 | 2.73 | 6.97E−03 | caseonly |
| rs7276749 | 1.84E−03 | cohort | 0/10/174 | 1/18/228 | 0.68 | 0.31 | 1.52 | 3.50E−01 | caseonly |
| rs198460 | 1.48E−02 | cohort | 620/1368/663 | 591/1353/713 | 1.54 | 1.01 | 2.34 | 4.59E−02 | cohort |
| rs7785499 | 3.74E−02 | cohort | 59/85/40 | 56/130/61 | 1.62 | 1.05 | 2.49 | 2.89E−02 | caseonly |
| rs996022 | 3.27E−02 | cohort | 20/75/64 | 43/102/79 | 0.62 | 0.35 | 1.10 | 1.02E−01 | caseonly |
| rs7222186 | 7.77E−02 | cohort | 6/36/117 | 6/72/146 | 0.68 | 0.44 | 1.07 | 9.51E−02 | caseonly |
| rs198464 | 4.86E−02 | cohort | 50/69/40 | 42/122/60 | 2.04 | 1.27 | 3.29 | 3.35E−03 | caseonly |
| rs16934059 | 7.03E−02 | cohort | 13/64/82 | 33/105/86 | 0.57 | 0.38 | 0.87 | 8.36E−03 | caseonly |
| rs1566221 | 1.10E−02 | cohort | 0/14/145 | 0/42/182 | 0.41 | 0.21 | 0.78 | 6.53E−03 | caseonly |
| rs8129810 | 1.89E−03 | cohort | 0/10/174 | 1/18/228 | 0.68 | 0.31 | 1.52 | 3.50E−01 | caseonly |
| rs1344081 | 1.14E−02 | cohort | 106/820/1729 | 101/844/1709 | 1.58 | 1.10 | 2.26 | 1.25E−02 | cohort |
| rs7918692 | 1.91E−02 | cohort | 8/43/133 | 3/41/203 | 1.76 | 1.11 | 2.79 | 1.59E−02 | caseonly |
| rs4686740 | 3.98E−02 | cohort | 55/87/42 | 54/122/71 | 1.53 | 0.98 | 2.37 | 5.90E−02 | caseonly |
| rs12817873 | 7.13E−03 | cohort | 20/89/75 | 41/133/73 | 0.69 | 0.52 | 0.93 | 1.38E−02 | caseonly |
| rs7508 | 2.27E−02 | cohort | 15/77/67 | 20/92/112 | 1.39 | 0.92 | 2.10 | 1.17E−01 | caseonly |
| rs271046 | 2.30E−03 | cohort | 19/94/71 | 40/115/92 | 0.58 | 0.32 | 1.05 | 6.99E−02 | caseonly |
| rs2011318 | 2.57E−02 | cohort | 2/23/133 | 8/47/169 | 0.60 | 0.38 | 0.95 | 2.83E−02 | caseonly |
| rs1136046 | 8.11E−04 | cohort | 2/35/147 | 2/43/202 | 1.16 | 0.74 | 1.83 | 5.13E−01 | caseonly |
| rs1450092 | 1.89E−03 | cohort | 4/43/112 | 8/81/135 | 0.68 | 0.46 | 1.01 | 5.29E−02 | caseonly |
| rs7070244 | 1.43E−02 | cohort | 8/39/135 | 3/38/206 | 1.72 | 1.15 | 2.59 | 8.56E−03 | caseonly |
| rs892162 | 2.95E−02 | cohort | 20/80/59 | 51/100/73 | 0.47 | 0.27 | 0.84 | 9.96E−03 | caseonly |
| rs6563805 | 8.26E−02 | cohort | 2/24/133 | 4/54/166 | 0.59 | 0.37 | 0.94 | 2.75E−02 | caseonly |
| rs9906737 | 5.44E−02 | cohort | 6/37/116 | 6/72/146 | 0.70 | 0.45 | 1.10 | 1.23E−01 | caseonly |
| rs475420 | 1.75E−03 | cohort | 0/29/155 | 0/29/217 | 1.37 | 0.78 | 2.38 | 2.73E−01 | caseonly |
| rs17644708 | 2.65E−02 | cohort | 13/78/93 | 31/116/100 | 0.52 | 0.26 | 1.03 | 5.89E−02 | caseonly |
| rs7067780 | 3.11E−02 | cohort | 8/43/132 | 3/38/206 | 1.93 | 1.21 | 3.07 | 5.99E−03 | caseonly |
| rs4773 | 3.94E−03 | cohort | 20/73/91 | 32/111/104 | 0.77 | 0.52 | 1.13 | 1.79E−01 | caseonly |
| rs6742894 | 8.45E−02 | cohort | 49/91/44 | 47/123/77 | 1.56 | 0.98 | 2.46 | 5.86E−02 | caseonly |
| rs1045916 | 1.39E−03 | cohort | 157/975/1521 | 170/995/1496 | 0.80 | 0.58 | 1.10 | 1.78E−01 | cohort |
| rs6435378 | 3.05E−02 | cohort | 34/70/55 | 42/134/48 | 0.52 | 0.33 | 0.82 | 4.94E−03 | caseonly |
| rs13411119 | 4.53E−03 | cohort | 22/84/78 | 18/87/142 | 1.83 | 1.24 | 2.69 | 2.34E−03 | caseonly |
| rs1531842 | 5.54E−03 | cohort | 13/54/92 | 21/89/114 | 0.76 | 0.50 | 1.15 | 1.90E−01 | caseonly |
| rs9857 | 1.14E−03 | cohort | 6/64/114 | 18/82/147 | 0.83 | 0.60 | 1.15 | 2.67E−01 | caseonly |
| rs9960 | 3.88E−03 | cohort | 10/57/117 | 7/63/177 | 1.41 | 0.94 | 2.13 | 9.91E−02 | caseonly |
| rs13103899 | 2.39E−02 | cohort | 5/53/126 | 8/83/156 | 0.78 | 0.52 | 1.17 | 2.32E−01 | caseonly |
| rs6848512 | 6.96E−02 | cohort | 38/90/56 | 65/133/49 | 0.55 | 0.35 | 0.86 | 8.50E−03 | caseonly |
| rs10181805 | 3.21E−02 | cohort | 11/74/99 | 8/76/163 | 1.58 | 1.13 | 2.21 | 7.18E−03 | caseonly |
| rs1129570 | 4.41E−02 | cohort | 7/52/100 | 5/54/165 | 1.58 | 1.08 | 2.31 | 1.83E−02 | caseonly |
| rs9986576 | 1.30E−02 | cohort | 21/75/87 | 20/108/117 | 1.46 | 0.76 | 2.78 | 2.54E−01 | caseonly |
| rs1352236 | 6.31E−02 | cohort | 6/62/91 | 28/84/112 | 0.27 | 0.11 | 0.66 | 4.24E−03 | caseonly |
| rs7770578 | 3.13E−02 | cohort | 0/23/136 | 6/43/174 | 0.57 | 0.34 | 0.94 | 2.88E−02 | caseonly |
| rs2748901 | 2.05E−02 | cohort | 517/1250/885 | 452/1342/868 | 1.81 | 1.11 | 2.95 | 1.80E−02 | cohort |
| rs1155875 | 5.63E−02 | cohort | 21/85/52 | 61/104/59 | 0.66 | 0.49 | 0.89 | 6.12E−03 | caseonly |
| rs675163 | 2.23E−02 | cohort | 2/31/151 | 4/54/189 | 0.71 | 0.46 | 1.11 | 1.32E−01 | caseonly |
| rs1068705 | 2.34E−02 | cohort | 615/1268/767 | 672/1320/661 | 0.74 | 0.49 | 1.11 | 1.45E−01 | cohort |
| rs1505469 | 6.03E−02 | cohort | 2/44/113 | 1/48/175 | 1.47 | 0.94 | 2.30 | 9.11E−02 | caseonly |
| rs623400 | 7.39E−02 | cohort | 16/63/105 | 25/111/111 | 0.62 | 0.42 | 0.92 | 1.60E−02 | caseonly |
| rs6040760 | 1.37E−04 | cohort | 18/72/94 | 23/87/137 | 1.23 | 0.83 | 1.81 | 2.98E−01 | caseonly |
| rs17310169 | 6.66E−03 | cohort | 2/54/128 | 4/81/162 | 0.81 | 0.54 | 1.23 | 3.22E−01 | caseonly |
| rs7623808 | 1.50E−02 | cohort | 6/46/132 | 2/58/187 | 4.22 | 0.83 | 21.33 | 8.20E−02 | caseonly |
| rs77638540 | 2.41E−03 | cohort | 0/10/174 | 1/18/228 | 0.68 | 0.31 | 1.52 | 3.50E−01 | caseonly |
| rs581401 | 2.53E−02 | cohort | 19/76/64 | 43/103/78 | 0.59 | 0.33 | 1.05 | 7.35E−02 | caseonly |
| rs4251580 | 8.76E−02 | cohort | 1/35/148 | 3/76/168 | 0.55 | 0.35 | 0.85 | 6.68E−03 | caseonly |
| rs603940 | 2.40E−02 | cohort | 19/77/63 | 43/103/78 | 0.59 | 0.33 | 1.05 | 7.35E−02 | caseonly |
| rs13117043 | 1.23E−01 | cohort | 5/42/112 | 3/41/180 | 1.73 | 1.07 | 2.78 | 2.45E−02 | caseonly |
| rs3800202 | 5.25E−03 | cohort | 0/9/150 | 1/23/200 | 0.49 | 0.22 | 1.07 | 7.33E−02 | caseonly |
| rs10738948 | 7.21E−02 | cohort | 19/77/63 | 36/118/70 | 0.74 | 0.55 | 1.02 | 6.20E−02 | caseonly |

TABLE 6-continued

| Marker | | | | | | | | | |
|---|---|---|---|---|---|---|---|---|---|
| rs623584 | 2.32E−02 | cohort | 19/76/64 | 43/104/77 | 0.59 | 0.33 | 1.05 | 7.35E−02 | caseonly |
| rs9557509 | 2.28E−03 | cohort | 44/636/1977 | 46/585/2031 | 1.42 | 0.95 | 2.11 | 8.72E−02 | cohort |
| rs11668038 | 3.36E−02 | cohort | 122/885/1648 | 111/846/1702 | 1.25 | 0.91 | 1.71 | 1.62E−01 | cohort |
| rs10802865 | 3.12E−03 | cohort | 625/1329/702 | 604/1353/706 | 1.16 | 0.90 | 1.50 | 2.52E−01 | cohort |
| rs17035071 | 8.90E−03 | cohort | 114/855/1681 | 112/836/1709 | 1.22 | 0.84 | 1.77 | 3.03E−01 | cohort |
| rs1439269 | 3.56E−02 | cohort | 20/72/67 | 15/75/134 | 1.74 | 1.27 | 2.39 | 6.20E−04 | caseonly |
| rs208025 | 7.23E−02 | cohort | 12/79/93 | 9/89/149 | 1.52 | 1.03 | 2.23 | 3.55E−02 | caseonly |
| rs12608167 | 3.67E−02 | cohort | 7/36/141 | 8/70/169 | 0.66 | 0.42 | 1.02 | 5.92E−02 | caseonly |
| rs133871 | 1.64E−01 | cohort | 20/54/85 | 25/105/94 | 0.64 | 0.42 | 0.96 | 3.04E−02 | caseonly |
| rs7068975 | 1.62E−02 | cohort | 3/32/124 | 1/26/197 | 2.02 | 1.16 | 3.51 | 1.24E−02 | caseonly |
| rs1866386 | 3.18E−03 | cohort | 4/57/123 | 12/80/155 | 0.81 | 0.57 | 1.14 | 2.23E−01 | caseonly |
| rs1580713 | 3.16E−02 | cohort | 45/72/41 | 41/116/66 | 1.68 | 1.03 | 2.75 | 3.75E−02 | caseonly |
| rs936671 | 4.56E−02 | cohort | 11/58/90 | 25/92/107 | 0.70 | 0.46 | 1.06 | 8.80E−02 | caseonly |
| rs3732136 | 6.98E−02 | cohort | 20/71/68 | 16/74/134 | 1.99 | 1.32 | 3.01 | 1.13E−03 | caseonly |
| rs17718867 | 6.28E−03 | cohort | 5/45/109 | 8/82/134 | 0.74 | 0.51 | 1.08 | 1.18E−01 | caseonly |
| rs5764592 | 5.39E−02 | cohort | 6/38/140 | 2/33/212 | 1.87 | 1.14 | 3.07 | 1.29E−02 | caseonly |
| rs2880563 | 6.81E−02 | cohort | 14/84/86 | 14/92/141 | 1.51 | 1.03 | 2.22 | 3.69E−02 | caseonly |
| rs1564078 | 3.95E−03 | cohort | 402/1248/992 | 447/1288/915 | 0.79 | 0.61 | 1.03 | 8.02E−02 | cohort |
| rs10817479 | 5.83E−03 | cohort | 0/32/152 | 2/31/214 | 1.37 | 0.81 | 2.33 | 2.42E−01 | caseonly |
| rs478859 | 6.17E−02 | cohort | 47/101/36 | 57/112/78 | 1.33 | 1.02 | 1.75 | 3.89E−02 | caseonly |
| rs10106852 | 1.15E−01 | cohort | 27/77/80 | 25/124/98 | 1.56 | 0.87 | 2.79 | 1.38E−01 | caseonly |
| rs12659030 | 1.21E−02 | cohort | 17/72/70 | 12/89/123 | 1.53 | 1.01 | 2.30 | 4.31E−02 | caseonly |
| rs1536506 | 1.06E−02 | cohort | 47/79/58 | 48/127/72 | 1.43 | 0.90 | 2.26 | 1.29E−01 | caseonly |
| rs2184393 | 7.98E−03 | cohort | 18/61/80 | 32/97/95 | 0.72 | 0.48 | 1.08 | 1.13E−01 | caseonly |
| rs11077308 | 1.75E−01 | cohort | 4/52/103 | 2/48/174 | 1.81 | 1.18 | 2.93 | 7.39E−03 | caseonly |
| rs7915250 | 1.04E−02 | cohort | 28/71/84 | 41/104/101 | 0.81 | 0.55 | 1.19 | 2.83E−01 | caseonly |
| rs4689078 | 3.84E−02 | cohort | 37/104/43 | 36/126/85 | 1.45 | 1.08 | 1.93 | 1.28E−02 | caseonly |
| rs2869680 | 8.13E−02 | cohort | 4/64/116 | 15/97/135 | 0.70 | 0.50 | 0.98 | 3.59E−02 | caseonly |
| rs12286877 | 3.26E−02 | cohort | 0/13/171 | 1/7/239 | 2.30 | 0.93 | 5.69 | 7.06E−02 | caseonly |
| rs10460737 | 2.98E−02 | cohort | 0/1/183 | 0/13/234 | 0.10 | 0.01 | 0.75 | 2.54E−02 | caseonly |

PROVEIT

| Marker | Atorv Count | Prav Count | OR | OR L95 | OR U95 | P value | Source | Model | End-point |
|---|---|---|---|---|---|---|---|---|---|
| rs13129010 | 6/47/138 | 5/51/196 | 1.39 | 0.89 | 2.16 | 1.44E−01 | caseonly | dom | CHD |
| rs4242281 | 37/78/76 | 27/127/98 | 2.08 | 1.20 | 3.60 | 8.70E−03 | caseonly | rec | CVD |
| rs6474228 | 9/87/95 | 19/90/143 | 1.32 | 0.90 | 1.93 | 1.52E−01 | caseonly | dom | CHD |
| rs4240808 | 28/97/66 | 59/123/70 | 0.56 | 0.34 | 0.92 | 2.26E−02 | caseonly | rec | CVD |
| rs13126170 | 6/37/148 | 7/81/164 | 0.53 | 0.34 | 0.82 | 4.23E−03 | caseonly | dom | CVD |
| rs7916629 | 21/82/86 | 15/101/136 | 2.11 | 1.05 | 4.26 | 3.73E−02 | caseonly | rec | CVD |
| rs11721179 | 14/41/136 | 12/80/160 | 0.64 | 0.41 | 0.99 | 4.53E−02 | caseonly | dom | CVD |
| rs2993156 | 11/57/123 | 23/84/145 | 0.75 | 0.50 | 1.10 | 1.42E−01 | caseonly | dom | CVD |
| rs10774580 | 26/85/80 | 40/132/80 | 0.63 | 0.43 | 0.94 | 2.27E−02 | caseonly | dom | CHD |
| rs16885715 | 10/60/121 | 9/67/176 | 1.34 | 0.89 | 2.02 | 1.59E−01 | caseonly | dom | CHD |
| rs4870109 | 37/78/76 | 28/124/98 | 1.97 | 1.14 | 3.40 | 1.48E−02 | caseonly | rec | CVD |
| rs17688430 | 4/51/136 | 10/77/165 | 0.77 | 0.54 | 1.11 | 1.57E−01 | caseonly | add | CVD |
| rs7332076 | 23/69/99 | 14/100/138 | 2.40 | 1.18 | 4.88 | 1.62E−02 | caseonly | rec | CVD |
| rs694780 | 19/106/66 | 50/108/94 | 0.40 | 0.21 | 0.73 | 3.11E−03 | caseonly | rec | CHD |
| rs4836745 | 13/76/102 | 25/119/108 | 0.65 | 0.44 | 0.96 | 2.82E−02 | caseonly | dom | CVD |
| rs7018577 | 15/79/97 | 18/83/151 | 1.44 | 0.98 | 2.12 | 6.13E−02 | caseonly | dom | CHD |
| rs11585647 | 10/26/155 | 14/61/177 | 0.49 | 0.30 | 0.80 | 4.76E−03 | caseonly | dom | CVD |
| rs4420312 | 8/56/127 | 10/106/136 | 0.59 | 0.40 | 0.87 | 8.31E−03 | caseonly | dom | CHD |
| rs7449527 | 8/61/122 | 8/60/184 | 1.53 | 1.01 | 2.30 | 4.28E−02 | caseonly | dom | CHD |
| rs7839562 | 47/95/49 | 39/125/88 | 1.54 | 1.01 | 2.34 | 4.35E−02 | caseonly | dom | CHD |
| rs2655222 | 3/80/108 | 17/71/164 | 0.23 | 0.07 | 0.80 | 2.09E−02 | caseonly | rec | CHD |
| rs2616548 | 8/57/126 | 2/52/198 | 2.02 | 1.28 | 3.16 | 2.29E−03 | caseonly | dom | CHD |
| rs10497883 | 3/57/131 | 13/88/151 | 0.68 | 0.48 | 0.96 | 2.91E−02 | caseonly | add | CHD |
| rs6998016 | 9/61/121 | 2/73/177 | 6.19 | 1.27 | 30.09 | 2.39E−02 | caseonly | rec | CHD |
| rs11148285 | 27/72/92 | 22/101/129 | 1.87 | 1.01 | 3.48 | 4.67E−02 | caseonly | rec | CVD |
| rs7305949 | 130/459/419 | 133/443/434 | 2.34 | 1.29 | 4.22 | 4.97E−03 | cohort | rec | CHD |
| rs264122 | 144/421/454 | 136/459/419 | 0.72 | 0.50 | 1.05 | 8.92E−02 | cohort | dom | CHD |
| rs1009748 | 121/455/444 | 118/435/460 | 1.43 | 1.09 | 1.88 | 1.06E−02 | cohort | add | CVD |
| rs1336400 | 151/404/459 | 116/431/465 | 1.46 | 1.00 | 2.12 | 4.82E−02 | cohort | dom | CHD |
| rs2108425 | 148/415/447 | 138/469/405 | 0.77 | 0.53 | 1.12 | 1.69E−01 | cohort | dom | CHD |
| rs2327412 | 122/453/443 | 119/431/463 | 1.38 | 1.05 | 1.81 | 2.08E−02 | cohort | add | CVD |
| rs17002013 | 54/346/616 | 57/351/604 | 1.38 | 0.94 | 2.02 | 9.55E−02 | cohort | dom | CVD |
| rs1015199 | 19/226/775 | 11/200/803 | 1.93 | 1.23 | 3.03 | 4.06E−03 | cohort | dom | CVD |
| rs7078016 | 140/415/466 | 112/439/466 | 1.41 | 0.97 | 2.04 | 7.29E−02 | cohort | dom | CVD |
| rs6585412 | 144/404/469 | 116/433/465 | 1.39 | 0.96 | 2.02 | 8.12E−02 | cohort | dom | CVD |
| rs198476 | 65/85/41 | 55/132/65 | 1.85 | 1.21 | 2.84 | 4.85E−03 | caseonly | rec | CHD |
| rs2648694 | 108/459/453 | 113/452/451 | 1.72 | 0.95 | 3.11 | 7.49E−02 | cohort | rec | CVD |
| rs10945874 | 22/196/799 | 20/201/795 | 1.72 | 1.15 | 2.58 | 8.16E−03 | cohort | add | CVD |
| rs1190706 | 103/476/441 | 129/443/445 | 0.76 | 0.52 | 1.10 | 1.42E−01 | cohort | dom | CVD |
| rs3763978 | 154/448/418 | 171/478/365 | 0.84 | 0.65 | 1.10 | 2.06E−01 | cohort | add | CVD |
| rs11138314 | 22/228/765 | 19/256/740 | 0.64 | 0.43 | 0.95 | 2.83E−02 | cohort | add | CHD |
| rs13107334 | 46/286/687 | 37/293/683 | 0.53 | 0.35 | 0.80 | 2.36E−03 | cohort | dom | CVD |
| rs6685920 | 28/243/750 | 19/227/771 | 1.45 | 0.93 | 2.25 | 9.96E−02 | cohort | dom | CVD |
| rs2616552 | 86/353/581 | 73/362/581 | 1.55 | 1.15 | 2.08 | 3.98E−03 | cohort | add | CHD |

TABLE 6-continued

| | | | | | | | | | |
|---|---|---|---|---|---|---|---|---|---|
| rs2110564 | 182/476/360 | 204/470/341 | 0.60 | 0.40 | 0.89 | 1.17E−02 | cohort | dom | CVD |
| rs10012485 | 61/341/619 | 47/357/613 | 0.54 | 0.36 | 0.79 | 1.78E−03 | cohort | dom | CVD |
| rs1798093 | 187/469/364 | 160/456/396 | 2.00 | 1.17 | 3.42 | 1.13E−02 | cohort | rec | CHD |
| rs4787415 | 33/101/57 | 64/118/70 | 0.62 | 0.38 | 0.99 | 4.76E−02 | caseonly | rec | CHD |
| rs11734256 | 219/511/278 | 226/491/287 | 0.57 | 0.36 | 0.89 | 1.46E−02 | cohort | rec | CVD |
| rs1266489 | 169/473/368 | 180/468/364 | 0.67 | 0.45 | 0.98 | 4.00E−02 | cohort | dom | CVD |
| rs238250 | 22/239/759 | 22/241/752 | 1.24 | 0.86 | 1.80 | 2.50E−01 | cohort | add | CVD |
| rs2588350 | 52/340/616 | 41/363/606 | 0.82 | 0.59 | 1.13 | 2.30E−01 | cohort | add | CVD |
| rs498657 | 8/66/117 | 4/69/179 | 1.57 | 1.10 | 2.24 | 1.40E−02 | caseonly | add | CHD |
| rs6427807 | 157/456/393 | 179/464/369 | 0.66 | 0.45 | 0.97 | 3.26E−02 | cohort | dom | CVD |
| rs619825 | 19/107/65 | 50/109/93 | 0.40 | 0.21 | 0.73 | 3.11E−03 | caseonly | rec | CHD |
| rs9478241 | 37/78/76 | 27/127/98 | 2.08 | 1.20 | 3.60 | 8.70E−03 | caseonly | rec | CVD |
| rs1727746 | 154/450/409 | 120/441/449 | 1.30 | 0.89 | 1.90 | 1.68E−02 | cohort | dom | CVD |
| rs2505039 | 252/494/269 | 254/499/258 | 0.84 | 0.65 | 1.09 | 1.97E−01 | cohort | add | CHD |
| rs4472926 | 22/63/106 | 29/123/100 | 0.53 | 0.36 | 0.78 | 1.17E−03 | caseonly | dom | CHD |
| rs6539231 | 51/80/60 | 60/131/61 | 0.68 | 0.45 | 1.05 | 7.89E−02 | caseonly | dom | CVD |
| rs7959965 | 34/92/65 | 67/115/70 | 0.74 | 0.57 | 0.97 | 2.87E−02 | caseonly | add | CVD |
| rs974950 | 179/455/376 | 201/455/352 | 0.64 | 0.43 | 0.94 | 2.37E−02 | cohort | dom | CVD |
| rs1524962 | 11/64/116 | 15/105/132 | 0.80 | 0.58 | 1.10 | 1.70E−01 | caseonly | add | CHD |
| rs17821383 | 5/70/116 | 18/89/145 | 0.35 | 0.13 | 0.96 | 4.18E−02 | caseonly | rec | CHD |
| rs10518335 | 9/47/135 | 9/99/143 | 0.55 | 0.37 | 0.82 | 3.26E−03 | caseonly | dom | CVD |
| rs12265891 | 53/82/56 | 39/127/85 | 2.13 | 1.33 | 3.41 | 1.78E−03 | caseonly | rec | CHD |
| rs4807536 | 1/16/174 | 1/14/237 | 1.53 | 0.74 | 3.16 | 2.50E−01 | caseonly | dom | CVD |
| rs9914580 | 3/41/147 | 10/82/160 | 0.51 | 0.33 | 0.78 | 2.05E−03 | caseonly | dom | CHD |
| rs646749 | 19/106/66 | 50/108/94 | 0.40 | 0.21 | 0.73 | 3.11E−03 | caseonly | rec | CHD |
| rs1003322 | 11/70/110 | 5/82/165 | 1.41 | 0.95 | 2.08 | 8.60E−02 | caseonly | dom | CHD |
| rs4660234 | 28/238/750 | 20/222/774 | 1.45 | 0.93 | 2.25 | 9.97E−02 | cohort | dom | CHD |
| rs4038018 | 44/88/59 | 68/119/65 | 0.76 | 0.50 | 1.17 | 2.11E−01 | caseonly | dom | CHD |
| rs7710039 | 11/63/117 | 17/102/133 | 0.70 | 0.48 | 1.03 | 7.21E−02 | caseonly | dom | CVD |
| rs13150189 | 7/70/114 | 18/65/169 | 1.36 | 0.92 | 2.02 | 1.22E−01 | caseonly | dom | CVD |
| rs12646525 | 65/338/616 | 46/360/605 | 0.59 | 0.40 | 0.87 | 7.91E−03 | cohort | dom | CVD |
| rs2113334 | 7/73/111 | 27/92/133 | 0.29 | 0.12 | 0.70 | 6.07E−03 | caseonly | rec | CVD |
| rs251817 | 1/22/168 | 0/17/235 | 2.02 | 1.06 | 3.86 | 3.35E−02 | caseonly | add | CVD |
| rs2574 | 258/474/287 | 237/537/242 | 1.62 | 1.07 | 2.44 | 2.30E−02 | cohort | rec | CVD |
| rs12679254 | 19/77/95 | 26/115/111 | 0.79 | 0.53 | 1.16 | 2.21E−01 | caseonly | dom | CVD |
| rs12341095 | 79/404/536 | 64/384/565 | 1.63 | 0.82 | 3.24 | 1.68E−01 | cohort | rec | CHD |
| rs17048681 | 30/91/70 | 30/114/108 | 1.25 | 0.95 | 1.66 | 1.15E−01 | caseonly | add | CVD |
| rs1942876 | 18/108/65 | 48/108/96 | 0.41 | 0.23 | 0.76 | 4.18E−02 | caseonly | rec | CHD |
| rs2657940 | 7/75/109 | 12/80/160 | 1.20 | 0.86 | 1.67 | 2.77E−01 | caseonly | add | CHD |
| rs494111 | 19/107/65 | 49/109/94 | 0.44 | 0.25 | 0.79 | 5.96E−03 | caseonly | rec | CHD |
| rs2060022 | 42/81/68 | 72/101/79 | 0.72 | 0.46 | 1.12 | 1.40E−01 | caseonly | rec | CVD |
| rs7338174 | 1/24/166 | 1/14/237 | 2.50 | 1.25 | 4.99 | 9.45E−02 | caseonly | dom | CHD |
| rs12048902 | 20/77/94 | 53/90/109 | 0.72 | 0.55 | 0.94 | 1.73E−02 | caseonly | add | CVD |
| rs6746182 | 73/376/568 | 65/375/576 | 1.25 | 0.86 | 1.81 | 2.38E−01 | cohort | dom | CHD |
| rs7276749 | 4/84/931 | 4/108/904 | 0.45 | 0.22 | 0.90 | 2.45E−02 | cohort | dom | CVD |
| rs198460 | 273/496/244 | 243/509/253 | 1.55 | 1.02 | 2.36 | 3.93E−02 | cohort | rec | CHD |
| rs7785499 | 258/486/267 | 214/516/281 | 1.68 | 1.09 | 2.61 | 1.97E−02 | cohort | rec | CVD |
| rs996022 | 18/108/65 | 48/108/96 | 0.41 | 0.23 | 0.76 | 4.18E−03 | caseonly | rec | CHD |
| rs7222186 | 2/40/148 | 9/82/161 | 0.50 | 0.32 | 0.77 | 1.48E−03 | caseonly | dom | CHD |
| rs198464 | 291/482/231 | 263/493/248 | 1.44 | 0.96 | 2.17 | 7.90E−02 | cohort | rec | CHD |
| rs16934059 | 119/460/439 | 121/463/430 | 0.65 | 0.45 | 0.95 | 2.65E−02 | cohort | dom | CHD |
| rs1566221 | 4/99/917 | 3/125/887 | 0.68 | 0.37 | 1.26 | 2.22E−01 | cohort | add | CHD |
| rs8129810 | 3/84/933 | 5/107/902 | 0.45 | 0.22 | 0.91 | 2.69E−02 | cohort | dom | CVD |
| rs1344081 | 8/61/122 | 8/68/176 | 1.31 | 0.88 | 1.96 | 1.86E−01 | caseonly | dom | CHD |
| rs7918692 | 0/52/139 | 3/48/201 | 1.48 | 0.95 | 2.32 | 8.37E−02 | caseonly | dom | CVD |
| rs4686740 | 53/85/53 | 45/141/66 | 1.86 | 1.17 | 2.97 | 8.84E−03 | caseonly | rec | CVD |
| rs12817873 | 165/458/398 | 179/482/355 | 0.85 | 0.65 | 1.10 | 2.15E−01 | cohort | add | CVD |
| rs7508 | 10/91/90 | 15/87/150 | 1.65 | 1.13 | 2.43 | 1.03E−02 | caseonly | dom | CHD |
| rs271046 | 29/89/73 | 50/103/99 | 0.68 | 0.40 | 1.18 | 1.74E−01 | caseonly | rec | CHD |
| rs2011318 | 1/34/156 | 3/64/185 | 0.63 | 0.40 | 0.99 | 4.35E−02 | caseonly | add | CHD |
| rs1136046 | 5/47/139 | 2/50/200 | 1.48 | 0.98 | 2.22 | 6.15E−02 | caseonly | add | CVD |
| rs1450092 | 6/51/134 | 10/79/163 | 0.81 | 0.57 | 1.15 | 2.41E−01 | caseonly | add | CHD |
| rs7070244 | 3/56/132 | 5/56/191 | 1.30 | 0.87 | 1.94 | 2.06E−01 | caseonly | add | CVD |
| rs892162 | 29/99/63 | 54/127/71 | 0.64 | 0.39 | 1.06 | 8.48E−02 | caseonly | rec | CHD |
| rs6563805 | 3/29/159 | 8/66/178 | 0.53 | 0.35 | 0.80 | 2.73E−03 | caseonly | add | CHD |
| rs9906737 | 2/43/146 | 9/83/160 | 0.53 | 0.35 | 0.81 | 3.19E−03 | caseonly | dom | CHD |
| rs475420 | 2/38/151 | 1/36/215 | 1.57 | 0.95 | 2.59 | 7.80E−02 | caseonly | dom | CVD |
| rs17644708 | 7/101/83 | 25/122/105 | 0.34 | 0.14 | 0.81 | 1.45E−02 | caseonly | rec | CVD |
| rs7067780 | 3/53/135 | 7/50/195 | 1.41 | 0.91 | 2.18 | 1.24E−01 | caseonly | dom | CVD |
| rs4773 | 28/86/77 | 52/120/80 | 0.68 | 0.45 | 1.01 | 5.68E−02 | caseonly | dom | CVD |
| rs6742894 | 60/81/50 | 50/138/64 | 1.94 | 1.24 | 3.03 | 3.53E−03 | caseonly | rec | CVD |
| rs1045916 | 15/61/115 | 20/103/129 | 0.79 | 0.58 | 1.07 | 1.29E−01 | caseonly | add | CHD |
| rs6435378 | 33/84/74 | 46/125/81 | 0.74 | 0.50 | 1.10 | 1.40E−01 | caseonly | dom | CHD |
| rs13411119 | 23/82/86 | 24/98/130 | 1.32 | 0.89 | 1.94 | 1.69E−01 | caseonly | dom | CVD |
| rs1531842 | 17/74/100 | 21/123/108 | 0.67 | 0.46 | 0.99 | 4.15E−02 | caseonly | dom | CHD |
| rs9857 | 12/63/116 | 15/108/129 | 0.78 | 0.57 | 1.07 | 1.18E−01 | caseonly | add | CVD |
| rs9960 | 11/57/123 | 8/64/180 | 1.37 | 0.92 | 2.06 | 1.25E−01 | caseonly | dom | CVD |
| rs13103899 | 6/37/148 | 7/82/163 | 0.53 | 0.34 | 0.81 | 3.72E−03 | caseonly | dom | CVD |
| rs6848512 | 48/84/59 | 65/131/56 | 0.64 | 0.41 | 0.98 | 4.02E−02 | caseonly | dom | CVD |
| rs10181805 | 16/60/115 | 10/79/163 | 1.28 | 0.93 | 1.75 | 1.27E−01 | caseonly | add | CVD |

TABLE 6-continued

| | | | | | | | | | |
|---|---|---|---|---|---|---|---|---|---|
| rs1129570 | 10/65/116 | 6/73/173 | 1.41 | 1.00 | 1.98 | 4.80E−02 | caseonly | add | CHD |
| rs9986576 | 36/79/76 | 27/126/98 | 2.00 | 1.15 | 3.47 | 1.36E−02 | caseonly | rec | CVD |
| rs1352236 | 10/84/97 | 30/93/129 | 0.39 | 0.18 | 0.84 | 1.60E−02 | caseonly | rec | CHD |
| rs7770578 | 3/35/153 | 6/66/180 | 0.65 | 0.43 | 0.99 | 4.58E−02 | caseonly | add | CHD |
| rs2748901 | 226/504/290 | 196/502/318 | 1.43 | 0.92 | 2.23 | 1.14E−01 | cohort | rec | CHD |
| rs1155875 | 32/84/75 | 58/111/83 | 0.79 | 0.61 | 1.03 | 7.69E−02 | caseonly | add | CHD |
| rs675163 | 1/33/157 | 5/64/183 | 0.58 | 0.38 | 0.90 | 1.44E−02 | caseonly | add | CVD |
| rs1068705 | 44/84/63 | 55/141/56 | 0.58 | 0.38 | 0.89 | 1.23E−02 | caseonly | dom | CHD |
| rs1505469 | 5/44/142 | 2/36/213 | 1.85 | 1.20 | 2.85 | 5.58E−03 | caseonly | add | CHD |
| rs623400 | 20/55/116 | 25/100/127 | 0.65 | 0.44 | 0.96 | 3.00E−02 | caseonly | dom | CVD |
| rs6040760 | 21/70/99 | 18/84/150 | 1.34 | 0.91 | 1.97 | 1.35E−01 | caseonly | dom | CVD |
| rs17310169 | 4/43/143 | 9/79/164 | 0.61 | 0.40 | 0.92 | 2.01E−02 | caseonly | dom | CVD |
| rs7623808 | 7/37/147 | 2/55/195 | 4.79 | 0.98 | 23.38 | 5.28E−02 | caseonly | rec | CVD |
| rs77638540 | 6/76/935 | 4/106/906 | 0.49 | 0.24 | 1.00 | 5.04E−02 | cohort | dom | CVD |
| rs581401 | 137/494/385 | 185/471/359 | 0.54 | 0.31 | 0.95 | 3.34E−02 | cohort | rec | CHD |
| rs4251580 | 4/28/159 | 4/63/185 | 0.64 | 0.42 | 0.98 | 4.06E−02 | caseonly | add | CVD |
| rs603940 | 136/503/380 | 182/481/354 | 0.55 | 0.31 | 0.98 | 3.64E−02 | cohort | rec | CHD |
| rs13117043 | 6/61/124 | 5/55/192 | 1.74 | 1.15 | 2.64 | 9.53E−03 | caseonly | dom | CHD |
| rs3800202 | 2/67/937 | 1/77/922 | 0.59 | 0.29 | 1.20 | 1.43E−01 | cohort | add | CHD |
| rs10738948 | 14/99/78 | 43/120/88 | 0.68 | 0.51 | 0.91 | 9.76E−03 | caseonly | add | CHD |
| rs623584 | 141/482/390 | 186/460/360 | 0.56 | 0.33 | 0.98 | 4.18E−02 | cohort | rec | CHD |
| rs9557509 | 8/47/136 | 5/55/192 | 1.29 | 0.83 | 2.00 | 2.62E−01 | caseonly | dom | CHD |
| rs11668038 | 16/82/93 | 15/83/154 | 1.54 | 1.11 | 2.12 | 8.96E−03 | caseonly | add | CHD |
| rs10802865 | 57/88/46 | 49/137/66 | 1.29 | 0.98 | 1.69 | 6.73E−02 | caseonly | add | CHD |
| rs17035071 | 10/73/108 | 8/73/171 | 1.60 | 1.07 | 2.37 | 2.06E−02 | caseonly | dom | CHD |
| rs1439269 | 21/83/87 | 22/97/133 | 1.27 | 0.94 | 1.72 | 1.25E−01 | caseonly | add | CHD |
| rs208025 | 8/80/102 | 11/78/162 | 1.55 | 1.05 | 2.29 | 2.60E−02 | caseonly | dom | CVD |
| rs12608167 | 23/209/785 | 21/253/740 | 0.63 | 0.40 | 0.98 | 4.24E−02 | cohort | dom | CVD |
| rs133871 | 19/73/99 | 27/124/101 | 0.59 | 0.40 | 0.87 | 8.11E−03 | caseonly | dom | CHD |
| rs7068975 | 0/33/158 | 1/34/216 | 1.32 | 0.78 | 2.22 | 3.05E−01 | caseonly | dom | CHD |
| rs1866386 | 6/61/124 | 12/93/147 | 0.77 | 0.55 | 1.08 | 1.32E−01 | caseonly | add | CVD |
| rs1580713 | 39/103/49 | 37/138/77 | 1.55 | 0.94 | 2.56 | 8.88E−02 | caseonly | rec | CHD |
| rs936671 | 14/60/117 | 21/102/129 | 0.64 | 0.44 | 0.95 | 2.62E−02 | caseonly | dom | CHD |
| rs3732136 | 22/84/85 | 25/94/133 | 1.42 | 0.96 | 2.09 | 8.12E−02 | caseonly | dom | CHD |
| rs17718867 | 5/51/135 | 10/79/163 | 0.77 | 0.54 | 1.10 | 1.57E−01 | caseonly | add | CHD |
| rs5764592 | 3/44/144 | 6/41/205 | 1.48 | 0.91 | 2.42 | 1.15E−01 | caseonly | dom | CVD |
| rs2880563 | 15/85/90 | 23/86/143 | 1.51 | 1.02 | 2.24 | 3.78E−02 | caseonly | dom | CVD |
| rs1564078 | 29/98/64 | 53/115/84 | 0.86 | 0.66 | 1.14 | 2.98E−01 | caseonly | add | CHD |
| rs10817479 | 2/23/166 | 0/20/232 | 1.77 | 0.95 | 3.31 | 7.42E−02 | caseonly | dom | CVD |
| rs478859 | 49/92/50 | 59/99/94 | 1.32 | 1.01 | 1.73 | 4.14E−02 | caseonly | add | CVD |
| rs10106852 | 40/78/73 | 28/118/106 | 2.19 | 1.29 | 3.71 | 3.79E−03 | caseonly | rec | CVD |
| rs12659030 | 10/82/99 | 16/92/144 | 1.27 | 0.86 | 1.86 | 2.24E−01 | caseonly | dom | CHD |
| rs1536506 | 56/80/55 | 56/132/64 | 1.44 | 0.93 | 2.23 | 1.05E−01 | caseonly | rec | CVD |
| rs2184393 | 30/78/83 | 44/116/92 | 0.75 | 0.51 | 1.11 | 1.51E−01 | caseonly | dom | CHD |
| rs11077308 | 1/63/127 | 4/58/190 | 1.55 | 1.02 | 2.36 | 3.98E−02 | caseonly | dom | CHD |
| rs7915250 | 33/78/80 | 41/128/83 | 0.66 | 0.44 | 0.99 | 4.43E−02 | caseonly | dom | CVD |
| rs4689078 | 39/98/54 | 44/123/85 | 1.20 | 0.91 | 1.57 | 2.00E−01 | caseonly | add | CVD |
| rs2869680 | 7/72/112 | 21/103/128 | 0.72 | 0.52 | 0.99 | 4.22E−02 | caseonly | add | CVD |
| rs12286877 | 1/18/172 | 1/13/236 | 2.05 | 0.92 | 4.57 | 8.07E−02 | caseonly | dom | CVD |
| rs10460737 | 0/1/190 | 1/11/240 | 0.10 | 0.01 | 0.85 | 3.53E−02 | caseonly | add | CVD |

TABLE 7

| Marker | allele A1 (non-ref) | allele A2 (ref) | Meta-analysis OR | OR L95 | OR U95 | P value (random) | Prava Count | Placebo Count | CARE OR | OR L95 | OR U95 | P value | Source | WOSCOPS Prava Count | WOSCOPS Placebo Count |
|---|---|---|---|---|---|---|---|---|---|---|---|---|---|---|---|
| rs1336400 | A | G | 1.56 | 1.28 | 1.89 | 7.06E-06 | 306/1284/1371 | 152/631/686 | 1.68 | 1.27 | 2.22 | 2.79E-04 | cohort | | |
| rs10787944 | G | A | | | | | 32/172/152 | 40/162/240 | 1.63 | 1.22 | 2.17 | 8.59E-04 | Caseonly | 19/81/82 | 22/91/132 |
| rs13103899 | G | A | 0.67 | 0.54 | 0.83 | 2.51E-04 | 81/850/1955 | 39/434/961 | 0.70 | 0.52 | 0.95 | 2.39E-02 | cohort | | |
| rs13121569 | G | A | | | | | 6/91/260 | 13/147/284 | 0.66 | 0.49 | 0.89 | 7.50E-03 | Caseonly | 5/53/126 | 8/83/156 |
| rs6563805 | A | G | 0.64 | 0.50 | 0.82 | 4.51E-04 | 42/350/1102 | 35/383/1052 | 0.76 | 0.56 | 1.04 | 8.26E-02 | cohort | | |
| rs1324012 | A | G | | | | | 5/68/227 | 9/105/268 | 0.78 | 0.57 | 1.06 | 1.15E-01 | Caseonly | 2/26/129 | 4/57/163 |
| rs17048681 | G | T | 1.30 | 1.13 | 1.50 | 2.15E-04 | 239/709/546 | 219/690/562 | 1.26 | 1.03 | 1.54 | 2.34E-02 | cohort | | |
| rs1559557 | G | A | | | | | 55/182/120 | 51/200/193 | 1.34 | 1.09 | 1.65 | 6.39E-03 | Caseonly | 48/85/51 | 33/127/87 |
| rs7132840 | T | G | 0.74 | 0.65 | 0.86 | 3.61E-05 | 341/693/418 | 312/761/361 | 0.75 | 0.61 | 0.91 | 4.20E-03 | cohort | | |
| rs1877527 | G | A | | | | | 59/177/121 | 92/238/114 | 0.75 | 0.61 | 0.93 | 7.37E-03 | Caseonly | 32/83/69 | 46/137/64 |
| rs12635482 | C | A | 0.61 | 0.45 | 0.81 | 7.53E-04 | 235/712/548 | 275/738/458 | 0.54 | 0.34 | 0.86 | 8.70E-03 | cohort | | |
| rs1917527 | A | C | | | | | 22/152/126 | 70/194/118 | 0.34 | 0.21 | 0.57 | 4.02E-05 | Caseonly | 27/74/58 | 50/99/75 |
| rs198476 | G | A | 1.69 | 1.34 | 2.13 | 1.17E-05 | 340/768/384 | 326/759/385 | 1.58 | 1.09 | 2.30 | 1.68E-02 | cohort | 613/1353/665 | 588/1343/710 |
| rs198462 | G | A | | | | | 74/153/73 | 67/214/101 | 1.57 | 1.08 | 2.28 | 1.90E-02 | Caseonly | 50/69/40 | 41/122/61 |
| rs11178579 | T | G | 0.77 | 0.67 | 0.89 | 2.86E-04 | 259/693/542 | 245/735/490 | 0.76 | 0.63 | 0.93 | 8.77E-03 | cohort | | |
| rs2132241 | A | G | | | | | 51/153/153 | 74/228/142 | 0.74 | 0.60 | 0.90 | 3.60E-03 | Caseonly | 20/89/75 | 41/132/74 |
| rs3844207 | G | C | 0.75 | 0.65 | 0.86 | 4.20E-05 | 321/694/479 | 295/766/409 | 0.73 | 0.60 | 0.89 | 2.08E-03 | cohort | | |
| rs2270588 | G | A | | | | | 59/165/133 | 93/235/116 | 0.72 | 0.59 | 0.88 | 1.46E-03 | Caseonly | 28/87/69 | 45/136/66 |
| rs304597 | A | G | 2.70 | 1.54 | 4.73 | 5.08E-04 | 61/409/980 | 48/448/938 | 1.95 | 0.89 | 4.29 | 9.56E-02 | cohort | | |
| rs304601 | C | A | | | | | 18/101/238 | 10/144/290 | 2.28 | 1.03 | 5.03 | 4.10E-02 | Caseonly | 10/55/119 | 4/75/168 |
| rs12553453 | A | C | 1.32 | 1.12 | 1.56 | 7.32E-04 | 314/693/445 | 292/668/473 | 1.22 | 0.98 | 1.50 | 7.15E-02 | cohort | | |
| rs471579 | C | T | | | | | 70/142/88 | 72/174/136 | 1.26 | 1.02 | 1.56 | 3.39E-02 | Caseonly | 32/82/45 | 27/103/94 |
| rs2768652 | A | T | 1.33 | 1.14 | 1.54 | 1.76E-04 | 261/675/514 | 241/665/527 | 1.22 | 0.98 | 1.51 | 7.06E-02 | cohort | | |
| rs7873371 | T | G | | | | | 70/143/87 | 73/175/134 | 1.25 | 1.01 | 1.55 | 4.05E-02 | Caseonly | 32/82/45 | 28/103/93 |
| rs11178579 | A | C | 0.77 | 0.67 | 0.88 | 2.30E-04 | 259/693/542 | 245/735/490 | 0.76 | 0.63 | 0.93 | 8.77E-03 | cohort | | |
| rs9325191 | T | C | | | | | 51/154/152 | 74/228/142 | 0.74 | 0.60 | 0.91 | 4.36E-03 | Caseonly | 20/89/75 | 41/134/72 |
| rs10945874 | A | G | 1.59 | 1.28 | 1.97 | 2.76E-05 | 19/277/1197 | 23/270/1178 | 1.72 | 1.25 | 2.36 | 8.43E-04 | cohort | | |
| rs9346951 | G | C | | | | | 7/76/274 | 4/67/373 | 1.56 | 1.12 | 2.15 | 7.68E-03 | Caseonly | 2/42/140 | 3/45/199 |
| rs13107334 | G | T | 0.69 | 0.58 | 0.83 | 5.80E-05 | 104/895/1967 | 52/452/967 | 0.69 | 0.53 | 0.89 | 4.84E-03 | cohort | | |
| rs988146 | G | A | | | | | 6/88/263 | 13/146/285 | 0.66 | 0.50 | 0.87 | 3.02E-03 | Caseonly | 5/53/126 | 9/82/156 |

TABLE 7-continued

| Marker | WOSCOPS | | | | | | PROVEIT | | | | | | End-point |
|---|---|---|---|---|---|---|---|---|---|---|---|---|---|
| | OR | OR L95 | OR U95 | P value | Atorv Count | Prav Count | Source | OR | OR L95 | OR U95 | P value | Source | Model |
| rs1336400 | | | | | 151/404/459 | 116/431/465 | | 1.46 | 1.00 | 2.12 | 4.82E-02 | cohort | dom | CVD |
| rs10787944 | 1.45 | 0.99 | 2.14 | 5.84E-02 | 29/84/77 | 29/101/122 | Caseonly | 1.37 | 0.93 | 2.01 | 1.15E-01 | Caseonly | dom | CVD |
| rs13103899 | | | | | | | | | | | | | dom | CVD |
| rs13121569 | 0.78 | 0.52 | 1.17 | 2.32E-01 | 6/38/147 | 7/84/161 | Caseonly | 0.52 | 0.34 | 0.80 | 3.10E-03 | Caseonly | dom | CVD |
| rs6563805 | | | | | | | | | | | | | add | CHD |
| rs1324012 | 0.60 | 0.38 | 0.96 | 3.12E-02 | 3/30/158 | 10/68/174 | Caseonly | 0.51 | 0.34 | 0.76 | 1.08E-03 | Caseonly | add | CHD |
| rs17048681 | | | | | | | | | | | | | add | CVD |
| rs1559557 | 1.53 | 1.16 | 2.02 | 2.89E-03 | 32/83/76 | 30/114/108 | Caseonly | 1.19 | 0.90 | 1.56 | 2.26E-01 | Caseonly | add | CVD |
| rs7132840 | | | | | | | | | | | | | add | CVD |
| rs1877527 | 0.77 | 0.58 | 1.02 | 6.90E-02 | 31/93/67 | 64/117/71 | Caseonly | 0.72 | 0.55 | 0.94 | 1.70E-02 | Caseonly | add | CHD |
| rs12635482 | | | | | | | Caseonly cohort | | | | | | rec | CHD |
| rs1917527 | 0.73 | 0.44 | 1.24 | 2.46E-01 | 22/98/70 | 48/117/87 | Caseonly | 0.57 | 0.33 | 1.00 | 4.86E-02 | Caseonly | rec | CHD |
| rs198476 | 1.61 | 1.06 | 2.46 | 2.63E-02 | | | | | | | | | rec | CHD |
| rs198462 | 2.12 | 1.31 | 3.42 | 2.23E-03 | 67/83/41 | 55/132/65 | Caseonly | 1.92 | 1.26 | 2.94 | 2.58E-03 | Caseonly | rec | CHD |
| rs11178579 | | | | | 162/444/403 | 177/462/365 | | 0.85 | 0.65 | 1.10 | 2.20E-01 | cohort | add | CHD |
| rs2132241 | 0.70 | 0.52 | 0.94 | 1.66E-02 | 26/87/78 | 45/121/86 | Caseonly | 0.79 | 0.60 | 1.04 | 9.47E-02 | Caseonly | add | CVD |
| rs3844207 | | | | | 190/491/336 | 235/471/306 | | 0.78 | 0.60 | 1.01 | 5.47E-02 | cohort | add | CVD |
| rs2270588 | 0.75 | 0.57 | 1.00 | 5.34E-02 | 30/93/68 | 62/122/68 | Caseonly | 0.70 | 0.53 | 0.92 | 1.07E-02 | Caseonly | rec | CVD |
| rs304597 | | | | | | | | | | | | | rec | CVD |
| rs304601 | 3.93 | 1.20 | 12.87 | 2.38E-02 | 13/52/126 | 6/70/176 | Caseonly | 3.63 | 1.24 | 10.64 | 1.88E-02 | Caseonly | add | CHD |
| rs12553453 | | | | | | | | | | | | | add | CHD |
| rs471579 | 1.62 | 1.20 | 2.19 | 1.84E-03 | 48/80/63 | 35/132/85 | Caseonly | 1.27 | 0.97 | 1.66 | 8.39E-02 | Caseonly | add | CHD |
| rs2768652 | | | | | | | | | | | | | add | CHD |
| rs7873371 | 1.59 | 1.17 | 2.15 | 2.68E-03 | 47/82/62 | 35/129/88 | Caseonly | 1.31 | 1.00 | 1.71 | 5.23E-02 | Caseonly | add | CHD |
| rs11178579 | | | | | 162/444/403 | 177/462/365 | | 0.85 | 0.65 | 1.10 | 2.20E-01 | cohort | add | CVD |
| rs9325191 | 0.69 | 0.51 | 0.92 | 1.19E-02 | 26/86/79 | 45/121/86 | Caseonly | 0.78 | 0.59 | 1.03 | 7.96E-02 | Caseonly | add | CVD |
| rs10945874 | | | | | 22/196/799 | 20/201/795 | | 1.72 | 1.15 | 2.58 | 8.16E-03 | cohort | add | CVD |
| rs9346951 | 1.25 | 0.81 | 1.92 | 3.09E-01 | 5/45/141 | 0/43/209 | Caseonly | 1.88 | 1.22 | 2.91 | 4.63E-03 | Caseonly | add | CVD |
| rs13107334 | | | | | 46/286/687 | 37/293/683 | | 0.60 | 0.43 | 0.86 | 4.97E-03 | cohort | add | CVD |
| rs988146 | 0.80 | 0.56 | 1.14 | 2.15E-01 | 6/37/148 | 7/80/165 | Caseonly | 0.64 | 0.44 | 0.93 | 2.04E-02 | Caseonly | add | CVD |

TABLE 8

| Original SNP (rs #) | Genotyped SNP (rs #) | LD (r^2) |
|---|---|---|
| rs10193722 | rs11124322 | 1 |
| rs1051334 | rs1051344 | 0.9637 |
| rs10740308 | rs2030057 | 0.9457 |
| rs10831415 | rs10831416 | 1 |
| rs1229430 | rs4657668 | 0.9445 |
| rs12914132 | rs6497117 | 0.9642 |
| rs1594887 | rs1529806 | 1 |
| rs16861476 | rs3732788 | 1 |
| rs1737478 | rs1773549 | 1 |
| rs2196180 | rs1560901 | 1 |
| rs231358 | rs231355 | 0.9636 |
| rs2335451 | rs10875941 | 1 |
| rs2358931 | rs9834251 | 0.8864 |
| rs2593270 | rs4765531 | 1 |
| rs2656824 | rs4765531 | 1 |
| rs302296 | rs302290 | 1 |
| rs3793048 | rs3806005 | 1 |
| rs3861810 | rs1560901 | 1 |
| rs4128766 | rs7179134 | 0.951 |
| rs4242084 | rs2148575 | 1 |
| rs4328731 | rs5756670 | 1 |
| rs4980176 | rs7094941 | 1 |
| rs6550706 | rs1851830 | 1 |
| rs6950121 | rs10275879 | 1 |
| rs7751843 | rs7765440 | 1 |
| rs7901888 | rs2030057 | 1 |
| rs7913568 | rs3998860 | 0.9736 |
| rs9467561 | rs6931627 | 1 |
| rs9554735 | rs912366 | 0.9646 |
| rs10787944 | rs1336400 | 1 |
| rs13121569 | rs13103899 | 1 |
| rs1324012 | rs6563805 | 1 |
| rs1559557 | rs17048681 | 0.8814 |
| rs1877527 | rs7132840 | 0.9591 |
| rs1917527 | rs12635482 | 0.9293 |
| rs198462 | rs198476 | 0.9823 |
| rs2132241 | rs11178579 | 1 |
| rs2270588 | rs3844207 | 1 |
| rs304601 | rs304597 | 0.9732 |
| rs471579 | rs12553453 | 0.931 |
| rs7873371 | rs2768652 | 0.8956 |
| rs9325191 | rs11178579 | 1 |
| rs9346951 | rs10945874 | 0.9567 |
| rs988146 | rs13107334 | 0.9491 |

TABLE 9

| SNP rs # | SOURCE | ALLELE (A1) | MODEL | NMISS | OR | SE | L95 | U95 | STAT | P | HW_PVALUE | ALLELE_FREQ | PRAVA_ALLELE_FREQ | PLACEBO_ALLELE_FREQ |
|---|---|---|---|---|---|---|---|---|---|---|---|---|---|---|
| rs198460 | Genotyped | G | REC | 682 | 1.552 | 0.1926 | 1.064 | 2.264 | 2.284 | 0.02238 | 0.02592 | 0.47507 | 0.50167 | 0.4542 |
| rs603940 | Genotyped | G | REC | 682 | 0.614 | 0.2233 | 0.3962 | 0.9509 | -2.185 | 0.02885 | 0.812 | 0.40469 | 0.38833 | 0.4175 |
| rs10021016 | Genotyped | G | GEN | 682 | | | | | 7.495 | 0.02358 | 0.8438 | 0.26393 | 0.29667 | 0.2382 |
| rs1003148 | Imputed | C | ADD | 674 | 0.691 | 0.1112 | 0.5556 | 0.8592 | -3.325 | 0.000885 | 0.04475 | 0.40059 | 0.34783 | 0.4427 |
| rs1003148 | Imputed | C | GEN | 674 | | | | | 11.71 | 0.002865 | 0.04475 | 0.40059 | 0.34783 | 0.4427 |
| rs1003148 | Imputed | C | REC | 674 | 0.511 | 0.2158 | 0.3345 | 0.7794 | -3.115 | 0.001839 | 0.04475 | 0.40059 | 0.34783 | 0.4427 |
| rs10046799 | Imputed | C | ADD | 671 | 0.784 | 0.1099 | 0.6321 | 0.9726 | -2.212 | 0.02694 | 0.1595 | 0.55365 | 0.52055 | 0.5792 |
| rs10046799 | Imputed | C | GEN | 671 | | | | | 4.972 | 0.08326 | 0.1595 | 0.55365 | 0.52055 | 0.5792 |
| rs10051148 | Imputed | C | DOM | 681 | 0.561 | 0.1597 | 0.4104 | 0.7675 | -3.617 | 0.000298 | 0.9326 | 0.34728 | 0.30833 | 0.378 |
| rs10054055 | Imputed | T | DOM | 681 | 0.561 | 0.1597 | 0.4104 | 0.7675 | -3.617 | 0.000298 | 0.9326 | 0.34728 | 0.30833 | 0.378 |
| rs10067895 | Imputed | A | DOM | 672 | 0.561 | 0.1605 | 0.4097 | 0.7686 | -3.6 | 0.000319 | 0.9321 | 0.34598 | 0.3064 | 0.3773 |
| rs1008705 | Imputed | C | DOM | 505 | 1.49 | 0.1837 | 1.04 | 2.136 | 2.172 | 0.02985 | 0.9137 | 0.28812 | 0.3211 | 0.2631 |
| rs10105871 | Imputed | A | GEN | 592 | 1.731 | 0.1743 | 1.23 | 2.436 | 3.149 | 0.001636 | 0.2592 | 0.38429 | 0.42278 | 0.3544 |
| rs10116807 | Imputed | A | REC | 652 | | | | | 8.336 | 0.01548 | 1 | 0.22469 | 0.25087 | 0.2041 |
| rs10116807 | Imputed | A | DOM | 652 | 2.88 | 0.389 | 1.43 | 6.569 | 2.88 | 0.003983 | 1 | 0.22469 | 0.25087 | 0.2041 |
| rs10121941 | Imputed | C | DOM | 682 | 3.065 | 0.2074 | 0.352 | 0.7937 | -3.074 | 0.00211 | 0.6748 | 0.10191 | 0.07333 | 0.1243 |
| rs10128638 | Genotyped | G | DOM | 682 | 0.529 | 0.1787 | 0.4054 | 0.8167 | -3.094 | 0.001978 | 0.9389 | 0.49047 | 0.45167 | 0.5209 |
| rs1012924 | Imputed | G | ADD | 682 | 0.575 | 0.1922 | 0.3551 | 0.7544 | -3.426 | 0.000612 | 0.3055 | 0.10484 | 0.07167 | 0.1309 |
| rs1012924 | Imputed | G | DOM | 682 | 0.518 | 0.2097 | 0.3145 | 0.7155 | -3.556 | 0.000376 | 0.3055 | 0.10484 | 0.07167 | 0.1309 |
| rs1016030 | Genotyped | G | ADD | 680 | 0.474 | 0.1137 | 1.12 | 1.749 | -2.956 | 0.00312 | 0.6897 | 0.40074 | 0.44482 | 0.3661 |
| rs1016030 | Genotyped | G | GEN | 680 | 1.4 | | | | 8.902 | 0.01167 | 0.6897 | 0.40074 | 0.44482 | 0.3661 |
| rs10177558 | Imputed | A | REC | 668 | 1.905 | 0.2304 | 1.213 | 2.992 | 2.798 | 0.005138 | 0.4004 | 0.35853 | 0.36735 | 0.3516 |
| rs10183431 | Imputed | T | DOM | 677 | 1.604 | 0.1584 | 1.176 | 2.188 | 2.983 | 0.002854 | 0.06064 | 0.24372 | 0.27534 | 0.2192 |
| rs10195401 | Imputed | C | DOM | 671 | 1.633 | 0.1636 | 1.185 | 2.251 | 2.998 | 0.002721 | 0.9348 | 0.41723 | 0.38227 | 0.3547 |
| rs10239416 | Imputed | A | DOM | 658 | 0.618 | 0.1624 | 0.4496 | 0.8497 | -2.963 | 0.003046 | 0.8667 | 0.36702 | 0.32653 | 0.3997 |
| rs1032188 | Imputed | G | GEN | 682 | | | | | 6.08 | 0.04784 | 1 | 0.30352 | 0.27167 | 0.3285 |
| rs1032188 | Imputed | G | REC | 682 | 0.55 | 0.2837 | 0.3157 | 0.9599 | -2.104 | 0.03536 | 1 | 0.30352 | 0.27167 | 0.3285 |
| rs10468988 | Imputed | G | ADD | 679 | 1.579 | 0.1261 | 1.233 | 2.022 | 3.624 | 0.00029 | 0.6914 | 0.26068 | 0.30936 | 0.2224 |
| rs10478919 | Imputed | G | DOM | 681 | 0.551 | 0.1595 | 0.4029 | 0.753 | -3.738 | 0.000186 | 1 | 0.34802 | 0.30667 | 0.3806 |
| rs10506623 | Imputed | C | DOM | 682 | 0.591 | 0.1642 | 0.4287 | 0.8159 | -3.199 | 0.001378 | 0.8737 | 0.40176 | 0.36667 | 0.4293 |
| rs10506626 | Imputed | A | DOM | 682 | 0.565 | 0.1629 | 0.4107 | 0.7779 | -3.501 | 0.000463 | 0.9364 | 0.40029 | 0.36667 | 0.4267 |
| rs10509477 | Imputed | T | DOM | 682 | 1.772 | 0.1576 | 1.301 | 2.413 | 3.63 | 0.000284 | 1 | 0.29692 | 0.335 | 0.267 |
| rs10511071 | Imputed | C | DOM | 682 | 1.705 | 0.2034 | 1.144 | 2.541 | 2.623 | 0.008711 | 0.3705 | 0.09457 | 0.11333 | 0.0798 |
| rs10511072 | Imputed | C | DOM | 682 | 1.705 | 0.2034 | 1.144 | 2.541 | 2.623 | 0.008711 | 0.3705 | 0.09457 | 0.11333 | 0.0798 |
| rs10511199 | Imputed | A | ADD | 679 | 1.5 | 0.1343 | 1.153 | 1.952 | 3.019 | 0.00254 | 1 | 0.21944 | 0.25671 | 0.1903 |
| rs10513283 | Imputed | G | GEN | 680 | | | | | 13.78 | 0.001017 | 0.06901 | 0.19706 | 0.2408 | 0.1627 |
| rs10520072 | Imputed | T | DOM | 681 | 0.561 | 0.1597 | 0.4104 | 0.7675 | -3.617 | 0.000298 | 0.9326 | 0.34728 | 0.30833 | 0.378 |
| rs1065639 | Imputed | C | ADD | 645 | 1.663 | 0.1678 | 1.197 | 2.311 | 3.031 | 0.002438 | 0.3536 | 0.37132 | 0.40071 | 0.3485 |
| rs10733846 | Imputed | G | ADD | 676 | 0.554 | 0.146 | 0.4165 | 0.7381 | -4.04 | 5.35E-05 | 0.02372 | 0.19009 | 0.1388 | 0.2308 |
| rs10733846 | Imputed | G | DOM | 676 | 0.557 | 0.1721 | 0.3978 | 0.7808 | -3.398 | 0.000679 | 0.02372 | 0.19009 | 0.1388 | 0.2308 |
| rs10737390 | Imputed | T | DOM | 678 | 0.561 | 0.161 | 0.4094 | 0.7694 | -3.588 | 0.000333 | 0.4645 | 0.38274 | 0.33833 | 0.418 |
| rs10749293 | Imputed | G | DOM | 682 | 1.794 | 0.1572 | 1.319 | 2.442 | 3.72 | 0.000199 | 1 | 0.29252 | 0.33167 | 0.2618 |
| rs10752159 | Imputed | G | DOM | 676 | 1.431 | 0.1604 | 1.045 | 1.96 | 2.234 | 0.02545 | 1 | 0.21598 | 0.24329 | 0.1944 |
| rs10753760 | Imputed | T | ADD | 650 | 1.411 | 0.1167 | 1.122 | 1.773 | 2.949 | 0.003192 | 0.6867 | 0.41692 | 0.46466 | 0.3801 |
| rs10757887 | Imputed | T | GEN | 650 | | | | | 9.074 | 0.01071 | 0.6867 | 0.41692 | 0.46466 | 0.3801 |
| rs10758326 | Imputed | C | DOM | 677 | 0.616 | 0.1602 | 0.4502 | 0.8435 | -3.023 | 0.002503 | 0.8353 | 0.24446 | 0.21477 | 0.2678 |
| rs10758326 | Imputed | A | ADD | 679 | 0.73 | 0.1149 | 0.5831 | 0.9149 | -2.734 | 0.006266 | 0.7443 | 0.37923 | 0.33893 | 0.4108 |
| rs10758326 | Imputed | A | GEN | 679 | | | | | 8.015 | 0.01818 | 0.7443 | 0.37923 | 0.33893 | 0.4108 |

TABLE 9-continued

| | | | | | | | | | | |
|---|---|---|---|---|---|---|---|---|---|---|
| rs10758326 | Imputed | REC | A | 679 | 0.554 | 0.2314 | 0.3523 | 0.8726 | −2.549 | 0.01081 | 0.7443 | 0.37923 | 0.4108 |
| rs10762236 | Genotyped | ADD | G | 682 | 0.583 | 0.1422 | 0.4409 | 0.77 | −3.797 | 0.000146 | 0.0221 | 0.19941 | 0.2382 |
| rs10765769 | Imputed | ADD | C | 676 | 1.445 | 0.1127 | 1.159 | 1.802 | 3.266 | 0.001089 | 0.6368 | 0.42456 | 0.3852 |
| rs10765769 | Imputed | GEN | C | 676 | | | | | 10.87 | 0.004364 | 0.6368 | 0.42456 | 0.3852 |
| rs10784891 | Imputed | ADD | C | 656 | 0.692 | 0.117 | 0.5504 | 0.8705 | −3.146 | 0.001655 | 0.5819 | 0.45503 | 0.4905 |
| rs10784891 | Imputed | DOM | C | 656 | 0.57 | 0.1761 | 0.4039 | 0.8053 | −3.19 | 0.001424 | 0.5819 | 0.45503 | 0.4905 |
| rs10787923 | Imputed | DOM | G | 672 | 1.834 | 0.1588 | 1.343 | 2.504 | 3.819 | 0.000134 | 1 | 0.29464 | 0.2627 |
| rs10787949 | Imputed | DOM | A | 682 | 1.79 | 0.1585 | 1.312 | 2.442 | 3.671 | 0.000241 | 1 | 0.30132 | 0.2709 |
| rs10787951 | Imputed | DOM | G | 682 | 1.79 | 0.1585 | 1.312 | 2.442 | 3.671 | 0.000241 | 1 | 0.30132 | 0.2709 |
| rs10787983 | Imputed | DOM | C | 682 | 1.786 | 0.1574 | 1.312 | 2.431 | 3.685 | 0.000229 | 1 | 0.29545 | 0.2644 |
| rs10788380 | Imputed | ADD | C | 675 | 1.411 | 0.1153 | 1.125 | 1.769 | 2.984 | 0.002844 | 0.2184 | 0.49333 | 0.4591 |
| rs10788380 | Imputed | DOM | C | 675 | 1.762 | 0.1889 | 1.217 | 2.552 | 2.999 | 0.002704 | 0.2184 | 0.49333 | 0.4591 |
| rs10788380 | Imputed | GEN | C | 675 | | | | | 9.862 | 0.007218 | 0.2184 | 0.49333 | 0.4591 |
| rs10814418 | Imputed | DOM | G | 680 | 0.533 | 0.2074 | 0.3547 | 0.7998 | −3.037 | 0.002389 | 0.6755 | 0.10221 | 0.1243 |
| rs10831417 | Imputed | ADD | A | 674 | 1.436 | 0.1147 | 1.147 | 1.798 | 3.154 | 0.001613 | 0.8092 | 0.39688 | 0.359 |
| rs10831417 | Imputed | GEN | A | 674 | | | | | 10.39 | 0.005538 | 8.09E-01 | 0.39688 | 0.359 |
| rs10831422 | Imputed | ADD | C | 676 | 1.421 | 0.1143 | 1.135 | 1.777 | 3.071 | 0.002131 | 0.8726 | 0.39941 | 0.3624 |
| rs10831422 | Imputed | GEN | C | 676 | | | | | 9.86 | 0.007226 | 0.8726 | 0.39941 | 0.3624 |
| rs10862931 | Imputed | GEN | C | 676 | | | | | 12.36 | 0.002073 | 0.2988 | 0.33284 | 0.3671 |
| rs10865197 | Imputed | DOM | C | 679 | 1.604 | 0.1581 | 1.177 | 2.186 | 2.988 | 0.002806 | 0.04888 | 0.24448 | 0.2199 |
| rs10871302 | Imputed | DOM | A | 677 | 1.561 | 0.1787 | 1.099 | 2.215 | 2.49 | 0.01276 | 0.5241 | 0.13959 | 0.1197 |
| rs10877463 | Imputed | DOM | C | 681 | 0.735 | 0.1583 | 0.5392 | 1.003 | −1.941 | 0.05228 | 0.1829 | 0.34281 | 0.3691 |
| rs10877468 | Imputed | DOM | C | 681 | 0.745 | 0.1584 | 0.5465 | 1.017 | −1.855 | 0.06358 | 0.2438 | 0.35756 | 0.3678 |
| rs10879240 | Imputed | ADD | G | 561 | 0.604 | 0.1586 | 0.4424 | 0.824 | −3.18 | 0.001472 | 1.43E-14 | 0.34581 | 0.3782 |
| rs10879242 | Imputed | DOM | A | 600 | 0.502 | 0.1832 | 0.3504 | 0.7186 | −3.764 | 0.000167 | 1 | 0.45083 | 0.4821 |
| rs10879245 | Imputed | DOM | A | 600 | 0.502 | 0.1832 | 0.3504 | 0.7186 | −3.764 | 0.000167 | 1 | 0.45083 | 0.4821 |
| rs10879249 | Imputed | DOM | T | 676 | 0.583 | 0.1653 | 0.4214 | 0.8058 | −3.266 | 0.001091 | 0.9363 | 0.40385 | 0.4325 |
| rs10886452 | Imputed | DOM | A | 682 | 1.79 | 0.1585 | 1.312 | 2.442 | 3.671 | 0.000241 | 1 | 0.30132 | 0.2709 |
| rs10886463 | Imputed | DOM | C | 682 | 1.79 | 0.1585 | 1.312 | 2.442 | 3.671 | 0.000241 | 1 | 0.30132 | 0.2709 |
| rs10886465 | Imputed | DOM | A | 682 | 1.778 | 0.1589 | 1.302 | 2.427 | 3.622 | 0.000293 | 1 | 0.30279 | 0.2736 |
| rs10886526 | Imputed | DOM | C | 681 | 1.762 | 0.1577 | 1.293 | 2.4 | 3.591 | 0.000329 | 1 | 0.29589 | 0.267 |
| rs10902437 | Imputed | ADD | G | 658 | 1.415 | 0.1115 | 1.137 | 1.761 | 3.113 | 0.001853 | 0.03266 | 0.38754 | 0.3466 |
| rs10941126 | Imputed | DOM | G | 682 | 0.187 | 0.4378 | 0.0793 | 0.441 | −3.83 | 0.000128 | 0.06181 | 0.03739 | 0.055 |
| rs10941126 | Imputed | GEN | G | 682 | | | | | | 0.000234 | 0.06181 | 0.03739 | 0.055 |
| rs10947871 | Imputed | DOM | A | 682 | 0.19 | 0.451 | 0.0786 | 0.4606 | −3.679 | 0.000234 | 0.1579 | 0.14223 | 0.123 |
| rs10972978 | Imputed | DOM | C | 658 | 1.569 | 0.1754 | 1.112 | 2.213 | 2.567 | 0.01026 | 0.6698 | 0.10258 | 0.1257 |
| rs10973012 | Imputed | ADD | A | 682 | 0.518 | 0.2117 | 0.3418 | 0.7839 | −3.11 | 0.001873 | 0.6748 | 0.10191 | 0.1243 |
| rs10974028 | Genotyped | DOM | G | 682 | 0.529 | 0.2074 | 0.352 | 0.7937 | −3.074 | 0.00211 | 0.3256 | 0.16349 | 0.1937 |
| rs10974028 | Genotyped | ADD | G | 682 | 0.605 | 0.1547 | 0.4467 | 0.8194 | −3.247 | 0.001165 | 0.3256 | 0.16349 | 0.1937 |
| rs11021302 | Imputed | DOM | A | 682 | 0.516 | 0.1777 | 0.3642 | 0.7308 | −3.725 | 0.000196 | 0.873 | 0.39794 | 0.3622 |
| rs11021302 | Imputed | GEN | A | 681 | 1.413 | 0.1142 | 1.13 | 1.768 | 3.029 | 0.002455 | 0.873 | 0.39794 | 0.3622 |
| rs11099644 | Imputed | REC | G | 681 | 1.905 | 0.2304 | 1.213 | 2.992 | 2.798 | 0.007733 | 0.4004 | 0.35853 | 0.3516 |
| rs11138315 | Imputed | ADD | A | 668 | 0.682 | 0.1861 | 0.4732 | 0.9815 | −2.06 | 0.005138 | 0.2275 | 0.11068 | 0.126 |
| rs11149802 | Imputed | DOM | T | 646 | 1.561 | 0.1787 | 1.099 | 2.215 | 2.49 | 0.01276 | 0.5241 | 0.13959 | 0.1197 |
| rs11178596 | Imputed | DOM | T | 677 | 0.551 | 0.1595 | 0.4029 | 0.753 | −3.738 | 0.000186 | 1 | 0.34802 | 0.3806 |
| rs11178531 | Imputed | ADD | A | 681 | 0.722 | 0.1139 | 0.5774 | 0.9022 | −2.863 | 0.004194 | 0.7006 | 0.47788 | 0.5105 |
| rs11178531 | Imputed | DOM | A | 678 | 0.557 | 0.1766 | 0.3942 | 0.7879 | −3.31 | 0.000934 | 0.7006 | 0.47788 | 0.5105 |
| rs11178575 | Imputed | GEN | C | 679 | | | | | 9.118 | 0.01047 | 0.5966 | 0.31885 | 0.294 |
| rs11178577 | Imputed | REC | G | 679 | 2.174 | 0.2571 | 1.313 | 3.598 | 3.019 | 0.002532 | 0.6589 | 0.31912 | 0.2945 |
| rs11178577 | Imputed | GEN | G | 680 | | | | | 9.117 | 0.01048 | 0.6589 | 0.31912 | 0.2945 |
| rs11178583 | Imputed | REC | T | 680 | 2.173 | 0.2571 | 1.313 | 3.597 | 3.019 | 0.002537 | 1 | 0.40827 | 0.4372 |
| rs11178583 | Imputed | GEN | A | 665 | 0.567 | 0.1672 | 0.4082 | 0.7862 | −3.399 | 0.000677 | 1 | 0.40827 | 0.4372 |
| rs11178589 | Imputed | DOM | T | 678 | 0.593 | 0.1662 | 0.4283 | 0.8217 | −3.142 | 0.001679 | 1 | 0.41593 | 0.4446 |

TABLE 9-continued

| | | | | | | | | | | |
|---|---|---|---|---|---|---|---|---|---|---|
| rs11178594 | Imputed | C | DOM | 680 | 0.579 | 0.1651 | 0.4187 | 0.7999 | −3.312 | 0.000926 | 0.9365 | 0.40294 | 0.36745 | 0.4306 |
| rs11178602 | Imputed | T | DOM | 680 | 0.57 | 0.165 | 0.4126 | 0.788 | −3.404 | 0.000665 | 0.8735 | 0.40221 | 0.36577 | 0.4306 |
| rs11178648 | Imputed | T | DOM | 680 | 0.564 | 0.1631 | 0.4095 | 0.7761 | −3.514 | 0.000442 | 0.8107 | 0.40074 | 0.36622 | 0.4278 |
| rs11198877 | Imputed | T | DOM | 682 | 1.79 | 0.1585 | 1.312 | 2.442 | 3.671 | 0.000241 | 1 | 0.30132 | 0.34 | 0.2709 |
| rs11198942 | Imputed | T | DOM | 680 | 1.797 | 0.1579 | 1.319 | 2.449 | 3.712 | 0.000206 | 1 | 0.29706 | 0.33612 | 0.2664 |
| rs11221075 | Imputed | A | ADD | 674 | 0.628 | 0.1738 | 0.4466 | 0.8827 | −2.678 | 0.007404 | 0.4847 | 0.12685 | 0.09966 | 0.1481 |
| rs11242020 | Imputed | T | DOM | 682 | 0.548 | 0.1595 | 0.4011 | 0.7494 | −3.769 | 0.000164 | 0.9329 | 0.34824 | 0.30667 | 0.3809 |
| rs11242021 | Imputed | T | DOM | 682 | 0.56 | 0.1597 | 0.4098 | 0.7664 | −3.626 | 0.000288 | 0.9329 | 0.34824 | 0.30833 | 0.3796 |
| rs11242022 | Imputed | T | DOM | 682 | 0.56 | 0.1597 | 0.4098 | 0.7664 | −3.626 | 0.000288 | 0.9329 | 0.34824 | 0.30833 | 0.3796 |
| rs11242023 | Imputed | T | DOM | 682 | 0.564 | 0.1596 | 0.4123 | 0.7707 | −3.592 | 0.000328 | 1 | 0.34531 | 0.30667 | 0.3757 |
| rs1149350 | Imputed | A | DOM | 680 | 1.537 | 0.1609 | 1.121 | 2.106 | 2.672 | 0.007551 | 0.1324 | 0.21029 | 0.23913 | 0.1877 |
| rs1150143 | Imputed | G | DOM | 658 | 1.631 | 0.1628 | 1.186 | 2.245 | 3.007 | 0.002639 | 0.1849 | 0.32827 | 0.35366 | 0.3086 |
| rs11576627 | Imputed | T | ADD | 682 | 1.785 | 0.1742 | 1.268 | 2.511 | 3.325 | 0.000885 | 0.05306 | 0.12463 | 0.15833 | 0.0982 |
| rs11576627 | Imputed | T | DOM | 682 | 1.844 | 0.1815 | 1.292 | 2.632 | 3.373 | 0.000744 | 0.05306 | 0.12463 | 0.15833 | 0.0982 |
| rs11602189 | Imputed | A | DOM | 677 | 0.604 | 0.1575 | 0.4435 | 0.8223 | −3.203 | 0.001362 | 0.5429 | 0.32939 | 0.2862 | 0.3632 |
| rs11605163 | Imputed | A | DOM | 679 | 2.068 | 0.229 | 1.32 | 3.239 | 3.173 | 0.001509 | 0.7687 | 0.07143 | 0.09532 | 0.0526 |
| rs11615214 | Imputed | G | ADD | 660 | 0.645 | 0.1143 | 0.5156 | 0.807 | −3.837 | 0.000125 | 0.02544 | 0.37652 | 0.31507 | 0.4253 |
| rs11615214 | Imputed | G | GEN | 660 | | | | | 15.05 | 0.000541 | 0.02544 | 0.37652 | 0.31507 | 0.4253 |
| rs11642394 | Imputed | C | DOM | 677 | 1.561 | 0.1787 | 1.099 | 2.215 | 2.49 | 0.01276 | 0.5241 | 0.13959 | 0.16498 | 0.1197 |
| rs11644943 | Imputed | A | DOM | 655 | 1.327 | 0.1361 | 1.017 | 1.733 | 2.081 | 0.03739 | 0.6522 | 0.22214 | 0.24829 | 0.2011 |
| rs11656608 | Imputed | A | ADD | 681 | 0.649 | 0.1794 | 0.4567 | 0.9228 | −2.408 | 0.01605 | 1 | 0.14317 | 0.12375 | 0.1584 |
| rs11661309 | Imputed | T | ADD | 676 | 0.626 | 0.1446 | 0.4718 | 0.8317 | −3.234 | 0.00122 | 0.6206 | 0.19231 | 0.15152 | 0.2243 |
| rs11661309 | Imputed | T | DOM | 676 | 0.601 | 0.1674 | 0.4325 | 0.8338 | −3.046 | 0.002323 | 0.6206 | 0.19231 | 0.15152 | 0.2243 |
| rs11666131 | Imputed | A | ADD | 675 | 1.512 | 0.136 | 1.158 | 1.974 | 3.04 | 0.002366 | 0.4389 | 0.22444 | 0.26102 | 0.1961 |
| rs11743355 | Imputed | C | ADD | 650 | 0.164 | 0.4716 | 0.0652 | 0.4139 | −3.83 | 0.000128 | 0.05102 | 0.03692 | 0.01394 | 0.0551 |
| rs11743355 | Imputed | C | DOM | 650 | 0.166 | 0.4861 | 0.064 | 0.4303 | −3.695 | 0.00022 | 0.05102 | 0.03692 | 0.01394 | 0.0551 |
| rs11746806 | Imputed | T | ADD | 682 | 0.217 | 0.4129 | 0.0965 | 0.4867 | −3.704 | 0.000213 | 0.06816 | 0.03812 | 0.01667 | 0.055 |
| rs11746806 | Imputed | T | DOM | 682 | 0.223 | 0.4255 | 0.0967 | 0.5123 | −3.532 | 0.000412 | 0.06816 | 0.03812 | 0.01667 | 0.055 |
| rs11746959 | Imputed | T | ADD | 682 | 0.187 | 0.4378 | 0.0793 | 0.441 | −3.83 | 0.000128 | 0.06181 | 0.03739 | 0.015 | 0.055 |
| rs11746959 | Imputed | T | DOM | 682 | 0.19 | 0.451 | 0.0786 | 0.4606 | −3.679 | 0.000234 | 0.06181 | 0.03739 | 0.015 | 0.055 |
| rs11749272 | Imputed | C | DOM | 679 | 0.552 | 0.16 | 0.4036 | 0.7559 | −3.709 | 0.000208 | 1 | 0.34831 | 0.30705 | 0.3806 |
| rs11901899 | Imputed | A | DOM | 668 | 1.459 | 0.1585 | 1.069 | 1.99 | 2.382 | 0.0172 | 1 | 0.26422 | 0.29223 | 0.2419 |
| rs11926319 | Imputed | G | ADD | 675 | 0.479 | 0.2053 | 0.3205 | 0.7167 | −3.583 | 0.00034 | 0.8261 | 0.09778 | 0.06397 | 0.1243 |
| rs11926319 | Imputed | G | DOM | 675 | 0.466 | 0.2155 | 0.3052 | 0.7104 | −3.546 | 0.000391 | 0.8261 | 0.09778 | 0.06397 | 0.1243 |
| rs11956952 | Imputed | C | DOM | 671 | 0.633 | 0.1593 | 0.4632 | 0.8648 | −2.872 | 0.00408 | 0.7761 | 0.28465 | 0.24662 | 0.3147 |
| rs12025826 | Imputed | G | DOM | 664 | 1.73 | 0.166 | 1.249 | 2.395 | 3.3 | 0.000968 | 0.05275 | 0.40286 | 0.45313 | 0.3644 |
| rs1204522 | Imputed | C | GEN | 676 | | | | | 11.67 | 0.002917 | 0.87 | 0.37796 | 0.33054 | 0.4153 |
| rs1204524 | Imputed | A | GEN | 678 | | | | | 11.89 | 0.002625 | 0.8065 | 0.37832 | 0.33054 | 0.4158 |
| rs12153185 | Imputed | T | DOM | 672 | 0.561 | 0.1605 | 0.4097 | 0.7686 | −3.6 | 0.000319 | 0.9321 | 0.34598 | 0.3064 | 0.3773 |
| rs12182651 | Imputed | T | ADD | 678 | 2.104 | 0.213 | 1.386 | 3.194 | 3.492 | 0.000479 | 0.6166 | 0.08481 | 0.11371 | 0.062 |
| rs12182651 | Imputed | T | DOM | 678 | 2.304 | 0.2264 | 1.478 | 3.592 | 3.687 | 0.000227 | 0.6166 | 0.08481 | 0.11371 | 0.062 |
| rs12193568 | Imputed | G | DOM | 565 | 1.551 | 0.1819 | 1.086 | 2.215 | 2.413 | 0.01581 | 0.3148 | 0.17788 | 0.20751 | 0.1538 |
| rs12264914 | Imputed | C | DOM | 361 | 0.591 | 0.2158 | 0.3873 | 0.9024 | −2.436 | 0.01486 | 0.08135 | 0.34349 | 0.29063 | 0.3856 |
| rs12307767 | Imputed | C | DOM | 661 | 0.729 | 0.1608 | 0.532 | 0.9993 | −1.964 | 0.04953 | 0.2737 | 0.36157 | 0.34589 | 0.374 |
| rs1232298 | Imputed | C | REC | 658 | 1.65 | 0.2751 | 0.9623 | 2.829 | 1.82 | 0.06874 | 0.2441 | 0.31839 | 0.32118 | 0.3162 |
| rs12407412 | Imputed | C | ADD | 682 | 1.785 | 0.1742 | 1.268 | 2.511 | 3.325 | 0.000885 | 0.05306 | 0.12463 | 0.15833 | 0.0982 |
| rs12407412 | Imputed | C | DOM | 682 | 1.844 | 0.1815 | 1.292 | 2.632 | 3.373 | 0.000744 | 0.05306 | 0.12463 | 0.15833 | 0.0982 |
| rs12420184 | Imputed | G | DOM | 681 | 0.542 | 0.1789 | 0.3816 | 0.7695 | −3.424 | 0.000617 | 0.4694 | 0.15639 | 0.125 | 0.1811 |
| rs12422750 | Imputed | A | DOM | 679 | 0.756 | 0.1585 | 0.5538 | 1.031 | −1.769 | 0.07688 | 0.1821 | 0.35935 | 0.34564 | 0.3701 |
| rs12446951 | Imputed | A | ADD | 520 | 2.018 | 0.2623 | 1.207 | 3.375 | 2.678 | 0.007409 | 0.4988 | 0.06923 | 0.09389 | 0.0498 |
| rs12446951 | Imputed | A | DOM | 520 | 2.001 | 0.2641 | 1.192 | 3.358 | 2.626 | 0.008639 | 0.4988 | 0.06923 | 0.09389 | 0.0498 |
| rs12457400 | Imputed | G | DOM | 680 | 0.553 | 0.201 | 0.3727 | 0.8196 | −2.95 | 0.003178 | 0.6917 | 0.10882 | 0.08361 | 0.1286 |
| rs1247340 | Imputed | C | DOM | 680 | 1.537 | 0.1609 | 1.121 | 2.106 | 2.672 | 0.007551 | 0.1324 | 0.21029 | 0.23913 | 0.1877 |

TABLE 9-continued

| | | | | | | | | | | | |
|---|---|---|---|---|---|---|---|---|---|---|---|
| rs1247341 | Imputed | C | DOM | 680 | 1.537 | 0.1609 | 1.121 | 2.106 | 2.672 | 0.007551 | 0.1324 | 0.21029 | 0.23913 | 0.1877 |
| rs12521291 | Imputed | G | ADD | 673 | 0.684 | 0.1186 | 0.5424 | 0.8634 | −3.198 | 0.001382 | 0.4434 | 0.34398 | 0.30034 | 0.3787 |
| rs12526849 | Imputed | T | ADD | 656 | 1.462 | 0.113 | 1.172 | 1.825 | 3.364 | 0.000769 | 0.2246 | 0.40473 | 0.45819 | 0.3631 |
| rs12526849 | Imputed | T | GEN | 656 | | | | | 11.33 | 0.003474 | 0.2246 | 0.40473 | 0.45819 | 0.3631 |
| rs12543110 | Imputed | G | DOM | 681 | 1.542 | 0.1596 | 1.127 | 2.108 | 2.712 | 0.006696 | 0.106 | 0.23128 | 0.25585 | 0.212 |
| rs12678600 | Imputed | A | DOM | 675 | 0.617 | 0.1585 | 0.4524 | 0.8419 | −3.046 | 0.002319 | 0.7936 | 0.32889 | 0.28859 | 0.3607 |
| rs12719415 | Imputed | T | DOM | 673 | 0.546 | 0.1604 | 0.3989 | 0.748 | −3.771 | 0.000163 | 0.548 | 0.34027 | 0.29522 | 0.375 |
| rs12831292 | Imputed | G | DOM | 678 | 0.574 | 0.1652 | 0.4153 | 0.7936 | −3.359 | 0.000782 | 0.9364 | 0.40339 | 0.367 | 0.4318 |
| rs12923993 | Imputed | C | DOM | 677 | 1.561 | 0.1787 | 1.099 | 2.215 | 2.49 | 0.01276 | 0.5241 | 0.13959 | 0.16498 | 0.1197 |
| rs12936964 | Imputed | T | DOM | 673 | 1.718 | 0.1622 | 1.25 | 2.362 | 3.338 | 0.000844 | 0.6161 | 0.35958 | 0.40372 | 0.3249 |
| rs12960663 | Imputed | G | ADD | 672 | 0.639 | 0.1447 | 0.4809 | 0.8478 | −3.101 | 0.001927 | 0.5336 | 0.19122 | 0.15203 | 0.2221 |
| rs13038146 | Imputed | C | ADD | 681 | 1.338 | 0.1141 | 1.07 | 1.674 | 2.554 | 0.01063 | 0.2789 | 0.3583 | 0.39667 | 0.3281 |
| rs13038146 | Imputed | C | GEN | 681 | | | | | 7.872 | 0.01953 | 0.2789 | 0.3583 | 0.39667 | 0.3281 |
| rs13134222 | Imputed | A | DOM | 597 | | | | | 9.274 | 0.009687 | 0.917 | 0.26884 | 0.23408 | 0.297 |
| rs13172910 | Imputed | A | DOM | 675 | 0.633 | 0.159 | 0.4637 | 0.8646 | −2.875 | 0.004042 | 0.7779 | 0.28667 | 0.25 | 0.3156 |
| rs13194907 | Imputed | A | ADD | 682 | 2.264 | 0.2373 | 1.422 | 3.606 | 3.444 | 0.000573 | 0.205 | 0.06598 | 0.09167 | 0.0458 |
| rs13194907 | Imputed | A | DOM | 682 | 2.432 | 0.2521 | 1.484 | 3.986 | 3.525 | 0.000423 | 0.205 | 0.06598 | 0.09167 | 0.0458 |
| rs13195745 | Imputed | A | ADD | 682 | 2.264 | 0.2373 | 1.422 | 3.606 | 3.444 | 0.000573 | 0.205 | 0.06598 | 0.09167 | 0.0458 |
| rs13195745 | Imputed | A | DOM | 682 | 2.432 | 0.2521 | 1.484 | 3.986 | 3.525 | 0.000423 | 0.205 | 0.06598 | 0.09167 | 0.0458 |
| rs13221432 | Imputed | A | REC | 681 | 2.324 | 0.2254 | 1.494 | 3.615 | 3.741 | 0.000183 | 0.5731 | 0.3884 | 0.44314 | 0.3455 |
| rs13221457 | Imputed | G | REC | 665 | 2.293 | 0.2272 | 1.469 | 3.58 | 3.653 | 0.000259 | 0.7441 | 0.38872 | 0.44178 | 0.3472 |
| rs13265054 | Imputed | T | DOM | 671 | 0.623 | 0.1591 | 0.4561 | 0.8511 | −2.973 | 0.002945 | 0.7921 | 0.32489 | 0.28716 | 0.3547 |
| rs13282131 | Imputed | C | GEN | 675 | | | | | 7.767 | 0.02058 | 0.8765 | 0.44889 | 0.48639 | 0.4199 |
| rs13353526 | Imputed | C | DOM | 674 | 1.752 | 0.2045 | 1.174 | 2.617 | 2.743 | 0.006085 | 0.3687 | 0.09496 | 0.11486 | 0.0794 |
| rs1336382 | Imputed | T | DOM | 682 | 1.772 | 0.1576 | 1.301 | 2.413 | 3.63 | 2.84E−04 | 1 | 0.29692 | 0.335 | 0.267 |
| rs1336383 | Imputed | T | DOM | 682 | 1.772 | 0.1576 | 1.301 | 2.413 | 3.63 | 0.000284 | 1 | 0.29692 | 0.335 | 0.267 |
| rs1336407 | Imputed | C | DOM | 682 | 1.772 | 0.1576 | 1.301 | 2.413 | 3.63 | 0.000284 | 1 | 0.29692 | 0.335 | 0.267 |
| rs1336409 | Imputed | T | DOM | 682 | 1.772 | 0.1576 | 1.301 | 2.413 | 3.63 | 0.000284 | 1 | 0.29692 | 0.335 | 0.267 |
| rs1336596 | Imputed | A | DOM | 682 | 0.565 | 0.1607 | 0.412 | 0.7735 | −3.558 | 0.000374 | 0.9327 | 0.34751 | 0.31333 | 0.3743 |
| rs1343560 | Imputed | A | ADD | 678 | 0.521 | 0.1923 | 0.3575 | 0.7596 | −3.39 | 0.000699 | 0.3076 | 0.10546 | 0.07239 | 0.1312 |
| rs1343560 | Imputed | T | DOM | 678 | 0.478 | 0.2098 | 0.3168 | 0.7211 | −3.518 | 0.000435 | 0.3076 | 0.10546 | 0.07239 | 0.1312 |
| rs1361987 | Imputed | T | GEN | 682 | | | | | 12.45 | 0.001975 | 0.9355 | 0.3849 | 0.335 | 0.4241 |
| rs1386153 | Imputed | T | ADD | 677 | 0.694 | 0.1194 | 0.5493 | 0.8772 | −3.057 | 0.002235 | 0.7936 | 0.32718 | 0.28261 | 0.3624 |
| rs1386153 | Imputed | T | DOM | 677 | 0.603 | 0.1574 | 0.4431 | 0.8213 | −3.21 | 0.001326 | 0.7936 | 0.32718 | 0.28261 | 0.3624 |
| rs1394015 | Imputed | C | DOM | 669 | 1.658 | 0.1636 | 1.203 | 2.285 | 3.091 | 0.001993 | 0.4527 | 0.36472 | 0.39384 | 0.3422 |
| rs1407038 | Imputed | A | REC | 678 | 2.31 | 0.2263 | 1.483 | 3.599 | 3.7 | 0.000215 | 0.8076 | 0.38422 | 0.4375 | 0.3429 |
| rs1407039 | Imputed | A | REC | 680 | 2.185 | 0.221 | 1.417 | 3.37 | 3.538 | 4.04E−04 | 0.748 | 0.39412 | 0.44631 | 0.3534 |
| rs1412802 | Imputed | T | GEN | 681 | | | | | 6.558 | 0.03767 | 0.785 | 0.30176 | 0.27 | 0.3268 |
| rs1414865 | Imputed | T | DOM | 682 | 1.79 | 0.1585 | 1.312 | 2.442 | 3.671 | 0.000241 | 1 | 0.30132 | 0.34 | 0.2709 |
| rs1414873 | Imputed | A | DOM | 682 | 1.786 | 0.1574 | 1.312 | 2.431 | 3.685 | 0.000229 | 1 | 0.29545 | 0.335 | 0.2644 |
| rs1414876 | Imputed | C | DOM | 682 | 1.786 | 0.1574 | 1.312 | 2.431 | 3.685 | 0.000229 | 1 | 0.29545 | 0.335 | 0.2644 |
| rs1418671 | Imputed | C | REC | 655 | 2.259 | 0.2305 | 1.437 | 3.549 | 3.534 | 0.000409 | 0.2728 | 0.36336 | 0.41493 | 0.3229 |
| rs1419490 | Genotyped | T | GEN | 682 | | | | | 12.66 | 0.001783 | 0.9357 | 0.38416 | 0.33333 | 0.4241 |
| rs1434507 | Imputed | A | DOM | 681 | 1.547 | 0.1268 | 1.206 | 1.983 | 3.439 | 0.000584 | 0.8411 | 0.25698 | 0.30333 | 0.2205 |
| rs1434508 | Imputed | T | DOM | 681 | 1.536 | 0.1268 | 1.198 | 1.97 | 3.388 | 0.000705 | 0.9202 | 0.25771 | 0.30333 | 0.2218 |
| rs1435205 | Imputed | A | ADD | 679 | 1.5 | 0.1343 | 1.153 | 1.952 | 3.019 | 0.00254 | 1 | 0.21944 | 0.25671 | 0.1903 |
| rs1443928 | Imputed | C | REC | 672 | 0.59 | 0.1812 | 0.4133 | 0.8409 | −2.917 | 0.003539 | 0.5875 | 0.53571 | 0.50169 | 0.5625 |
| rs1452235 | Imputed | G | GEN | 682 | | | | | 12.53 | 0.001899 | 0.2617 | 0.33065 | 0.28667 | 0.3652 |
| rs1452236 | Imputed | G | GEN | 681 | | | | | 12.63 | 0.001811 | 0.2989 | 0.33113 | 0.28667 | 0.3661 |
| rs1452237 | Imputed | G | GEN | 682 | | | | | 12.53 | 0.001899 | 0.2617 | 0.33065 | 0.28667 | 0.3652 |
| rs1452243 | Imputed | T | GEN | 682 | | | | | 12.53 | 0.001899 | 0.2617 | 0.33065 | 0.28667 | 0.3652 |
| rs1463768 | Genotyped | G | REC | 682 | 1.527 | 0.2037 | 1.025 | 2.277 | 2.08 | 0.03755 | 0.3847 | 0.40982 | 0.435 | 0.3901 |
| rs1463769 | Imputed | G | REC | 682 | 1.561 | 0.2044 | 1.045 | 2.33 | 2.177 | 0.02947 | 0.428 | 0.40836 | 0.435 | 0.3874 |

TABLE 9-continued

| | | | | | | | | | | | | |
|---|---|---|---|---|---|---|---|---|---|---|---|---|
| rs1472435 | Imputed | A | ADD | 675 | 0.581 | 0.2266 | 0.3727 | 0.9061 | −2.395 | 0.01663 | 0.3725 | 0.07111 | 0.05201 | 0.0862 |
| rs1472435 | Imputed | A | DOM | 675 | 0.6 | 0.2382 | 0.376 | 0.9566 | −2.146 | 0.03185 | 0.3725 | 0.07111 | 0.05201 | 0.0862 |
| rs1476714 | Imputed | A | DOM | 681 | 0.558 | 0.1599 | 0.4076 | 0.7628 | −3.654 | 0.000258 | 1 | 0.34802 | 0.30769 | 0.3796 |
| rs1495159 | Imputed | G | ADD | 671 | 0.664 | 0.125 | 0.5195 | 0.8479 | −3.281 | 0.001036 | 0.8591 | 0.31967 | 0.27721 | 0.3528 |
| rs1495159 | Imputed | G | GEN | 671 | | | | | 11.32 | 0.003475 | 0.8591 | 0.31967 | 0.27721 | 0.3528 |
| rs1495375 | Imputed | A | DOM | 674 | 0.571 | 0.1673 | 0.4111 | 0.7921 | −3.353 | 0.0008 | 1 | 0.42507 | 0.3902 | 0.4524 |
| rs1495376 | Imputed | T | DOM | 649 | 0.594 | 0.1848 | 0.4134 | 0.8529 | −2.821 | 0.004787 | 0.8753 | 0.4923 | 0.46986 | 0.5095 |
| rs1495377 | Imputed | G | DOM | 652 | 0.615 | 0.1836 | 0.4294 | 0.8819 | −2.644 | 0.008185 | 0.9375 | 0.49233 | 0.47183 | 0.5082 |
| rs1495381 | Imputed | T | GEN | 682 | | | | | 10.43 | 0.005444 | 0.3777 | 0.39443 | 0.43 | 0.3665 |
| rs1495381 | Imputed | T | REC | 682 | 2.043 | 0.2213 | 1.324 | 3.152 | 3.229 | 0.001243 | 0.3777 | 0.39443 | 0.43 | 0.3665 |
| rs1498992 | Imputed | G | DOM | 681 | 0.583 | 0.1567 | 0.4286 | 0.7922 | −3.446 | 0.000568 | 0.4296 | 0.32159 | 0.27592 | 0.3573 |
| rs1499001 | Imputed | T | DOM | 661 | 0.587 | 0.1603 | 0.4291 | 0.8042 | −3.32 | 0.000901 | 0.5609 | 0.27761 | 0.22837 | 0.3159 |
| rs1512988 | Imputed | A | DOM | 681 | 0.588 | 0.1643 | 0.4264 | 0.8118 | −3.229 | 0.001243 | 0.9365 | 0.40088 | 0.36455 | 0.4293 |
| rs1512989 | Imputed | T | DOM | 681 | 0.588 | 0.1643 | 0.4264 | 0.8118 | −3.229 | 0.001243 | 0.9365 | 0.40088 | 0.36455 | 0.4293 |
| rs1512991 | Imputed | T | ADD | 677 | 0.734 | 0.1143 | 0.5865 | 0.9181 | −2.707 | 0.006791 | 0.6434 | 0.46824 | 0.42929 | 0.4987 |
| rs1512991 | Imputed | T | DOM | 677 | 0.588 | 0.1751 | 0.4173 | 0.8289 | −3.032 | 0.002431 | 0.6434 | 0.46824 | 0.42929 | 0.4987 |
| rs1516855 | Imputed | G | REC | 657 | 1.965 | 0.2424 | 1.222 | 3.16 | 2.786 | 0.005328 | 0.1374 | 0.38052 | 0.41176 | 0.356 |
| rs1527450 | Imputed | A | ADD | 670 | 1.426 | 0.1148 | 1.139 | 1.787 | 3.093 | 0.001982 | 0.7474 | 0.39776 | 0.44463 | 0.3602 |
| rs1527450 | Imputed | T | GEN | 670 | | | | | 9.977 | 0.006814 | 0.7474 | 0.39776 | 0.44463 | 0.3602 |
| rs1567740 | Imputed | T | DOM | 679 | 0.584 | 0.165 | 0.4224 | 0.8064 | −3.264 | 0.001098 | 0.8732 | 0.40206 | 0.367 | 0.4293 |
| rs1572573 | Imputed | A | ADD | 657 | 1.745 | 0.1419 | 1.321 | 2.305 | 3.923 | 8.73E-05 | 0.1585 | 0.18798 | 0.23693 | 0.15 |
| rs1572573 | Imputed | A | DOM | 657 | 2.014 | 0.1694 | 1.445 | 2.807 | 4.132 | 3.60E-05 | 0.1585 | 0.18798 | 0.23693 | 0.15 |
| rs1584003 | Imputed | C | DOM | 673 | 1.97 | 0.1384 | 1.384 | 2.806 | 3.761 | 0.000169 | 0.2788 | 0.47028 | 0.5119 | 0.438 |
| rs1584005 | Imputed | C | DOM | 665 | 1.936 | 0.181 | 1.358 | 2.761 | 3.652 | 0.000261 | 0.2759 | 0.46842 | 0.50692 | 0.4388 |
| rs1585771 | Imputed | G | ADD | 674 | 1.481 | 0.1242 | 1.161 | 1.889 | 3.162 | 0.001567 | 0.3712 | 0.26261 | 0.30678 | 0.2282 |
| rs1592015 | Imputed | C | DOM | 681 | 0.523 | 0.1726 | 0.373 | 0.7337 | −3.754 | 0.000174 | 0.43 | 0.17621 | 0.13712 | 0.2068 |
| rs1594885 | Imputed | T | DOM | 681 | 1.561 | 0.1254 | 1.221 | 1.995 | 3.551 | 0.000384 | 0.6918 | 0.26211 | 0.31 | 0.2244 |
| rs1603232 | Imputed | A | ADD | 682 | 0.588 | 0.1751 | 0.4173 | 0.8289 | | | | | | |
| rs1614565 | Imputed | A | DOM | 655 | 0.631 | 0.1827 | 0.4408 | 0.902 | −2.525 | 0.01159 | 1 | 0.48779 | 0.47038 | 0.5014 |
| rs1648200 | Imputed | C | DOM | 671 | 0.574 | 0.1797 | 0.4034 | 0.816 | −3.091 | 0.001993 | 0.9385 | 0.48957 | 0.46949 | 0.5053 |
| rs16877387 | Imputed | C | ADD | 623 | 1.473 | 0.135 | 1.13 | 1.919 | 2.868 | 0.004134 | 0.833 | 0.25522 | 0.29478 | 0.2254 |
| rs16877387 | Imputed | C | REC | 677 | | | | | 11.65 | 0.002959 | 0.3017 | 0.33678 | 0.38047 | 0.3026 |
| rs16938626 | Imputed | G | DOM | 677 | 2.249 | 0.2423 | 1.399 | 3.616 | 3.345 | 0.000823 | 0.9255 | 0.29261 | 0.25676 | 0.3215 |
| rs1694334 | Imputed | G | ADD | 663 | 0.631 | 0.1588 | 0.4625 | 0.8618 | −2.897 | 0.00377 | 0.01892 | 0.24207 | 0.1954 | 0.2781 |
| rs16998821 | Imputed | C | ADD | 599 | 0.664 | 0.1373 | 0.5072 | 0.8688 | −2.984 | 0.002847 | 0.43 | 0.17621 | 0.13712 | 0.2068 |
| rs1700400 | Imputed | C | DOM | 681 | 0.523 | 0.1726 | 0.373 | 0.7337 | −3.754 | 0.000174 | 0.5481 | 0.25967 | 0.22297 | 0.2886 |
| rs17007620 | Imputed | T | ADD | 672 | 0.695 | 0.131 | 0.5378 | 0.8989 | −2.774 | 0.005544 | 0.8194 | 0.23372 | 0.27308 | 0.2035 |
| rs17007620 | Imputed | G | DOM | 599 | 1.567 | 0.1431 | 1.184 | 2.074 | 3.138 | 0.001699 | 0.8194 | 0.23372 | 0.27308 | 0.2035 |
| rs17023290 | Imputed | C | DOM | 599 | 1.743 | 0.171 | 1.247 | 2.437 | 3.251 | 0.00149 | 0.3705 | 0.09457 | 0.11333 | 0.0798 |
| rs17047957 | Imputed | C | DOM | 682 | 1.705 | 0.2034 | 1.221 | 2.541 | 2.623 | 0.008711 | 0.4202 | 0.17181 | 0.19231 | 0.1558 |
| rs1705237 | Imputed | A | DOM | 681 | 1.493 | 0.168 | 1.074 | 2.074 | 2.384 | 0.01712 | 0.8767 | 0.48649 | 0.4622 | 0.5053 |
| rs1705261 | Imputed | A | DOM | 666 | 0.566 | 0.1803 | 0.3973 | 0.8057 | −3.158 | 0.001589 | 0.4226 | 0.39296 | 0.43 | 0.3639 |
| rs1705261 | Imputed | A | GEN | 682 | | | | | 10.46 | 0.005353 | 0.4226 | 0.39296 | 0.43 | 0.3639 |
| rs17076972 | Imputed | C | ADD | 682 | 2.043 | 0.2213 | 1.324 | 3.152 | 3.229 | 0.001243 | 1 | 0.47507 | 0.52667 | 0.4346 |
| rs17076972 | Imputed | C | GEN | 682 | | | | | 3.172 | 0.001511 | 1 | 0.47507 | 0.52667 | 0.4346 |
| rs17076972 | Imputed | C | REC | 682 | 1.427 | 0.1121 | 1.146 | 1.778 | 11.26 | 0.003593 | 1 | 0.47507 | 0.52667 | 0.4346 |
| rs17189710 | Imputed | T | ADD | 682 | 1.816 | 0.1863 | 1.26 | 2.616 | 3.202 | 0.001365 | 0.2789 | 0.3583 | 0.39667 | 0.3281 |
| rs17189710 | Imputed | T | GEN | 681 | 1.338 | 0.1141 | 1.07 | 1.674 | 2.554 | 0.01063 | 0.2789 | 0.3583 | 0.39667 | 0.3281 |
| rs17196143 | Imputed | A | ADD | 681 | | | | | 7.872 | 0.01953 | 0.6286 | 0.19721 | 0.23667 | 0.1662 |
| rs17353809 | Imputed | G | ADD | 682 | 1.57 | 0.1416 | 1.189 | 2.072 | 3.183 | 0.001458 | 0.9094 | 0.21588 | 0.25424 | 0.186 |
| rs17368986 | Imputed | A | ADD | 674 | 1.511 | 0.1348 | 1.16 | 1.968 | 3.062 | 0.002199 | 0.07037 | 0.19721 | 0.24167 | 0.1623 |
| rs17369097 | Imputed | A | GEN | 682 | | | | | 13.99 | 0.000919 | 0.1414 | 0.19457 | 0.23833 | 0.1601 |
| rs17434511 | Imputed | C | GEN | 681 | | | | | 13.12 | 0.001413 | 0.06935 | 0.19735 | 0.24161 | 0.1627 |
| | | | GEN | 679 | | | | | 13.93 | 0.000944 | | | | |

TABLE 9-continued

| SNP | Type | Allele | Model | N | OR | SE | CI_L | CI_U | Stat | P | Col1 | Col2 | Col3 | Col4 |
|---|---|---|---|---|---|---|---|---|---|---|---|---|---|---|
| rs17434589 | Imputed | C | GEN | 673 | | | | | 14.2 | 0.000826 | 0.06943 | 0.19837 | 0.24407 | 0.1627 |
| rs17434603 | Imputed | G | GEN | 680 | | | | | 13.78 | 0.001017 | 0.06901 | 0.19706 | 0.2408 | 0.1627 |
| rs17434840 | Imputed | C | GEN | 681 | | | | | 13.12 | 0.001413 | 0.1414 | 0.19457 | 0.23833 | 0.1601 |
| rs17446418 | Imputed | G | DOM | 678 | 0.537 | 0.1603 | 0.3921 | 0.7351 | -3.88 | 0.000105 | 0.8045 | 0.36873 | 0.31711 | 0.4092 |
| rs17533747 | Imputed | T | ADD | 669 | 0.525 | 0.1614 | 0.383 | 0.7209 | -3.988 | 6.66E-05 | 0.8027 | 0.36398 | 0.30887 | 0.4069 |
| rs17604285 | Imputed | C | DOM | 681 | 0.533 | 0.1972 | 0.3619 | 0.7838 | -3.195 | 0.001397 | 0.2868 | 0.09912 | 0.06833 | 0.1234 |
| rs17604285 | Imputed | C | ADD | 681 | 0.504 | 0.212 | 0.3327 | 0.7638 | -3.231 | 0.001233 | 0.2868 | 0.09912 | 0.06833 | 0.1234 |
| rs17662322 | Imputed | T | DOM | 681 | 0.555 | 0.17 | 0.3978 | 0.7746 | -3.463 | 0.000535 | 1 | 0.18135 | 0.13712 | 0.216 |
| rs17769826 | Imputed | T | ADD | 677 | 1.504 | 0.1347 | 1.155 | 1.958 | 3.029 | 0.002453 | 0.9092 | 0.21492 | 0.25253 | 0.1855 |
| rs17821641 | Imputed | T | ADD | 679 | 1.5 | 0.1343 | 1.153 | 1.952 | 3.019 | 0.00254 | 1 | 0.21944 | 0.25671 | 0.1903 |
| rs1782328 | Imputed | A | ADD | 647 | 0.613 | 0.1454 | 0.4609 | 0.8148 | -3.369 | 0.000754 | 0.1051 | 0.19706 | 0.15194 | 0.2321 |
| rs1796337 | Imputed | T | DOM | 669 | 0.597 | 0.1833 | 0.4168 | 0.8548 | -2.816 | 0.004863 | 0.5361 | 0.51121 | 0.48142 | 0.5349 |
| rs1798083 | Imputed | C | DOM | 674 | 0.601 | 0.179 | 0.4232 | 0.8536 | -2.845 | 0.004447 | 0.8775 | 0.48813 | 0.46959 | 0.5026 |
| rs1798085 | Imputed | T | DOM | 668 | 0.578 | 0.1804 | 0.4058 | 0.823 | -3.04 | 0.002368 | 0.9383 | 0.48952 | 0.46928 | 0.5053 |
| rs1798086 | Imputed | T | DOM | 668 | 0.553 | 0.1797 | 0.3886 | 0.786 | -3.3 | 0.000968 | 1 | 0.48653 | 0.46246 | 0.5053 |
| rs1798089 | Imputed | C | GEN | 675 | | | | | 11.13 | 0.00383 | 0.42 | 0.39333 | 0.43098 | 0.3638 |
| rs1798089 | Imputed | C | REC | 675 | 2.101 | 0.2227 | 1.358 | 3.252 | 3.334 | 0.000855 | 0.42 | 0.39333 | 0.43098 | 0.3638 |
| rs1798090 | Imputed | C | GEN | 674 | | | | | 10.63 | 0.004921 | 0.3765 | 0.39614 | 0.43412 | 0.3664 |
| rs1798090 | Imputed | C | REC | 674 | 2.054 | 0.2214 | 1.331 | 3.17 | 3.251 | 0.001151 | 0.3765 | 0.39614 | 0.43412 | 0.3664 |
| rs1832222 | Imputed | G | DOM | 682 | 1.786 | 0.1574 | 1.312 | 2.431 | 3.685 | 0.000229 | 1 | 0.29545 | 0.335 | 0.2644 |
| rs1838104 | Imputed | A | ADD | 668 | 0.727 | 0.1159 | 0.5791 | 0.9121 | -2.754 | 0.005895 | 0.3083 | 0.55539 | 0.51199 | 0.5891 |
| rs1838104 | Imputed | A | GEN | 668 | | | | | 7.983 | 0.01848 | 0.3083 | 0.55539 | 0.51199 | 0.5891 |
| rs1868616 | Imputed | G | DOM | 671 | 0.572 | 0.1501 | 0.426 | 0.7672 | -3.725 | 0.000195 | 0.7063 | 0.19001 | 0.14576 | 0.2247 |
| rs1874313 | Imputed | A | DOM | 674 | 0.578 | 0.1655 | 0.4178 | 0.7993 | -3.314 | 0.000921 | 0.9364 | 0.40504 | 0.36824 | 0.4339 |
| rs1884902 | Imputed | C | REC | 678 | 2.217 | 0.2224 | 1.434 | 3.428 | 3.579 | 0.000344 | 0.6303 | 0.39381 | 0.44649 | 0.3522 |
| rs1913201 | Imputed | G | ADD | 650 | 0.692 | 0.1185 | 0.5487 | 0.873 | -3.106 | 0.001894 | 0.3832 | 0.44692 | 0.40175 | 0.4822 |
| rs1913201 | Imputed | G | DOM | 650 | 0.589 | 0.1754 | 0.4175 | 0.8303 | -3.02 | 0.002528 | 0.3832 | 0.44692 | 0.40175 | 0.4822 |
| rs1913201 | Imputed | G | GEN | 650 | | | | | 10.22 | 0.006038 | 0.3832 | 0.44692 | 0.40175 | 0.4822 |
| rs1944279 | Imputed | A | ADD | 679 | 1.579 | 0.1261 | 1.233 | 2.022 | 3.624 | 0.00029 | 0.6914 | 0.26068 | 0.30936 | 0.2224 |
| rs198461 | Imputed | C | DOM | 676 | 0.625 | 0.1925 | 0.4287 | 0.9117 | -2.44 | 0.01467 | 0.04501 | 0.52367 | 0.49495 | 0.5462 |
| rs1987179 | Imputed | T | DOM | 680 | 0.701 | 0.1613 | 0.5109 | 0.9616 | -2.203 | 0.0276 | 0.06175 | 0.20735 | 0.18562 | 0.2244 |
| rs1990023 | Imputed | T | DOM | 682 | 0.548 | 0.1595 | 0.4011 | 0.7494 | -3.769 | 0.000164 | 0.9329 | 0.34824 | 0.30667 | 0.3809 |
| rs2016194 | Imputed | G | DOM | 682 | 0.56 | 0.1597 | 0.4098 | 0.7664 | -3.626 | 0.000288 | 1 | 0.34824 | 0.30833 | 0.3796 |
| rs2024789 | Imputed | C | ADD | 666 | 0.675 | 0.1123 | 0.542 | 0.8417 | -3.495 | 0.000475 | 0.3902 | 0.4542 | 0.39828 | 0.4973 |
| rs2024789 | Imputed | C | GEN | 666 | | | | | 12.34 | 0.002095 | 0.3902 | 0.4542 | 0.39828 | 0.4973 |
| rs2024902 | Imputed | A | ADD | 678 | 2.07 | 0.2296 | 1.32 | 3.246 | 3.168 | 0.001535 | 0.2503 | 0.07375 | 0.09732 | 0.0553 |
| rs2024902 | Imputed | A | DOM | 678 | 2.266 | 0.2451 | 1.401 | 3.663 | 3.336 | 0.000849 | 0.2503 | 0.07375 | 0.09732 | 0.0553 |
| rs2025107 | Imputed | A | ADD | 682 | 2.008 | 0.2082 | 1.336 | 3.02 | 3.35 | 0.000808 | 0.4997 | 0.09238 | 0.12 | 0.0707 |
| rs2025107 | Imputed | A | DOM | 682 | 2.219 | 0.2217 | 1.437 | 3.427 | 3.596 | 0.000324 | 0.4997 | 0.09238 | 0.12 | 0.0707 |
| rs2025108 | Imputed | T | ADD | 682 | 2.008 | 0.2082 | 1.336 | 3.02 | 3.35 | 0.000808 | 0.4997 | 0.09238 | 0.12 | 0.0707 |
| rs2025108 | Imputed | T | DOM | 682 | 2.219 | 0.2217 | 1.437 | 3.427 | 3.596 | 0.000324 | 0.4997 | 0.09238 | 0.12 | 0.0707 |
| rs2062448 | Imputed | T | ADD | 674 | 0.545 | 0.1992 | 0.3687 | 0.805 | -3.049 | 0.002299 | 0.2633 | 0.09644 | 0.06711 | 0.1197 |
| rs2062448 | Imputed | T | DOM | 674 | 0.517 | 0.215 | 0.339 | 0.7873 | -3.072 | 0.002123 | 0.2633 | 0.09644 | 0.06711 | 0.1197 |
| rs2063591 | Imputed | C | ADD | 677 | 0.73 | 0.1136 | 0.5839 | 0.9113 | -2.777 | 0.005479 | 0.8173 | 0.47858 | 0.43792 | 0.5106 |
| rs2063591 | Imputed | C | DOM | 677 | 0.56 | 0.1767 | 0.3958 | 0.7911 | -3.287 | 0.001014 | 0.8173 | 0.47858 | 0.43792 | 0.5106 |
| rs2065604 | Imputed | C | DOM | 682 | 0.529 | 0.2074 | 0.352 | 0.7937 | -3.074 | 0.00211 | 0.6748 | 0.10191 | 0.07333 | 0.1243 |
| rs2066238 | Imputed | C | DOM | 682 | 0.521 | 0.1725 | 0.3715 | 0.7305 | -3.78 | 0.000157 | 0.4294 | 0.17595 | 0.13667 | 0.2068 |
| rs2068051 | Imputed | G | ADD | 424 | 0.612 | 0.1413 | 0.464 | 0.8076 | -3.472 | 0.000517 | 0.1925 | 0.58726 | 0.52332 | 0.6407 |
| rs2068051 | Imputed | G | GEN | 424 | | | | | 12.06 | 0.002411 | 0.1925 | 0.58726 | 0.52332 | 0.6407 |
| rs2077702 | Genotyped | G | GEN | 682 | | | | | 9.004 | 0.01108 | 0.5971 | 0.31818 | 0.35 | 0.2932 |
| rs208757 | Imputed | G | ADD | 652 | 1.552 | 0.1511 | 1.154 | 2.087 | 2.91 | 0.003619 | 0.4981 | 0.17485 | 0.20833 | 0.1484 |
| rs208757 | Imputed | G | DOM | 652 | 1.649 | 0.1701 | 1.182 | 2.302 | 2.942 | 0.003266 | 0.4981 | 0.17485 | 0.20833 | 0.1484 |
| rs2095586 | Imputed | A | DOM | 682 | 1.786 | 0.1574 | 1.312 | 2.431 | 3.685 | 0.000229 | 1 | 0.29545 | 0.335 | 0.2644 |

TABLE 9-continued

| | | | | | | | | | | | |
|---|---|---|---|---|---|---|---|---|---|---|---|
| rs2108426 | Imputed | C | DOM | 682 | 0.56 | 0.1597 | 0.4098 | 0.7664 | −3.626 | 0.000288 | 0.9329 | 0.34824 | 0.30833 | 0.3796 |
| rs2110664 | Imputed | A | DOM | 643 | 1.503 | 0.1611 | 1.096 | 2.061 | 2.53 | 0.01141 | 0.8422 | 0.27138 | 0.30674 | 0.2438 |
| rs2132242 | Imputed | A | DOM | 680 | 0.585 | 0.1661 | 0.4222 | 0.8097 | −3.231 | 0.001233 | 1 | 0.41544 | 0.37919 | 0.4437 |
| rs2151644 | Imputed | T | DOM | 679 | 0.527 | 0.2075 | 0.3509 | 0.7914 | −3.088 | 0.002018 | 0.6758 | 0.10236 | 0.07358 | 0.125 |
| rs2157752 | Genotyped | A | GEN | 682 | | | | | 12.46 | 0.001973 | 0.676 | 0.35557 | 0.30667 | 0.394 |
| rs2158958 | Imputed | A | DOM | 682 | 0.56 | 0.1597 | 0.4098 | 0.7664 | −3.626 | 0.000288 | 0.9329 | 0.34824 | 0.30833 | 0.3796 |
| rs2158961 | Imputed | G | DOM | 680 | 0.564 | 0.1598 | 0.412 | 0.7707 | −3.59 | 0.00033 | 0.9326 | 0.34706 | 0.30833 | 0.3776 |
| rs2164099 | Imputed | G | ADD | 681 | 1.561 | 0.1254 | 1.221 | 1.995 | 3.551 | 0.000384 | 0.6918 | 0.26211 | 0.31 | 0.2244 |
| rs2173254 | Imputed | G | GEN | 675 | | | | | 12.63 | 0.001808 | 0.08658 | 0.34074 | 0.29561 | 0.376 |
| rs2173254 | Imputed | G | REC | 675 | 0.382 | 0.2927 | 0.2154 | 0.6786 | −3.285 | 0.001021 | 0.08658 | 0.34074 | 0.29561 | 0.376 |
| rs2188079 | Imputed | C | ADD | 682 | 1.482 | 0.1139 | 1.186 | 1.853 | 3.457 | 0.000547 | 0.8148 | 0.42962 | 0.48333 | 0.3874 |
| rs2188079 | Imputed | C | GEN | 682 | | | | | 12.81 | 0.001651 | 0.8148 | 0.42962 | 0.48333 | 0.3874 |
| rs2190304 | Imputed | G | REC | 682 | 0.439 | 0.2056 | 0.2933 | 0.6567 | −4.005 | 6.20E−05 | 0.2503 | 0.47947 | 0.42667 | 0.5209 |
| rs2190597 | Imputed | T | DOM | 681 | 0.559 | 0.174 | 0.3978 | 0.7868 | −3.338 | 0.000844 | 0.9387 | 0.46916 | 0.43167 | 0.4987 |
| rs2190598 | Imputed | T | DOM | 682 | 0.56 | 0.1597 | 0.4098 | 0.7664 | −3.626 | 0.000288 | 0.9329 | 0.34824 | 0.30833 | 0.3796 |
| rs2190600 | Imputed | A | DOM | 672 | 0.561 | 0.1605 | 0.4097 | 0.7686 | −3.6 | 0.000319 | 0.9321 | 0.34598 | 0.3064 | 0.3773 |
| rs2218084 | Imputed | T | GEN | 664 | | | | | 8.488 | 0.01435 | 0.02385 | 0.16416 | 0.18983 | 0.1436 |
| rs2218084 | Imputed | T | REC | 664 | 3.657 | 0.4516 | 1.509 | 8.862 | 2.871 | 0.004092 | 0.02385 | 0.16416 | 0.18983 | 0.1436 |
| rs2236290 | Genotyped | C | GEN | 680 | | | | | 6.499 | 0.0388 | 0.5618 | 0.36103 | 0.32667 | 0.3882 |
| rs2243860 | Imputed | A | GEN | 548 | | | | | 9.796 | 0.00746 | 0.1582 | 0.40785 | 0.45021 | 0.3746 |
| rs2243860 | Imputed | A | REC | 548 | 2.168 | 0.2486 | 1.332 | 3.529 | 3.113 | 0.00185 | 0.1582 | 0.40785 | 0.45021 | 0.3746 |
| rs2246564 | Imputed | T | DOM | 682 | 0.529 | 0.2074 | 0.352 | 0.7937 | −3.074 | 0.00211 | 0.6748 | 0.10191 | 0.07333 | 0.1243 |
| rs2248236 | Imputed | C | ADD | 681 | 0.718 | 0.133 | 0.524 | 0.9842 | −2.059 | 0.03947 | 0.04865 | 0.20852 | 0.18833 | 0.2244 |
| rs2250340 | Imputed | T | DOM | 600 | 0.514 | 0.1608 | 0.3382 | 0.7813 | −3.115 | 0.001837 | 0.8378 | 0.1125 | 0.08113 | 0.1373 |
| rs2257192 | Imputed | G | DOM | 682 | 0.529 | 0.2074 | 0.352 | 0.7937 | −3.074 | 0.00211 | 0.6748 | 0.10191 | 0.07333 | 0.1243 |
| rs2270584 | Imputed | A | DOM | 679 | 0.567 | 0.1632 | 0.4117 | 0.7806 | −3.477 | 0.000507 | 0.7495 | 0.40059 | 0.36622 | 0.4276 |
| rs2270586 | Imputed | A | DOM | 680 | 0.564 | 0.1631 | 0.4095 | 0.7761 | −3.514 | 0.000442 | 0.8731 | 0.4 | 0.36622 | 0.4265 |
| rs2270589 | Imputed | A | ADD | 682 | 0.711 | 0.1121 | 0.5703 | 0.8851 | −3.048 | 0.002301 | 0.877 | 0.44648 | 0.40167 | 0.4817 |
| rs2270589 | Imputed | A | DOM | 682 | 0.552 | 0.1689 | 0.3961 | 0.7679 | −3.523 | 0.000426 | 0.877 | 0.44648 | 0.40167 | 0.4817 |
| rs2270589 | Imputed | A | GEN | 682 | | | | | 12.43 | 0.001996 | 0.877 | 0.44648 | 0.40167 | 0.4817 |
| rs2296889 | Imputed | C | DOM | 672 | 1.638 | 0.1743 | 1.164 | 2.305 | 2.832 | 0.004632 | 0.7651 | 0.15253 | 0.17508 | 0.1347 |
| rs2301346 | Imputed | G | ADD | 550 | 1.573 | 0.133 | 1.212 | 2.042 | 3.407 | 0.000656 | 0.2216 | 0.29818 | 0.35124 | 0.2565 |
| rs2301346 | Imputed | G | DOM | 550 | 1.763 | 0.1765 | 1.248 | 2.492 | 3.214 | 0.001311 | 0.2216 | 0.29818 | 0.35124 | 0.2565 |
| rs2327929 | Imputed | T | REC | 682 | 2.122 | 0.1996 | 1.435 | 3.137 | 3.769 | 0.000164 | 0.09898 | 0.42155 | 0.47333 | 0.3809 |
| rs2357486 | Imputed | C | REC | 673 | 2.717 | 0.2622 | 1.625 | 4.542 | 3.812 | 0.000138 | 0.7297 | 0.33432 | 0.37752 | 0.3 |
| rs2373793 | Imputed | G | DOM | 646 | 1.534 | 0.1778 | 1.083 | 2.173 | 2.407 | 0.0161 | 0.1726 | 0.15402 | 0.18151 | 0.1314 |
| rs2377622 | Imputed | T | GEN | 552 | | | | | 7.759 | 0.02066 | 0.9252 | 0.34692 | 0.3125 | 0.3719 |
| rs2377622 | Imputed | T | REC | 552 | 0.437 | 0.2982 | 0.2436 | 0.784 | −2.776 | 0.005501 | 0.9252 | 0.34692 | 0.3125 | 0.3719 |
| rs2383903 | Imputed | G | DOM | 681 | 0.614 | 0.1576 | 0.4507 | 0.836 | −3.096 | 0.001959 | 0.9247 | 0.28267 | 0.245 | 0.3123 |
| rs2389866 | Imputed | C | DOM | 681 | 0.697 | 0.1612 | 0.508 | 0.9558 | −2.24 | 0.02509 | 0.06186 | 0.20705 | 0.185 | 0.2244 |
| rs2389869 | Imputed | C | DOM | 681 | 0.697 | 0.1612 | 0.508 | 0.9558 | −2.24 | 0.02509 | 0.06186 | 0.20705 | 0.185 | 0.2244 |
| rs2418541 | Imputed | A | DOM | 681 | 0.551 | 0.1595 | 0.4029 | 0.753 | −3.738 | 0.000186 | 1 | 0.34802 | 0.30667 | 0.3806 |
| rs2418542 | Imputed | A | DOM | 681 | 0.551 | 0.1595 | 0.4029 | 0.753 | −3.738 | 0.000186 | 1 | 0.34802 | 0.30667 | 0.3806 |
| rs2418548 | Imputed | C | DOM | 630 | 0.572 | 0.1639 | 0.4145 | 0.788 | −3.414 | 0.00064 | 0.9279 | 0.32698 | 0.29474 | 0.3536 |
| rs2476976 | Imputed | G | DOM | 681 | 1.728 | 0.1579 | 1.268 | 2.355 | 3.465 | 0.00053 | 0.855 | 0.29736 | 0.33278 | 0.2696 |
| rs2483639 | Imputed | A | DOM | 682 | 0.529 | 0.2074 | 0.352 | 0.7937 | −3.074 | 0.00211 | 0.6748 | 0.10191 | 0.07333 | 0.1243 |
| rs2483640 | Imputed | A | DOM | 682 | 0.529 | 0.2074 | 0.352 | 0.7937 | −3.074 | 0.00211 | 0.6748 | 0.10191 | 0.07333 | 0.1243 |
| rs2544780 | Imputed | T | REC | 670 | 1.881 | 0.2505 | 1.151 | 3.073 | 2.521 | 0.0117 | 0.248 | 0.3194 | 0.35959 | 0.2884 |
| rs2586458 | Imputed | T | DOM | 322 | 0.507 | 0.2771 | 0.2947 | 0.8733 | −2.449 | 0.01433 | 0.4953 | 0.14286 | 0.10465 | 0.1684 |
| rs2593272 | Imputed | G | ADD | 682 | 0.712 | 0.1296 | 0.5521 | 0.9177 | −2.623 | 0.00872 | 0.6186 | 0.25953 | 0.225 | 0.2866 |
| rs2593273 | Imputed | T | ADD | 678 | 0.699 | 0.1321 | 0.5396 | 0.9057 | −2.71 | 0.006738 | 0.3627 | 0.25516 | 0.2198 | 0.2829 |
| rs2622499 | Imputed | G | DOM | 682 | 0.726 | 0.1604 | 0.5299 | 0.9939 | −1.998 | 0.04572 | 0.08586 | 0.21261 | 0.19333 | 0.2277 |
| rs264126 | Imputed | C | DOM | 679 | 0.553 | 0.1744 | 0.3932 | 0.779 | −3.392 | 0.000693 | 0.9386 | 0.46981 | 0.43167 | 0.5 |

TABLE 9-continued

| | | | | | | | | | | | |
|---|---|---|---|---|---|---|---|---|---|---|---|
| rs264129 | Imputed | T | DOM | 681 | 0.561 | 0.1597 | 0.4104 | 0.7675 | −3.617 | 0.000298 | 1 | 0.34802 | 0.30833 | 0.3793 |
| rs2656822 | Imputed | T | ADD | 682 | 0.712 | 0.1296 | 0.5521 | 0.9177 | −2.623 | 0.00872 | 0.6186 | 0.25953 | 0.225 | 0.2866 |
| rs2656823 | Imputed | G | ADD | 682 | 0.712 | 0.1296 | 0.5521 | 0.9177 | −2.623 | 0.00872 | 0.6186 | 0.25953 | 0.225 | 0.2866 |
| rs2656825 | Imputed | T | ADD | 665 | 0.702 | 0.1338 | 0.5398 | 0.9119 | −2.649 | 0.00807 | 0.4115 | 0.25263 | 0.21747 | 0.2802 |
| rs2764766 | Imputed | C | REC | 678 | 1.803 | 0.2463 | 1.112 | 2.922 | 2.393 | 0.01673 | 0.2549 | 0.32448 | 0.36364 | 0.294 |
| rs2793101 | Imputed | T | ADD | 680 | 0.506 | 0.1889 | 0.3491 | 0.732 | −3.612 | 0.000304 | 1 | 0.1125 | 0.07833 | 0.1395 |
| rs2793101 | Imputed | T | DOM | 680 | 0.501 | 0.2 | 0.3385 | 0.7413 | −3.457 | 0.000547 | 1 | 0.1125 | 0.07833 | 0.1395 |
| rs2795871 | Imputed | A | ADD | 676 | 0.578 | 0.2256 | 0.3717 | 0.9 | −2.427 | 0.01522 | 0.3783 | 0.07175 | 0.05201 | 0.0873 |
| rs2795886 | Imputed | A | DOM | 681 | 0.507 | 0.2747 | 0.2962 | 0.8693 | −2.47 | 0.01352 | 0.0724 | 0.04919 | 0.03167 | 0.063 |
| rs2795886 | Imputed | A | ADD | 681 | 0.517 | 0.2884 | 0.2939 | 0.9104 | −2.285 | 0.02229 | 0.0724 | 0.04919 | 0.03167 | 0.063 |
| rs2859994 | Imputed | C | GEN | 645 | | | | | 9.449 | 0.008877 | 0.112 | 0.37984 | 0.41986 | 0.3478 |
| rs2870464 | Imputed | G | DOM | 682 | 1.534 | 0.1771 | 1.084 | 2.171 | 2.417 | 0.01564 | 0.5379 | 0.14443 | 0.17 | 0.1243 |
| rs2875528 | Imputed | T | DOM | 682 | 1.705 | 0.2034 | 1.144 | 2.541 | 2.623 | 0.008711 | 0.3705 | 0.09457 | 0.11333 | 0.0798 |
| rs2876227 | Imputed | C | ADD | 640 | 1.393 | 0.1179 | 1.106 | 1.755 | 2.811 | 0.00494 | 0.226 | 0.35156 | 0.39785 | 0.3158 |
| rs2876227 | Imputed | C | GEN | 640 | | | | | 8.788 | 0.01235 | 0.226 | 0.35156 | 0.39785 | 0.3158 |
| rs2882097 | Imputed | A | DOM | 682 | 1.772 | 0.1576 | 1.301 | 2.413 | 3.63 | 0.000284 | 1 | 0.29692 | 0.335 | 0.267 |
| rs2921983 | Imputed | C | ADD | 640 | 0.679 | 0.1387 | 0.5173 | 0.8909 | −2.793 | 0.00522 | 0.5889 | 0.23984 | 0.20285 | 0.2688 |
| rs2987537 | Imputed | C | DOM | 682 | 0.501 | 0.1957 | 0.3413 | 0.735 | −3.533 | 0.000411 | 0.2158 | 0.1239 | 0.09 | 0.1505 |
| rs2996416 | Imputed | C | ADD | 682 | 0.518 | 0.1922 | 0.3551 | 0.7544 | −3.426 | 0.000612 | 0.3055 | 0.10484 | 0.07167 | 0.1309 |
| rs2996416 | Imputed | C | DOM | 682 | 0.474 | 0.2097 | 0.3145 | 0.7155 | −3.556 | 0.000376 | 0.3055 | 0.10484 | 0.07167 | 0.1309 |
| rs3015527 | Imputed | C | ADD | 677 | 0.519 | 0.1922 | 0.3558 | 0.7559 | −3.416 | 0.000635 | 0.303 | 0.10487 | 0.07191 | 0.131 |
| rs3015527 | Imputed | C | DOM | 677 | 0.476 | 0.2098 | 0.3154 | 0.7179 | −3.54 | 0.000401 | 0.303 | 0.10487 | 0.07191 | 0.131 |
| rs3015530 | Imputed | C | ADD | 682 | 0.518 | 0.1922 | 0.3551 | 0.7544 | −3.426 | 0.000612 | 0.3055 | 0.10484 | 0.07167 | 0.1309 |
| rs3015530 | Imputed | C | DOM | 682 | 0.474 | 0.2097 | 0.3145 | 0.7155 | −3.556 | 0.000376 | 0.3055 | 0.10484 | 0.07167 | 0.1309 |
| rs3015531 | Imputed | T | ADD | 682 | 0.518 | 0.1922 | 0.3551 | 0.7544 | −3.426 | 0.000612 | 0.3055 | 0.10484 | 0.07167 | 0.1309 |
| rs3015531 | Imputed | T | DOM | 682 | 0.474 | 0.2097 | 0.3145 | 0.7155 | −3.556 | 0.000376 | 0.3055 | 0.10484 | 0.07167 | 0.1309 |
| rs3015535 | Imputed | C | ADD | 682 | 0.518 | 0.1922 | 0.3551 | 0.7544 | −3.426 | 0.000612 | 0.3055 | 0.10484 | 0.07167 | 0.1309 |
| rs3015535 | Imputed | C | DOM | 682 | 0.474 | 0.2097 | 0.3145 | 0.7155 | −3.556 | 0.000376 | 0.3055 | 0.10484 | 0.07167 | 0.1309 |
| rs3019407 | Imputed | A | GEN | 675 | | | | | 12.63 | 0.001808 | 0.08658 | 0.34074 | 0.29561 | 0.376 |
| rs3019407 | Genotyped | C | REC | 675 | 0.382 | 0.2927 | 0.2154 | 0.6786 | −3.285 | 0.001021 | 0.08658 | 0.33724 | 0.29561 | 0.376 |
| rs36071725 | Imputed | C | GEN | 682 | | | | | 15.36 | 0.000463 | 0.6072 | 0.37984... | 0.38333 | 0.301 |
| rs373983 | Imputed | G | DOM | 661 | 1.911 | 0.1684 | 1.373 | 2.658 | 3.844 | 0.000121 | 0.4632 | 0.39334 | 0.44692 | 0.3509 |
| rs37561154 | Imputed | C | DOM | 681 | 0.697 | 0.1612 | 0.508 | 0.9558 | −2.24 | 0.02509 | 0.06186 | 0.20705 | 0.185 | 0.2244 |
| rs3793044 | Imputed | C | ADD | 682 | 2.264 | 0.2373 | 1.422 | 3.606 | 3.444 | 0.000573 | 0.205 | 0.06598 | 0.09167 | 0.0458 |
| rs3793044 | Imputed | C | DOM | 682 | 2.432 | 0.2521 | 1.484 | 3.986 | 3.525 | 0.000423 | 0.205 | 0.06598 | 0.09167 | 0.0458 |
| rs3793053 | Imputed | C | ADD | 672 | 2.017 | 0.2117 | 1.332 | 3.055 | 3.316 | 0.000914 | 0.6256 | 0.08705 | 0.11409 | 0.0655 |
| rs3793053 | Imputed | C | DOM | 672 | 2.188 | 0.2249 | 1.408 | 3.4 | 3.48 | 0.000501 | 0.6256 | 0.08705 | 0.11409 | 0.0655 |
| rs3796246 | Imputed | G | ADD | 682 | 0.511 | 0.2045 | 0.3419 | 0.7623 | −3.287 | 0.001012 | 1 | 0.09531 | 0.065 | 0.1191 |
| rs3796246 | Imputed | G | DOM | 682 | 0.497 | 0.2139 | 0.3265 | 0.7551 | −3.273 | 0.001063 | 1 | 0.09531 | 0.065 | 0.1191 |
| rs3805996 | Imputed | G | ADD | 662 | 2.146 | 0.2358 | 1.352 | 3.407 | 3.239 | 0.001199 | 0.1442 | 0.07251 | 0.0976 | 0.0527 |
| rs3805996 | Imputed | G | DOM | 662 | 2.368 | 0.2509 | 1.448 | 3.871 | 3.436 | 0.00059 | 0.1442 | 0.07251 | 0.0976 | 0.0527 |
| rs3806003 | Imputed | A | ADD | 682 | 2.264 | 0.2373 | 1.422 | 3.606 | 3.444 | 0.000573 | 0.205 | 0.06598 | 0.09167 | 0.0458 |
| rs3806003 | Imputed | A | DOM | 682 | 2.432 | 0.2521 | 1.484 | 3.986 | 3.525 | 0.000423 | 0.205 | 0.06598 | 0.09167 | 0.0458 |
| rs3806004 | Imputed | T | ADD | 682 | 2.008 | 0.2082 | 1.336 | 3.02 | 3.35 | 0.000808 | 0.4997 | 0.09238 | 0.12 | 0.0707 |
| rs3806004 | Imputed | T | DOM | 682 | 2.219 | 0.2217 | 1.437 | 3.427 | 3.596 | 0.000324 | 0.4997 | 0.09238 | 0.12 | 0.0707 |
| rs3806010 | Imputed | T | ADD | 682 | 2.008 | 0.2082 | 1.336 | 3.02 | 3.35 | 0.000808 | 0.4997 | 0.09238 | 0.12 | 0.0707 |
| rs3806010 | Imputed | T | DOM | 682 | 2.219 | 0.2217 | 1.437 | 3.427 | 3.596 | 0.000324 | 0.4997 | 0.09238 | 0.12 | 0.0707 |
| rs3806014 | Imputed | T | ADD | 682 | 2.008 | 0.2082 | 1.336 | 3.02 | 3.35 | 0.000808 | 0.4997 | 0.09238 | 0.12 | 0.0707 |
| rs3806014 | Imputed | T | DOM | 682 | 2.219 | 0.2217 | 1.437 | 3.427 | 3.596 | 0.000324 | 0.4997 | 0.09238 | 0.12 | 0.0707 |
| rs3806015 | Imputed | A | ADD | 682 | 2.008 | 0.2082 | 1.336 | 3.02 | 3.35 | 0.000808 | 0.4997 | 0.09238 | 0.12 | 0.0707 |
| rs3806015 | Imputed | A | DOM | 682 | 2.219 | 0.2217 | 1.437 | 3.427 | 3.596 | 0.000324 | 0.4997 | 0.09238 | 0.12 | 0.0707 |
| rs3806018 | Imputed | A | ADD | 682 | 2.008 | 0.2082 | 1.336 | 3.02 | 3.35 | 0.000808 | 0.4997 | 0.09238 | 0.12 | 0.0707 |
| rs3806018 | Imputed | A | DOM | 682 | 2.219 | 0.2217 | 1.437 | 3.427 | 3.596 | 0.000324 | 0.4997 | 0.09238 | 0.12 | 0.0707 |

TABLE 9-continued

| SNP | Type | Allele | Model | N | | | | | | | | | | |
|---|---|---|---|---|---|---|---|---|---|---|---|---|---|---|
| rs3806019 | Imputed | A | ADD | 678 | 2.145 | 0.2126 | 1.414 | 3.253 | 3.588 | 0.000333 | 0.6198 | 0.08555 | 0.11538 | 0.062 |
| rs3806019 | Imputed | A | DOM | 678 | 2.353 | 0.2258 | 1.511 | 3.663 | 3.788 | 0.000152 | 0.6198 | 0.08555 | 0.11538 | 0.062 |
| rs3806024 | Imputed | T | ADD | 672 | 2.017 | 0.2117 | 1.332 | 3.055 | 3.316 | 0.000914 | 0.6256 | 0.08705 | 0.11409 | 0.0655 |
| rs3806024 | Imputed | T | DOM | 672 | 2.188 | 0.2249 | 1.408 | 3.4 | 3.48 | 0.000501 | 0.6256 | 0.08705 | 0.11409 | 0.0655 |
| rs3847825 | Imputed | G | ADD | 680 | 0.691 | 0.112 | 0.5544 | 0.8601 | −3.305 | 0.00095 | 0.03311 | 0.37353 | 0.32107 | 0.4147 |
| rs3847825 | Genotyped | G | GEN | 680 | | | | | 11.36 | 0.003414 | 0.03311 | 0.37353 | 0.32107 | 0.4147 |
| rs3852001 | Genotyped | C | GEN | 682 | | | | | 13.99 | 0.000919 | 0.07037 | 0.19721 | 0.24167 | 0.1623 |
| rs3852001 | Imputed | C | REC | 682 | 4.254 | 0.4136 | 1.891 | 9.569 | 3.5 | 0.000465 | 0.07037 | 0.19721 | 0.24167 | 0.1623 |
| rs3852002 | Imputed | G | GEN | 681 | | | | | 13.41 | 0.001226 | 0.08816 | 0.1953 | 0.23913 | 0.161 |
| rs3852002 | Imputed | G | REC | 681 | 4.089 | 0.4152 | 1.812 | 9.226 | 3.392 | 0.000694 | 0.08816 | 0.1953 | 0.23913 | 0.161 |
| rs3852003 | Imputed | A | GEN | 681 | | | | | 13.41 | 0.001226 | 0.08816 | 0.1953 | 0.23913 | 0.161 |
| rs3852003 | Imputed | A | REC | 681 | 4.089 | 0.4152 | 1.812 | 9.226 | 3.392 | 0.000694 | 0.08816 | 0.1953 | 0.23913 | 0.161 |
| rs3942254 | Imputed | T | DOM | 678 | 0.6 | 0.1651 | 0.4341 | 0.8292 | −3.094 | 0.001974 | 1 | 0.40413 | 0.37037 | 0.4304 |
| rs3945085 | Imputed | A | DOM | 682 | 1.794 | 0.1572 | 1.319 | 2.442 | 3.72 | 0.000199 | 1 | 0.29252 | 0.33167 | 0.2618 |
| rs399485 | Imputed | A | DOM | 678 | 1.537 | 0.1571 | 1.129 | 2.091 | 2.735 | 0.006241 | 0.697 | 0.26917 | 0.30705 | 0.2395 |
| rs4029119 | Imputed | G | ADD | 682 | 0.217 | 0.4129 | 0.0965 | 0.4867 | −3.704 | 0.000213 | 0.06816 | 0.03812 | 0.01667 | 0.055 |
| rs4029119 | Imputed | G | DOM | 682 | 0.223 | 0.4255 | 0.0967 | 0.5123 | −3.532 | 0.000412 | 0.06816 | 0.03812 | 0.01667 | 0.055 |
| rs412791 | Imputed | C | GEN | 675 | | | | | 12.74 | 0.001714 | 0.8702 | 0.38 | 0.33054 | 0.4191 |
| rs4146972 | Imputed | T | DOM | 682 | 1.42 | 0.1657 | 1.026 | 1.965 | 2.117 | 0.0343 | 0.6059 | 0.18035 | 0.19833 | 0.1662 |
| rs4259369 | Genotyped | C | REC | 679 | 0.645 | 0.1981 | 0.4374 | 0.9509 | −2.214 | 0.02681 | 0.01503 | 0.42636 | 0.40468 | 0.4434 |
| rs4273613 | Imputed | T | ADD | 682 | 0.217 | 0.4129 | 0.0965 | 0.4867 | −3.704 | 0.000213 | 0.06816 | 0.03812 | 0.01667 | 0.055 |
| rs4273613 | Imputed | T | DOM | 682 | 0.223 | 0.4255 | 0.0967 | 0.5123 | −3.532 | 0.000412 | 0.06816 | 0.03812 | 0.01667 | 0.055 |
| rs4294022 | Imputed | C | DOM | 659 | 0.632 | 0.1627 | 0.4591 | 0.8687 | −2.825 | 0.004728 | 1 | 0.23293 | 0.19792 | 0.2601 |
| rs4310554 | Genotyped | C | GEN | 682 | 1.747 | 0.1888 | 1.207 | 2.53 | 2.956 | 0.00312 | 0.2203 | 0.49707 | 0.54167 | 0.462 |
| rs4315598 | Imputed | T | ADD | 682 | 1.338 | 0.1141 | 1.07 | 1.674 | 2.555 | 0.01063 | 0.2786 | 0.35777 | 0.39667 | 0.3272 |
| rs4315598 | Imputed | T | GEN | 682 | | | | | 7.867 | 0.01957 | 0.2786 | 0.35777 | 0.39667 | 0.3272 |
| rs4370878 | Imputed | G | DOM | 682 | 1.755 | 0.157 | 1.29 | 2.388 | 3.583 | 0.00034 | 0.9265 | 0.29399 | 0.33167 | 0.2644 |
| rs4436200 | Imputed | C | ADD | 682 | 0.718 | 0.169 | 0.5154 | 0.9996 | −1.963 | 0.0497 | 0.2391 | 0.1305 | 0.11 | 0.1466 |
| rs4444612 | Imputed | G | ADD | 682 | 1.338 | 0.1141 | 1.07 | 1.674 | 2.555 | 0.01063 | 0.2786 | 0.35777 | 0.39667 | 0.3272 |
| rs4444612 | Imputed | G | GEN | 682 | | | | | 7.867 | 0.01957 | 0.2786 | 0.35777 | 0.39667 | 0.3272 |
| rs4450660 | Imputed | C | DOM | 675 | 1.654 | 0.1588 | 1.212 | 2.258 | 3.168 | 0.001533 | 0.07497 | 0.24296 | 0.27778 | 0.2156 |
| rs4463950 | Imputed | C | DOM | 671 | 0.617 | 0.1688 | 0.4431 | 0.8588 | −2.862 | 0.004214 | 0.9374 | 0.43294 | 0.40541 | 0.4547 |
| rs4509702 | Genotyped | T | GEN | 682 | 1.755 | 0.157 | 1.29 | 2.388 | 3.583 | 0.00034 | 0.9265 | 0.29399 | 0.33167 | 0.2644 |
| rs4533379 | Imputed | T | ADD | 682 | 1.561 | 0.1254 | 1.221 | 1.995 | 3.551 | 0.000384 | 0.6918 | 0.26211 | 0.31 | 0.2244 |
| rs4569984 | Imputed | A | DOM | 671 | 0.645 | 0.1612 | 0.4706 | 0.8853 | −2.715 | 0.006623 | 0.8278 | 0.231 | 0.19661 | 0.258 |
| rs4570530 | Imputed | C | DOM | 681 | 1.766 | 0.1571 | 1.298 | 2.403 | 3.62 | 0.000295 | 0.9266 | 0.29369 | 0.33167 | 0.2638 |
| rs4571583 | Imputed | T | ADD | 666 | 0.645 | 0.162 | 0.4697 | 0.8862 | −2.706 | 0.006814 | 0.91334 | 0.23123 | 0.19759 | 0.2573 |
| rs4586678 | Imputed | A | DOM | 678 | 1.637 | 0.1582 | 1.2 | 2.232 | 3.114 | 0.001843 | 0.07807 | 0.24484 | 0.27852 | 0.2184 |
| rs4615971 | Imputed | G | ADD | 530 | 1.8 | 0.1582 | 1.32 | 2.455 | 3.716 | 0.000202 | 0.9269 | 0.29734 | 0.33784 | 0.2658 |
| rs4629229 | Imputed | G | DOM | 676 | 0.521 | 0.1725 | 0.3715 | 0.7305 | −3.78 | 0.000157 | 0.4294 | 0.17595 | 0.13667 | 0.2068 |
| rs4632512 | Imputed | T | GEN | 681 | | | | | 13.12 | 0.001413 | 0.1414 | 0.19457 | 0.23833 | 0.1601 |
| rs4641552 | Imputed | A | ADD | 678 | 0.514 | 0.2311 | 0.3271 | 0.8092 | −2.876 | 0.004025 | 0.7689 | 0.07153 | 0.04849 | 0.0897 |
| rs4682527 | Imputed | C | DOM | 656 | 1.64 | 0.1669 | 1.183 | 2.275 | 2.966 | 0.003017 | 0.3618 | 0.37805 | 0.40941 | 0.3537 |
| rs4688632 | Imputed | G | REC | 675 | 0.538 | 0.1943 | 0.3678 | 0.7876 | −3.189 | 0.001429 | 0.3557 | 0.48889 | 0.45424 | 0.5158 |
| rs4702720 | Imputed | A | ADD | 530 | 0.596 | 0.1535 | 0.4412 | 0.8051 | −3.372 | 0.000745 | 0.08183 | 0.22547 | 0.17842 | 0.2647 |
| rs4702720 | Imputed | A | DOM | 530 | 0.541 | 0.1863 | 0.3758 | 0.7798 | −3.295 | 0.000984 | 0.08183 | 0.22547 | 0.17842 | 0.2647 |
| rs4714484 | Imputed | A | ADD | 681 | 0.631 | 0.1545 | 0.4661 | 0.8539 | −2.982 | 0.002861 | 0.8896 | 0.1652 | 0.13 | 0.1929 |
| rs4714484 | Imputed | A | DOM | 681 | 0.606 | 0.1733 | 0.4315 | 0.8511 | −2.89 | 0.003849 | 0.8896 | 0.1652 | 0.13 | 0.1929 |
| rs4725142 | Genotyped | G | REC | 682 | 0.444 | 0.2656 | 0.2639 | 0.7476 | −3.055 | 0.002251 | 0.2804 | 0.3585 | 0.33667 | 0.3757 |
| rs4725144 | Imputed | G | REC | 677 | 0.427 | 0.2722 | 0.2502 | 0.7275 | −3.129 | 0.001756 | 0.2734 | 0.35229 | 0.32886 | 0.3707 |
| rs4760785 | Imputed | A | ADD | 657 | 0.709 | 0.1165 | 0.5639 | 0.8903 | −2.957 | 0.003102 | 0.5823 | 0.45282 | 0.41003 | 0.4864 |
| rs4760785 | Imputed | A | DOM | 657 | 0.595 | 0.1749 | 0.4222 | 0.8382 | −2.969 | 0.002989 | 0.5823 | 0.45282 | 0.41003 | 0.4864 |
| rs4760894 | Imputed | T | ADD | 657 | 0.709 | 0.1165 | 0.5639 | 0.8903 | −2.957 | 0.003102 | 0.5823 | 0.45282 | 0.41003 | 0.4864 |

TABLE 9-continued

| | | | | | | | | | | |
|---|---|---|---|---|---|---|---|---|---|---|
| rs4760894 | Imputed | T | DOM | 657 | 0.595 | 0.1749 | 0.4222 | 0.8382 | −2.969 | 0.002989 | 0.5823 | 0.45282 | 0.41003 | 0.4864 |
| rs4760895 | Imputed | A | ADD | 657 | 0.709 | 0.1165 | 0.5639 | 0.8903 | −2.957 | 0.003102 | 0.5823 | 0.45282 | 0.41003 | 0.4864 |
| rs4760895 | Imputed | A | DOM | 657 | 0.595 | 0.1749 | 0.4222 | 0.8382 | −2.969 | 0.002989 | 0.5823 | 0.45282 | 0.41003 | 0.4864 |
| rs4767184 | Imputed | C | ADD | 678 | 0.704 | 0.1112 | 0.5659 | 0.8752 | −3.159 | 0.001584 | 0.02822 | 0.38127 | 0.3311 | 0.4208 |
| rs4767184 | Imputed | C | GEN | 678 | | | | | 9.99 | 0.006772 | 0.02822 | 0.38127 | 0.3311 | 0.4208 |
| rs4773487 | Imputed | T | ADD | 682 | 0.555 | 0.1837 | 0.3871 | 0.7953 | −3.207 | 0.001342 | 0.2503 | 0.11364 | 0.08167 | 0.1387 |
| rs4780547 | Imputed | G | GEN | 682 | | | | | 8.214 | 0.01646 | 0.14488 | 0.22141 | 0.19167 | 0.2448 |
| rs4780547 | Imputed | G | REC | 682 | 0.327 | 0.3979 | 0.1501 | 0.7141 | −2.806 | 0.005013 | 0.14488 | 0.22141 | 0.19167 | 0.2448 |
| rs483159 | Imputed | T | DOM | 611 | 1.742 | 0.1718 | 1.244 | 2.44 | 3.23 | 0.001236 | 0.899 | 0.19722 | 0.23432 | 0.1676 |
| rs4836502 | Imputed | T | DOM | 682 | 0.56 | 0.1597 | 0.4098 | 0.7664 | −3.626 | 0.000288 | 0.9329 | 0.34824 | 0.30833 | 0.3796 |
| rs4836507 | Imputed | C | DOM | 672 | 0.561 | 0.1605 | 0.4097 | 0.7686 | −3.6 | 0.000319 | 0.9321 | 0.34598 | 0.3064 | 0.3773 |
| rs4851531 | Imputed | T | DOM | 677 | 0.722 | 0.1629 | 0.5246 | 0.9935 | −2 | 0.0455 | 1 | 0.4062 | 0.37584 | 0.4301 |
| rs4879931 | Imputed | G | ADD | 678 | 0.672 | 0.1211 | 0.5303 | 0.8526 | −3.277 | 0.00105 | 0.2044 | 0.30457 | 0.25758 | 0.3412 |
| rs489441 | Imputed | G | ADD | 631 | 1.549 | 0.1342 | 1.191 | 2.015 | 3.261 | 0.00111 | 0.4702 | 0.2607 | 0.30545 | 0.2261 |
| rs489441 | Imputed | G | DOM | 631 | 1.778 | 0.164 | 1.289 | 2.452 | 3.509 | 0.00045 | 0.4702 | 0.2607 | 0.30545 | 0.2261 |
| rs4976276 | Imputed | T | ADD | 681 | 1.45 | 0.125 | 1.135 | 1.853 | 2.973 | 0.002945 | 0.07074 | 0.3047 | 0.345 | 0.273 |
| rs4977681 | Imputed | C | REC | 682 | 2.487 | 0.278 | 1.442 | 4.288 | 3.278 | 0.001047 | 0.7153 | 0.29912 | 0.33 | 0.2749 |
| rs4986197 | Imputed | G | ADD | 679 | 1.564 | 0.1255 | 1.223 | 2 | 3.563 | 0.000366 | 0.6211 | 0.26215 | 0.3104 | 0.2244 |
| rs4986220 | Imputed | T | ADD | 681 | 1.538 | 0.1266 | 1.2 | 1.971 | 3.4 | 0.000673 | 0.8411 | 0.25698 | 0.30268 | 0.2212 |
| rs525462 | Imputed | A | GEN | 682 | | | | | 4.513 | 0.1047 | 0.1205 | 0.56012 | 0.53 | 0.5838 |
| rs552006 | Imputed | G | GEN | 678 | | | | | 9.189 | 0.01011 | 0.00901 | 0.2913 | 0.32886 | 0.2618 |
| rs5756669 | Imputed | C | DOM | 679 | 1.798 | 0.1769 | 1.271 | 2.543 | 3.316 | 0.000914 | 1 | 0.45582 | 0.49664 | 0.4239 |
| rs581905 | Imputed | T | DOM | 681 | 1.742 | 0.218 | 1.137 | 2.671 | 2.548 | 0.01085 | 1 | 0.08003 | 0.10167 | 0.063 |
| rs6033138 | Imputed | C | ADD | 682 | 1.338 | 0.1141 | 1.07 | 1.674 | 2.555 | 0.01063 | 0.2786 | 0.35777 | 0.39667 | 0.3272 |
| rs6033138 | Imputed | C | GEN | 682 | | | | | 7.867 | 0.01957 | 0.2786 | 0.35777 | 0.39667 | 0.3272 |
| rs6040619 | Imputed | C | ADD | 677 | 1.341 | 0.1132 | 1.074 | 1.675 | 2.594 | 0.009478 | 0.2114 | 0.36115 | 0.40101 | 0.3298 |
| rs6040619 | Imputed | C | GEN | 677 | | | | | 7.963 | 0.01866 | 0.2114 | 0.36115 | 0.40101 | 0.3298 |
| rs6040625 | Imputed | T | ADD | 680 | 1.351 | 0.1131 | 1.082 | 1.686 | 2.66 | 0.007824 | 0.2138 | 0.36103 | 0.40167 | 0.3289 |
| rs6040625 | Imputed | T | GEN | 680 | | | | | 8.078 | 0.01761 | 0.2138 | 0.36103 | 0.40167 | 0.3289 |
| rs6040630 | Imputed | A | ADD | 679 | 1.356 | 0.1137 | 1.085 | 1.694 | 2.676 | 0.007453 | 0.317 | 0.35935 | 0.4 | 0.3272 |
| rs6040630 | Imputed | A | GEN | 679 | | | | | 8.108 | 0.01735 | 0.317 | 0.35935 | 0.4 | 0.3272 |
| rs6040633 | Imputed | A | ADD | 679 | 1.356 | 0.1137 | 1.085 | 1.694 | 2.676 | 0.007453 | 0.317 | 0.35935 | 0.4 | 0.3272 |
| rs6040633 | Imputed | A | GEN | 679 | | | | | 8.108 | 0.01735 | 0.317 | 0.35935 | 0.4 | 0.3272 |
| rs6040634 | Imputed | T | ADD | 682 | 1.306 | 0.1123 | 1.048 | 1.628 | 2.378 | 0.01743 | 0.2463 | 0.3629 | 0.4 | 0.3338 |
| rs6040634 | Imputed | T | GEN | 682 | | | | | 6.36 | 0.0416 | 0.2463 | 0.3629 | 0.4 | 0.3338 |
| rs6040636 | Imputed | T | ADD | 681 | 1.312 | 0.1124 | 1.052 | 1.635 | 2.413 | 0.01583 | 0.2147 | 0.3627 | 0.4 | 0.3333 |
| rs6040636 | Imputed | T | GEN | 681 | | | | | 6.462 | 0.03952 | 0.2147 | 0.3627 | 0.4 | 0.3333 |
| rs6040638 | Imputed | C | ADD | 682 | 1.338 | 0.1141 | 1.07 | 1.674 | 2.555 | 0.01063 | 0.2786 | 0.35777 | 0.39667 | 0.3272 |
| rs6040638 | Imputed | C | GEN | 682 | | | | | 7.867 | 0.01957 | 0.2786 | 0.35777 | 0.39667 | 0.3272 |
| rs6040644 | Imputed | A | ADD | 680 | 1.338 | 0.1141 | 1.07 | 1.674 | 2.554 | 0.01065 | 0.2795 | 0.35882 | 0.39799 | 0.3281 |
| rs6040644 | Imputed | A | GEN | 680 | | | | | 7.863 | 0.01962 | 0.2795 | 0.35882 | 0.39799 | 0.3281 |
| rs6040667 | Imputed | A | ADD | 669 | 1.394 | 0.1165 | 1.11 | 1.752 | 2.853 | 0.004333 | 0.3047 | 0.34529 | 0.38908 | 0.3112 |
| rs6040667 | Imputed | T | GEN | 669 | | | | | 8.924 | 0.01154 | 0.3047 | 0.34529 | 0.38908 | 0.3112 |
| rs6040668 | Imputed | C | ADD | 669 | 1.394 | 0.1165 | 1.11 | 1.752 | 2.853 | 0.004333 | 0.3047 | 0.34529 | 0.38908 | 0.3112 |
| rs6040668 | Imputed | C | GEN | 669 | | | | | 8.924 | 0.01154 | 0.3047 | 0.34529 | 0.38908 | 0.3112 |
| rs6053005 | Imputed | C | DOM | 479 | 0.644 | 0.2558 | 0.3901 | 1.063 | −1.72 | 0.08545 | 0.7029 | 0.60334 | 0.59709 | 0.6081 |
| rs6054427 | Genotyped | G | REC | 679 | 2.249 | 0.2226 | 1.454 | 3.478 | 3.641 | 0.000271 | 0.6876 | 0.39323 | 0.44631 | 0.3517 |
| rs6075186 | Imputed | G | DOM | 682 | 0.521 | 0.1725 | 0.3715 | 0.7305 | 12.27 | 0.002167 | 0.4728 | 0.39736 | 0.44667 | 0.3586 |
| rs608278 | Imputed | A | ADD | 594 | 0.702 | 0.1219 | 0.5527 | 0.8913 | −3.78 | 0.000157 | 0.4294 | 0.17595 | 0.13667 | 0.2068 |
| rs6111540 | Imputed | A | ADD | 630 | 0.643 | 0.1186 | 0.5094 | 0.8109 | −2.904 | 0.003681 | 0.8663 | 0.41835 | 0.37354 | 0.4525 |
| rs6131206 | Imputed | C | ADD | 668 | 1.277 | 0.1203 | 1.009 | 1.617 | 2.033 | 0.04201 | 0.3108 | 0.29865 | 0.3299 | 0.2745 |
| rs6131208 | Imputed | T | ADD | 669 | 1.394 | 0.1165 | 1.11 | 1.752 | 2.853 | 0.004333 | 0.3047 | 0.34529 | 0.38908 | 0.3112 |

TABLE 9-continued

| | | | | | | | | | | |
|---|---|---|---|---|---|---|---|---|---|---|
| rs6131208 | Imputed | T | GEN | 669 | 0.521 | 0.1725 | 0.3715 | 0.7305 | 8.924 | 0.01154 | 0.3047 | 0.34529 | 0.38908 | 0.3112 |
| rs6131919 | Imputed | G | DOM | 682 | 0.338 | 0.1141 | 1.07 | 1.674 | −3.78 | 0.000157 | 0.4294 | 0.17595 | 0.13667 | 0.2068 |
| rs6134243 | Imputed | C | ADD | 682 | 1.338 | 0.1141 | | | 2.555 | 0.01063 | 0.2786 | 0.35777 | 0.39667 | 0.3272 |
| rs6134243 | Imputed | C | GEN | 682 | | | | | 7.867 | 0.01957 | 0.2786 | 0.35777 | 0.39667 | 0.3272 |
| rs6136020 | Imputed | A | DOM | 681 | 0.511 | 0.1731 | 0.3638 | 0.7171 | −3.881 | 0.000104 | 0.4267 | 0.17548 | 0.13545 | 0.2068 |
| rs613799 | Imputed | C | DOM | 582 | 1.79 | 0.1709 | 1.28 | 2.502 | 3.405 | 0.000663 | 1 | 0.28866 | 0.32738 | 0.2591 |
| rs644041 | Imputed | G | DOM | 621 | 1.565 | 0.135 | 1.201 | 2.039 | 3.319 | 0.000902 | 0.4688 | 0.26329 | 0.30882 | 0.2278 |
| rs644041 | Imputed | G | ADD | 621 | 1.762 | 0.165 | 1.275 | 2.435 | 3.433 | 0.000597 | 0.4688 | 0.26329 | 0.30882 | 0.2278 |
| rs6464377 | Imputed | C | DOM | 681 | 2.223 | 0.2258 | 1.428 | 3.46 | 3.538 | 0.000404 | 0.5678 | 0.07269 | 0.09833 | 0.0525 |
| rs6474230 | Imputed | T | DOM | 681 | 1.542 | 0.1596 | 1.127 | 2.108 | 2.712 | 0.006696 | 0.106 | 0.23128 | 0.25585 | 0.212 |
| rs6476565 | Imputed | A | DOM | 677 | 0.524 | 0.2092 | 0.3479 | 0.7901 | −3.086 | 0.00203 | 0.6704 | 0.10118 | 0.07239 | 0.1237 |
| rs6511286 | Imputed | T | ADD | 675 | 1.359 | 0.1178 | 1.079 | 1.712 | 2.603 | 0.009243 | 0.5353 | 0.31852 | 0.3557 | 0.2891 |
| rs6541829 | Genotyped | C | REC | 682 | 1.978 | 0.3119 | 1.073 | 3.646 | 2.187 | 0.02875 | 0.9213 | 0.2632 | 0.28833 | 0.2435 |
| rs6544721 | Imputed | G | DOM | 675 | 1.623 | 0.1588 | 1.189 | 2.216 | 3.049 | 0.002295 | 0.05817 | 0.24148 | 0.27458 | 0.2158 |
| rs6544728 | Imputed | T | DOM | 680 | 1.638 | 0.158 | 1.202 | 2.233 | 3.124 | 0.001785 | 0.03564 | 0.23971 | 0.27592 | 0.2113 |
| rs6665910 | Imputed | G | DOM | 675 | 0.576 | 0.1625 | 0.4188 | 0.7919 | −3.395 | 0.000685 | 0.1512 | 0.24963 | 0.21044 | 0.2804 |
| rs6581985 | Imputed | G | GEN | 661 | | | | | 8.243 | 0.01622 | 0.7098 | 0.29728 | 0.32646 | 0.2743 |
| rs6581985 | Imputed | G | REC | 661 | 2.29 | 0.2899 | 1.298 | 4.042 | 2.859 | 0.004255 | 0.7098 | 0.29728 | 0.32646 | 0.2743 |
| rs6685186 | Imputed | T | ADD | 680 | 1.508 | 0.1138 | 1.206 | 1.884 | 3.606 | 0.000312 | 0.9363 | 0.39926 | 0.45485 | 0.3556 |
| rs6685186 | Imputed | T | GEN | 680 | | | | | 13.11 | 0.001423 | 0.9363 | 0.39926 | 0.45485 | 0.3556 |
| rs670593 | Imputed | A | REC | 678 | 0.594 | 0.2258 | 0.3815 | 0.9244 | −2.308 | 0.02099 | 0.8731 | 0.40192 | 0.38629 | 0.4142 |
| rs6722640 | Imputed | T | DOM | 682 | 0.696 | 0.1624 | 0.5059 | 0.9562 | −2.236 | 0.02536 | 0.7521 | 0.40909 | 0.37833 | 0.4332 |
| rs6746170 | Imputed | A | DOM | 679 | 1.647 | 0.1581 | 1.208 | 2.245 | 3.155 | 0.001604 | 0.03549 | 0.24006 | 0.27685 | 0.2113 |
| rs6757316 | Imputed | A | GEN | 675 | | | | | 12.53 | 0.001901 | 0.4778 | 0.42222 | 0.46633 | 0.3876 |
| rs6805139 | Imputed | G | DOM | 681 | 1.829 | 0.1922 | 1.255 | 2.666 | 3.141 | 0.001685 | 0.4904 | 0.51101 | 0.54333 | 0.4856 |
| rs6808571 | Imputed | G | ADD | 675 | 1.794 | 0.1564 | 1.32 | 2.438 | 3.736 | 0.000187 | 0.5429 | 0.14889 | 0.19231 | 0.1144 |
| rs6816479 | Imputed | A | REC | 681 | 1.903 | 0.2298 | 1.213 | 2.985 | 2.8 | 0.005116 | 0.4521 | 0.35609 | 0.36789 | 0.3469 |
| rs6865976 | Imputed | C | DOM | 636 | 0.514 | 0.1832 | 0.3586 | 0.7355 | −3.636 | 0.000277 | 0.5254 | 0.47799 | 0.42419 | 0.5195 |
| rs687047 | Imputed | C | ADD | 682 | 0.621 | 0.1734 | 0.4423 | 0.8729 | −2.744 | 0.00607 | 0.485 | 0.1261 | 0.09833 | 0.1479 |
| rs6871041 | Imputed | C | DOM | 625 | 0.549 | 0.1652 | 0.3974 | 0.7594 | −3.626 | 0.000288 | 0.7819 | 0.3176 | 0.27957 | 0.3483 |
| rs688358 | Imputed | A | ADD | 672 | 0.627 | 0.1736 | 0.4457 | 0.8804 | −2.693 | 0.007071 | 0.4853 | 0.12723 | 0.09966 | 0.1489 |
| rs6908481 | Imputed | C | REC | 664 | 2.09 | 0.2119 | 1.38 | 3.166 | 3.479 | 0.000503 | 0.1953 | 0.39759 | 0.44138 | 0.3636 |
| rs6917224 | Imputed | A | ADD | 682 | 1.452 | 0.1114 | 1.167 | 1.806 | 3.346 | 0.000821 | 0.3803 | 0.40029 | 0.45167 | 0.3599 |
| rs6917224 | Imputed | A | GEN | 682 | | | | | 11.22 | 0.003661 | 0.3803 | 0.40029 | 0.45167 | 0.3599 |
| rs6920677 | Imputed | G | DOM | 669 | 0.657 | 0.1616 | 0.4785 | 0.9016 | −2.601 | 0.009294 | 0.5131 | 0.38266 | 0.3468 | 0.4113 |
| rs6994498 | Imputed | G | DOM | 679 | 1.555 | 0.1598 | 1.122 | 2.1 | 2.682 | 0.007325 | 0.1286 | 0.22975 | 0.25336 | 0.2113 |
| rs6998772 | Imputed | T | DOM | 682 | 2.585 | 0.2693 | 1.525 | 4.383 | 3.526 | 0.000422 | 0.1493 | 0.05572 | 0.07833 | 0.038 |
| rs7022281 | Imputed | C | DOM | 678 | 0.736 | 0.1153 | 0.5872 | 0.9228 | −2.656 | 0.007896 | 0.8713 | 0.38569 | 0.34783 | 0.4156 |
| rs7022281 | Imputed | C | ADD | 678 | 0.39 | 0.3429 | 0.1992 | 0.7638 | 7.862 | 0.01963 | 0.8713 | 0.38569 | 0.34783 | 0.4156 |
| rs7022281 | Imputed | C | REC | 678 | 0.551 | 0.2295 | 0.3514 | 0.864 | −2.597 | 0.009407 | 0.6702 | 0.10103 | 0.07239 | 0.1234 |
| rs7043983 | Imputed | A | DOM | 682 | 0.526 | 0.2092 | 0.3491 | 0.7928 | −3.07 | 0.00214 | 1 | 0.29692 | 0.335 | 0.267 |
| rs7077799 | Imputed | A | DOM | 681 | 1.772 | 0.1576 | 1.301 | 2.413 | 3.63 | 0.000284 | 0.3761 | 0.07122 | 0.05167 | 0.0866 |
| rs7089947 | Imputed | C | ADD | 682 | 0.579 | 0.2256 | 0.372 | 0.9006 | −2.424 | 0.01536 | | 0.29545 | 0.335 | 0.2644 |
| rs7089661 | Imputed | C | DOM | 682 | 1.786 | 0.1574 | 1.312 | 2.431 | 3.685 | 0.000229 | 1 | 0.28488 | 0.24167 | 0.3189 |
| rs7102072 | Imputed | A | DOM | 681 | 0.569 | 0.1579 | 0.4177 | 0.7758 | −3.568 | 0.00036 | 0.397 | 0.25293 | 0.24 | 0.2631 |
| rs710832 | Genotyped | A | REC | 671 | 1.679 | 0.2095 | 0.1992 | 0.2315 | −2.746 | 0.006038 | 0.2666 | 0.36587 | 0.39691 | 0.3421 |
| rs712531 | Imputed | A | DOM | 674 | 0.693 | 0.1168 | 0.5509 | 0.8706 | 3.16 | 0.001579 | 0.2799 | 0.34866 | 0.30201 | 0.3856 |
| rs7129817 | Imputed | T | ADD | 678 | | | | | −3.147 | 0.001649 | 0.4978 | 0.35619 | 0.3796 | 0.3377 |
| rs7134262 | Imputed | T | GEN | 678 | | | | | 19.92 | 4.72E-05 | 0.9333 | 0.35619 | 0.3796 | 0.3377 |
| rs7134262 | Imputed | T | REC | 678 | 2.671 | 0.2439 | 1.656 | 4.308 | 4.027 | 5.66E-05 | 0.9333 | 0.45282 | 0.41003 | 0.4864 |
| rs7138300 | Imputed | C | ADD | 657 | 0.709 | 0.1165 | 0.5639 | 0.8903 | −2.957 | 0.003102 | 0.5823 | 0.45282 | 0.41003 | 0.4864 |
| rs7138300 | Imputed | C | DOM | 657 | 0.595 | 0.1749 | 0.4222 | 0.8382 | −2.969 | 0.002989 | 0.5823 | 0.45282 | 0.41003 | 0.4864 |
| rs722927 | Imputed | G | ADD | 660 | 0.494 | 0.2288 | 0.3152 | 0.773 | −3.085 | 0.002035 | 0.2612 | 0.07652 | 0.04915 | 0.0986 |

TABLE 9-continued

| | | | | | | | | | | | | | |
|---|---|---|---|---|---|---|---|---|---|---|---|---|---|
| rs722927 | Imputed | G | DOM | 660 | 0.474 | 0.2419 | 0.2951 | 0.7616 | −3.086 | 0.002029 | 0.2612 | 0.07652 | 0.04915 | 0.0986 |
| rs726424 | Genotyped | G | ADD | 682 | 0.709 | 0.111 | 0.57 | 0.8809 | −3.102 | 0.001922 | 0.02768 | 0.37757 | 0.32833 | 0.4162 |
| rs726424 | Genotyped | G | GEN | 682 | | | | | 10.03 | 0.006653 | 0.02768 | 0.37757 | 0.32833 | 0.4162 |
| rs7295817 | Imputed | C | ADD | 677 | 0.667 | 0.1118 | 0.5356 | 0.8302 | −3.624 | 0.00029 | 0.0658 | 0.40177 | 0.34343 | 0.4474 |
| rs7295817 | Imputed | C | GEN | 677 | | | | | 13.77 | 0.001022 | 0.0658 | 0.40177 | 0.34343 | 0.4474 |
| rs7295817 | Imputed | C | REC | 677 | 0.482 | 0.218 | 0.3144 | 0.739 | −3.347 | 0.000816 | 0.0658 | 0.40177 | 0.34343 | 0.4474 |
| rs7297372 | Imputed | A | ADD | 682 | 0.69 | 0.1134 | 0.5524 | 0.8617 | −3.272 | 0.001068 | 0.8151 | 0.56891 | 0.52 | 0.6073 |
| rs7297372 | Imputed | A | GEN | 682 | | | | | 10.73 | 0.00468 | 0.8151 | 0.56891 | 0.52 | 0.6073 |
| rs7298255 | Imputed | A | ADD | 682 | 0.725 | 0.1134 | 0.5804 | 0.9053 | −2.837 | 0.004558 | 0.701 | 0.46701 | 0.42667 | 0.4987 |
| rs7298255 | Imputed | C | GEN | 682 | 0.584 | 0.1737 | 0.4156 | 0.8211 | −3.095 | 0.001971 | 0.701 | 0.46701 | 0.42667 | 0.4987 |
| rs7305832 | Imputed | C | GEN | 678 | | | | | 19.92 | 4.72E-05 | 0.9333 | 0.35619 | 0.3796 | 0.3377 |
| rs7305832 | Imputed | C | REC | 678 | 2.671 | 0.2439 | 1.656 | 4.308 | 4.027 | 5.66E-05 | 0.9333 | 0.35619 | 0.3796 | 0.3377 |
| rs737542 | Imputed | A | REC | 678 | 1.983 | 0.312 | 1.076 | 3.655 | 2.194 | 0.02823 | 0.8432 | 0.26327 | 0.28859 | 0.2434 |
| rs742827 | Imputed | A | ADD | 637 | 1.408 | 0.1178 | 1.118 | 1.774 | 2.905 | 0.003678 | 0.2603 | 0.35479 | 0.40108 | 0.3189 |
| rs742827 | Imputed | A | GEN | 637 | | | | | 8.971 | 0.01127 | 0.2603 | 0.35479 | 0.40108 | 0.3189 |
| rs7446891 | Imputed | G | DOM | 681 | 0.561 | 0.1597 | 0.4104 | 0.7675 | −3.617 | 0.000298 | 0.9326 | 0.34728 | 0.30833 | 0.378 |
| rs7448641 | Imputed | C | ADD | 682 | 0.187 | 0.4378 | 0.0793 | 0.441 | −3.83 | 0.000128 | 0.06181 | 0.03739 | 0.015 | 0.055 |
| rs7448641 | Imputed | C | DOM | 682 | 0.19 | 0.451 | 0.0786 | 0.4606 | −3.679 | 0.000234 | 0.06181 | 0.03739 | 0.015 | 0.055 |
| rs7460605 | Imputed | G | DOM | 638 | 1.639 | 0.1689 | 1.177 | 2.283 | 2.927 | 0.003421 | 0.1625 | 0.40282 | 0.43816 | 0.3746 |
| rs7468898 | Imputed | T | ADD | 674 | 1.412 | 0.1152 | 1.127 | 1.77 | 2.995 | 0.002747 | 0.3143 | 0.45846 | 0.50334 | 0.4227 |
| rs7468898 | Imputed | T | GEN | 674 | | | | | 9.55 | 0.008438 | 0.3143 | 0.45846 | 0.50334 | 0.4227 |
| rs7501186 | Imputed | A | DOM | 677 | 1.561 | 0.1787 | 1.099 | 2.215 | 2.49 | 0.01276 | 0.5241 | 0.13959 | 0.16498 | 0.1197 |
| rs755117 | Imputed | A | DOM | 651 | 1.658 | 0.1686 | 1.192 | 2.308 | 2.999 | 0.002709 | 0.3232 | 0.19662 | 0.22664 | 0.1727 |
| rs7557560 | Imputed | T | GEN | 679 | | | | | 8.554 | 0.01389 | 0.9031 | 0.19514 | 0.21906 | 0.1763 |
| rs7557560 | Imputed | T | REC | 679 | 3.783 | 0.4649 | 1.521 | 9.41 | 2.862 | 0.004208 | 0.9031 | 0.19514 | 0.21906 | 0.1763 |
| rs7562462 | Imputed | T | DOM | 673 | 1.896 | 0.1733 | 1.35 | 2.662 | 3.691 | 0.000223 | 0.2091 | 0.43388 | 0.48294 | 0.3961 |
| rs757173 | Genotyped | G | DOM | 682 | 0.544 | 0.1595 | 0.398 | 0.7436 | −3.817 | 0.000135 | 1 | 0.36217 | 0.31 | 0.4031 |
| rs7607447 | Imputed | T | REC | 676 | 1.87 | 0.2836 | 1.073 | 3.26 | 2.208 | 0.02726 | 0.7777 | 0.28624 | 0.29798 | 0.277 |
| rs7639053 | Imputed | A | ADD | 682 | 1.506 | 0.1344 | 1.157 | 1.96 | 3.046 | 0.002322 | 0.9093 | 0.21408 | 0.25167 | 0.1846 |
| rs7648163 | Imputed | C | REC | 654 | 1.993 | 0.25 | 1.221 | 3.252 | 2.758 | 0.005822 | 0.3754 | 0.32875 | 0.34896 | 0.3128 |
| rs7651273 | Imputed | A | GEN | 680 | | | | | 14.12 | 0.00086 | 0.08957 | 0.19779 | 0.24247 | 0.1627 |
| rs7653190 | Imputed | C | ADD | 677 | 1.504 | 0.1347 | 1.155 | 1.958 | 3.029 | 0.002453 | 0.9092 | 0.21492 | 0.25253 | 0.1855 |
| rs7653685 | Genotyped | C | DOM | 682 | 1.705 | 0.2034 | 1.144 | 2.541 | 2.623 | 0.008711 | 0.3705 | 0.09457 | 0.11333 | 0.0798 |
| rs7684899 | Imputed | G | ADD | 682 | 0.713 | 0.1608 | 0.5205 | 0.9774 | −2.102 | 0.03551 | 0.04848 | 0.20894 | 0.18833 | 0.2251 |
| rs7701604 | Imputed | G | ADD | 682 | 0.187 | 0.4378 | 0.0793 | 0.441 | −3.83 | 0.000128 | 0.06181 | 0.03739 | 0.015 | 0.055 |
| rs7701604 | Imputed | G | DOM | 682 | 0.19 | 0.4378 | 0.0786 | 0.4606 | −3.679 | 0.000234 | 0.06181 | 0.03739 | 0.015 | 0.055 |
| rs7703676 | Imputed | G | ADD | 682 | 0.187 | 0.4378 | 0.0793 | 0.441 | −3.83 | 0.000128 | 0.06181 | 0.03739 | 0.015 | 0.055 |
| rs7703676 | Imputed | G | DOM | 682 | 0.19 | 0.451 | 0.0786 | 0.4606 | −3.679 | 0.000234 | 0.06181 | 0.03739 | 0.015 | 0.055 |
| rs7711358 | Imputed | A | REC | 682 | 0.564 | 0.1602 | 0.4123 | 0.7725 | −3.571 | 0.000355 | 1 | 0.34934 | 0.30976 | 0.3803 |
| rs7713251 | Imputed | C | DOM | 677 | 2.098 | 0.2572 | 1.267 | 3.474 | 2.882 | 0.003956 | 0.6634 | 0.33661 | 0.37075 | 0.3093 |
| rs7337608 | Imputed | G | REC | 661 | 1.904 | 0.164 | 1.38 | 2.625 | 3.926 | 8.65E-05 | 0.5601 | 0.36169 | 0.41186 | 0.3228 |
| rs7755903 | Imputed | G | DOM | 676 | | | | | 7.188 | 0.02748 | 0.9377 | 0.42805 | 0.38833 | 0.4593 |
| rs7762993 | Imputed | A | ADD | 677 | 1.726 | 0.1392 | 1.314 | 2.268 | 3.921 | 8.82E-05 | 0.219 | 0.19276 | 0.24074 | 0.1553 |
| rs7762993 | Imputed | A | DOM | 677 | 2.011 | 0.1659 | 1.453 | 2.784 | 4.21 | 2.55E-05 | 0.219 | 0.19276 | 0.24074 | 0.1553 |
| rs7767265 | Imputed | G | DOM | 663 | 2.106 | 0.1643 | 1.526 | 2.905 | 4.533 | 5.81E-06 | 0.07386 | 0.22323 | 0.27875 | 0.1809 |
| rs7769415 | Imputed | C | GEN | 670 | | | | | 4.537 | 0.1035 | 0.9297 | 0.32239 | 0.34694 | 0.3032 |
| rs7771264 | Imputed | T | DOM | 654 | 0.635 | 0.1631 | 0.4613 | 0.8744 | −2.783 | 0.005385 | 1 | 0.23471 | 0.2 | 0.2615 |
| rs7795792 | Imputed | T | REC | 679 | 0.645 | 0.1981 | 0.4374 | 0.9509 | −2.214 | 0.02681 | 0.01503 | 0.42636 | 0.40468 | 0.4434 |
| rs7806481 | Imputed | G | REC | 682 | 0.439 | 0.2056 | 0.2933 | 0.6567 | −4.005 | 6.20E-05 | 0.2503 | 0.47947 | 0.42667 | 0.5209 |
| rs7808536 | Imputed | G | DOM | 678 | 1.455 | 0.1608 | 1.062 | 1.995 | 2.334 | 0.01962 | 0.7257 | 0.20649 | 0.2291 | 0.1887 |
| rs7814819 | Imputed | G | ADD | 395 | 2.408 | 0.2698 | 1.419 | 4.086 | 3.256 | 0.001129 | | 0.08734 | 0.12431 | 0.0561 |
| rs7814819 | Imputed | G | DOM | 395 | 2.577 | 0.2831 | 1.48 | 4.488 | 3.345 | 0.000824 | | 0.08734 | 0.12431 | 0.0561 |
| rs7815952 | Imputed | T | DOM | 682 | 2.585 | 0.2693 | 1.525 | 4.383 | 3.526 | 0.000422 | 0.1493 | 0.05572 | 0.07833 | 0.038 |

TABLE 9-continued

| | | | | | | | | | | | | |
|---|---|---|---|---|---|---|---|---|---|---|---|---|
| rs7834090 | Imputed | T | DOM | 682 | 2.585 | 0.2693 | 1.525 | 4.383 | 3.526 | 0.000422 | 0.1493 | 0.05572 | 0.07833 | 0.038 |
| rs7859250 | Imputed | C | DOM | 679 | 0.52 | 0.2089 | 0.345 | 0.7824 | −3.134 | 0.001722 | 0.6726 | 0.10162 | 0.07239 | 0.1243 |
| rs7863577 | Genotyped | A | ADD | 682 | 0.48 | 0.201 | 0.3239 | 0.7122 | −3.648 | 0.000264 | 0.6823 | 0.10337 | 0.07 | 0.1296 |
| rs7863577 | Genotyped | A | DOM | 682 | 0.479 | 0.2131 | 0.3153 | 0.7268 | −3.458 | 0.000545 | 0.6823 | 0.10337 | 0.07 | 0.1296 |
| rs7902140 | Imputed | C | ADD | 673 | 0.63 | 0.1425 | 0.4765 | 0.8328 | −3.244 | 0.001178 | 0.1401 | 0.19539 | 0.1532 | 0.2287 |
| rs7921834 | Imputed | C | DOM | 682 | 1.786 | 0.1574 | 1.312 | 2.431 | 3.685 | 0.000229 | 1 | 0.29545 | 0.335 | 0.2644 |
| rs7939893 | Imputed | C | ADD | 682 | 0.707 | 0.1129 | 0.5669 | 0.8826 | −3.066 | 0.002167 | 0.005005 | 0.34311 | 0.29833 | 0.3783 |
| rs7939893 | Imputed | C | DOM | 682 | 0.641 | 0.1573 | 0.4706 | 0.8718 | −2.832 | 0.004625 | 0.005005 | 0.34311 | 0.29833 | 0.3783 |
| rs7955901 | Imputed | C | ADD | 675 | 0.723 | 0.1135 | 0.579 | 0.9035 | −2.855 | 0.00431 | 0.8771 | 0.46741 | 0.42617 | 0.5 |
| rs7955901 | Imputed | C | DOM | 675 | 0.582 | 0.1743 | 0.4133 | 0.8183 | −3.11 | 0.001869 | 0.8771 | 0.46741 | 0.42617 | 0.5 |
| rs7956274 | Imputed | T | ADD | 677 | 0.74 | 0.1141 | 0.5915 | 0.9251 | −2.642 | 0.00823 | 0.6995 | 0.4675 | 0.42929 | 0.4974 |
| rs7956274 | Imputed | T | DOM | 677 | 0.598 | 0.1747 | 0.4246 | 0.8421 | −2.944 | 0.003242 | 0.6995 | 0.4675 | 0.42929 | 0.4974 |
| rs7957932 | Imputed | G | ADD | 671 | 0.738 | 0.1147 | 0.5895 | 0.9243 | −2.646 | 0.008151 | 0.6433 | 0.47615 | 0.4375 | 0.5067 |
| rs7957932 | Imputed | G | DOM | 671 | 0.57 | 0.1775 | 0.4021 | 0.8065 | −3.171 | 0.001518 | 0.6433 | 0.47615 | 0.4375 | 0.5067 |
| rs7984294 | Imputed | A | DOM | 678 | 1.497 | 0.19 | 1.032 | 2.173 | 2.125 | 0.03361 | 0.8479 | 0.11283 | 0.13255 | 0.0974 |
| rs7994286 | Imputed | A | ADD | 674 | 0.538 | 0.1883 | 0.3721 | 0.7784 | −3.29 | 0.001 | 0.2388 | 0.10979 | 0.07653 | 0.1355 |
| rs7994286 | Imputed | A | DOM | 674 | 0.5 | 0.2066 | 0.3333 | 0.7491 | −3.358 | 0.000784 | 0.2388 | 0.10979 | 0.07653 | 0.1355 |
| rs8038229 | Genotyped | A | ADD | 682 | 0.809 | 0.1191 | 0.6403 | 1.021 | −1.783 | 0.07457 | 0.2326 | 0.29545 | 0.26833 | 0.3168 |
| rs8038229 | Genotyped | A | DOM | 682 | 0.742 | 0.1556 | 0.547 | 1.007 | −1.918 | 0.055517 | 0.2326 | 0.29545 | 0.26833 | 0.3168 |
| rs8043336 | Imputed | C | GEN | 647 | | | | | 8.706 | 0.01287 | 0.9305 | 0.34312 | 0.30851 | 0.3699 |
| rs8043336 | Imputed | C | REC | 647 | 0.449 | 0.2712 | 0.264 | 0.7645 | −2.95 | 0.003176 | 0.9305 | 0.34312 | 0.30851 | 0.3699 |
| rs8054431 | Imputed | T | DOM | 652 | 1.625 | 0.1667 | 1.172 | 2.253 | 2.915 | 0.003561 | 0.5067 | 0.38037 | 0.41434 | 0.3538 |
| rs8066502 | Imputed | T | DOM | 681 | 0.683 | 0.1787 | 0.4814 | 0.9701 | −2.13 | 0.03319 | 1 | 0.14317 | 0.12667 | 0.1562 |
| rs8068714 | Imputed | T | DOM | 682 | 0.671 | 0.1793 | 0.4725 | 0.954 | −2.223 | 0.02623 | 0.8763 | 0.14223 | 0.125 | 0.1558 |
| rs892575 | Imputed | T | ADD | 681 | 1.549 | 0.1262 | 1.21 | 1.984 | 3.471 | 0.000519 | 0.7644 | 0.25844 | 0.305 | 0.2218 |
| rs892583 | Imputed | C | ADD | 679 | 1.541 | 0.1267 | 1.202 | 1.976 | 3.414 | 0.00064 | 0.9202 | 0.25847 | 0.30435 | 0.2224 |
| rs915494 | Imputed | A | ADD | 647 | 1.548 | 0.1295 | 1.201 | 1.995 | 3.374 | 0.00074 | 0.6962 | 0.27975 | 0.32517 | 0.2438 |
| rs915494 | Imputed | A | DOM | 647 | 1.881 | 0.1622 | 1.369 | 2.585 | 3.896 | 9.77E−05 | 0.6962 | 0.29545 | 0.32517 | 0.2438 |
| rs917295 | Imputed | G | DOM | 681 | 0.561 | 0.1597 | 0.4104 | 0.7675 | −3.617 | 0.000298 | 0.9326 | 0.34728 | 0.30833 | 0.378 |
| rs922594 | Imputed | T | DOM | 681 | 0.735 | 0.1583 | 0.5392 | 1.003 | −1.941 | 0.05228 | 0.1829 | 0.35756 | 0.34281 | 0.3691 |
| rs9301653 | Imputed | T | ADD | 682 | 0.518 | 0.1922 | 0.3551 | 0.7544 | −3.426 | 0.000612 | 0.3055 | 0.10484 | 0.07167 | 0.1309 |
| rs9301653 | Imputed | T | DOM | 682 | 0.474 | 0.2097 | 0.3145 | 0.7155 | −3.556 | 0.000376 | 0.3055 | 0.10484 | 0.07167 | 0.1309 |
| rs9309988 | Imputed | G | ADD | 682 | 1.705 | 0.2034 | 1.144 | 2.541 | 2.623 | 0.008711 | 0.3705 | 0.09457 | 0.11333 | 0.0798 |
| rs9309989 | Genotyped | C | ADD | 682 | 1.731 | 0.2018 | 1.165 | 2.57 | 2.718 | 0.006576 | 0.1323 | 0.09824 | 0.11667 | 0.0838 |
| rs9310221 | Imputed | A | ADD | 631 | 2.083 | 0.1765 | 1.474 | 2.943 | 4.157 | 3.23E−05 | 0.6253 | 0.42155 | 0.46277 | 0.3883 |
| rs9327555 | Imputed | T | DOM | 682 | 0.56 | 0.1597 | 0.4098 | 0.7664 | −3.626 | 0.000288 | 0.866 | 0.34751 | 0.30833 | 0.3783 |
| rs937890 | Imputed | G | DOM | 638 | 0.654 | 0.1848 | 0.455 | 0.939 | −2.3 | 0.02143 | 0.8728 | 0.14498 | 0.12633 | 0.1597 |
| rs9454967 | Imputed | G | ADD | 678 | 2.104 | 0.213 | 1.386 | 3.194 | 3.492 | 0.000479 | 0.6166 | 0.08481 | 0.11371 | 0.062 |
| rs9454967 | Imputed | G | DOM | 678 | 2.304 | 0.2264 | 1.478 | 3.592 | 3.687 | 0.000227 | 0.6166 | 0.08481 | 0.11371 | 0.062 |
| rs9471295 | Imputed | T | DOM | 682 | 1.569 | 0.1754 | 1.112 | 2.213 | 2.567 | 0.01026 | 0.1579 | 0.14223 | 0.16667 | 0.123 |
| rs9477007 | Imputed | A | ADD | 651 | 1.476 | 0.1133 | 1.182 | 1.842 | 3.433 | 0.000596 | 0.225 | 0.41014 | 0.46503 | 0.3671 |
| rs9477007 | Imputed | A | GEN | 651 | | | | | 11.79 | 0.002754 | 0.225 | 0.41014 | 0.46503 | 0.3671 |
| rs9487279 | Imputed | T | DOM | 653 | 0.61 | 0.165 | 0.4417 | 0.8435 | −2.991 | 0.002778 | 0.5145 | 0.3974 | 0.35986 | 0.4272 |
| rs949016 | Imputed | C | ADD | 682 | 1.55 | 0.1262 | 1.21 | 1.985 | 3.473 | 0.000515 | 0.7642 | 0.25806 | 0.305 | 0.2212 |
| rs9555973 | Imputed | G | ADD | 681 | 0.538 | 0.1869 | 0.3726 | 0.7754 | −3.321 | 0.000898 | 0.3277 | 0.11087 | 0.07833 | 0.1365 |
| rs9555973 | Imputed | G | DOM | 681 | 0.501 | 0.2048 | 0.3354 | 0.7487 | −3.373 | 0.000743 | 0.3277 | 0.11087 | 0.07833 | 0.1365 |
| rs9557510 | Imputed | G | ADD | 680 | 1.629 | 0.1608 | 1.188 | 2.232 | 3.033 | 0.002418 | 0.7519 | 0.14044 | 0.17224 | 0.1155 |
| rs9557510 | Imputed | G | DOM | 680 | 1.768 | 0.1765 | 1.251 | 2.498 | 3.227 | 0.001253 | 0.7519 | 0.14044 | 0.17224 | 0.1155 |
| rs9560584 | Imputed | T | DOM | 660 | 0.489 | 0.211 | 0.3233 | 0.7393 | −3.392 | 0.000695 | 0.3013 | 0.10606 | 0.07388 | 0.1314 |
| rs9588770 | Imputed | T | DOM | 680 | 0.529 | 0.2039 | 0.3549 | 0.7895 | −3.119 | 0.001815 | 0.3247 | 0.11029 | 0.08 | 0.1342 |
| rs9588848 | Imputed | C | ADD | 682 | 0.518 | 0.1922 | 0.3551 | 0.7544 | −3.426 | 0.000612 | 0.3055 | 0.10484 | 0.07167 | 0.1309 |
| rs9588848 | Imputed | C | DOM | 682 | 0.474 | 0.2097 | 0.3145 | 0.7155 | −3.556 | 0.000376 | 0.3055 | 0.10484 | 0.07167 | 0.1309 |
| rs966583 | Imputed | A | ADD | 679 | 0.729 | 0.1149 | 0.5819 | 0.913 | −2.752 | 0.005926 | 0.9364 | 0.40133 | 0.36409 | 0.4304 |

TABLE 9-continued

| SNP rs # | SOURCE | ALLELE (A1) | MODEL | NMISS | | | | PRAVA_A1_HZ_COUNT | PRAVA_HET_COUNT | PRAVA_A2_HZ_COUNT | | PLACEBO_A1_HZ_COUNT | PLACEBO_HET_COUNT | PLACEBO_A2_HZ_COUNT |
|---|---|---|---|---|---|---|---|---|---|---|---|---|---|---|
| rs966583 | Imputed | A | DOM | | | 0.578 | 0.1648 | 0.4182 | 0.7977 | | | 0.40133 | 0.36409 | 0.4304 |
| rs974130 | Genotyped | A | REC | 679 | | 1.891 | 0.2296 | 1.206 | 2.965 | | | 0.3563 | 0.36833 | 0.3469 |
| rs977160 | Imputed | T | ADD | 682 | | 1.657 | 0.1289 | 1.287 | 2.775 | | | 0.25037 | 0.30333 | 0.2087 |
| rs9812206 | Imputed | G | ADD | 681 | | 0.481 | 0.2047 | 0.3217 | 3.916 | 8.99E-05 | | 0.09677 | 0.06333 | 0.123 |
| rs9812206 | Imputed | G | DOM | 682 | | 0.466 | 0.215 | 0.306 | −3.581 | 0.000343 | 0.8253 | 0.09677 | 0.06333 | 0.123 |
| rs9813552 | Imputed | G | ADD | 673 | | 0.487 | 0.2063 | 0.325 | −3.548 | 0.000388 | 0.8253 | 0.09658 | 0.06376 | 0.1227 |
| rs9813552 | Imputed | G | DOM | 673 | | 0.472 | 0.2155 | 0.3093 | −3.487 | 0.000489 | 1 | 0.09658 | 0.06333 | 0.1227 |
| rs9815037 | Imputed | T | ADD | 682 | | 0.482 | 0.206 | 0.3221 | −3.486 | 0.000491 | 1 | 0.09604 | 0.06333 | 0.1217 |
| rs9815037 | Imputed | T | DOM | 682 | | 0.467 | 0.215 | 0.3063 | −3.539 | 0.000395 | 1 | 0.09604 | 0.06333 | 0.1217 |
| rs9825349 | Imputed | A | ADD | 682 | | 0.482 | 0.206 | 0.3221 | −3.543 | 0.000402 | 1 | 0.09604 | 0.06333 | 0.1217 |
| rs9825349 | Imputed | A | DOM | 682 | | 0.467 | 0.215 | 0.3063 | −3.539 | 0.000395 | 1 | 0.09604 | 0.06333 | 0.1217 |
| rs9834217 | Imputed | T | ADD | 681 | | 0.483 | 0.206 | 0.3226 | −3.543 | 0.000413 | 1 | 0.09618 | 0.06355 | 0.1217 |
| rs9834217 | Imputed | T | DOM | 681 | | 0.468 | 0.215 | 0.3069 | −3.532 | 0.000407 | 1 | 0.09618 | 0.06355 | 0.1217 |
| rs9840460 | Imputed | T | ADD | 682 | | 0.482 | 0.206 | 0.3221 | −3.539 | 0.000402 | 1 | 0.09604 | 0.06333 | 0.1217 |
| rs9840460 | Imputed | T | DOM | 682 | | 0.467 | 0.215 | 0.3063 | −3.543 | 0.000395 | 1 | 0.09604 | 0.06333 | 0.1217 |
| rs9840756 | Imputed | A | ADD | 682 | | 0.482 | 0.206 | 0.3221 | −3.539 | 0.000402 | 1 | 0.09604 | 0.06333 | 0.1217 |
| rs9840756 | Imputed | A | DOM | 682 | | 0.467 | 0.215 | 0.3063 | −3.543 | 0.000395 | 1 | 0.09604 | 0.06333 | 0.1217 |
| rs9844801 | Imputed | C | DOM | 682 | | 1.705 | 0.2034 | 1.144 | 2.623 | 0.008711 | 0.3705 | 0.09457 | 0.11333 | 0.0798 |
| rs985375 | Imputed | A | GEN | 655 | | | | | 11.2 | 0.003703 | 0.4705 | 0.2542 | 0.2972 | 0.2209 |
| rs9869187 | Imputed | C | ADD | 681 | | 0.488 | 0.2129 | 0.3218 | −3.366 | 0.000764 | 0.8111 | 0.08884 | 0.05853 | 0.1126 |
| rs9869187 | Imputed | C | DOM | 681 | | 0.497 | 0.2215 | 0.3219 | −3.157 | 0.001595 | 0.8111 | 0.08884 | 0.05853 | 0.1126 |
| rs9872327 | Imputed | C | DOM | 682 | | 1.705 | 0.2034 | 1.144 | 2.623 | 0.008711 | 0.3705 | 0.09457 | 0.11333 | 0.0798 |
| rs9881685 | Imputed | A | ADD | 682 | | 0.481 | 0.2047 | 0.3217 | −3.581 | 0.000343 | 0.8253 | 0.09677 | 0.06333 | 0.123 |
| rs9881685 | Imputed | A | DOM | 682 | | 0.466 | 0.215 | 0.306 | −3.548 | 0.000388 | 0.8253 | 0.09677 | 0.06333 | 0.123 |
| rs9909499 | Imputed | C | DOM | 668 | | 1.42 | 0.1577 | 1.042 | 2.223 | 0.02622 | 0.8536 | 0.2979 | 0.3266 | 0.2749 |
| rs9911847 | Imputed | C | DOM | 680 | | 0.668 | 0.1793 | 0.4702 | −2.249 | 0.02452 | 0.7545 | 0.14338 | 0.12667 | 0.1566 |
| rs9946886 | Imputed | G | REC | 232 | | 0.3 | 0.3567 | 0.1492 | −3.374 | 0.000742 | 0.08656 | 0.44828 | 0.39908 | 0.4919 |
| rs9958823 | Imputed | A | ADD | 679 | | 1.579 | 0.1261 | 1.233 | 3.624 | 0.00029 | 0.6914 | 0.26068 | 0.2224 | 0.2224 |
| rs9965248 | Imputed | T | ADD | 671 | | 1.556 | 0.127 | 1.213 | 3.481 | 0.0005 | 0.7646 | 0.2608 | 0.30847 | 0.2234 |
| rs198460 | Imputed | G | DOM | 682 | | | | | −3.332 | 0.000863 | 0.9364 | | | 101 |
| rs603940 | Genotyped | G | REC | 682 | | | | | 2.775 | 0.005522 | 0.4535 | 66 | 215 | 135 |
| rs10021016 | Imputed | G | GEN | 682 | | | | | 3.916 | 8.99E-05 | 0.919 | 72 | 175 | 217 |
| rs1003148 | Imputed | C | ADD | 674 | | | | | −3.581 | 0.000343 | 0.8253 | 17 | 148 | 126 |
| rs1003148 | Imputed | C | GEN | 674 | | | | | −3.548 | 0.000388 | 0.8253 | 83 | 166 | 126 |
| rs1003148 | Imputed | C | REC | 673 | | | | | −3.487 | 0.000489 | 1 | 83 | 166 | 126 |
| rs10046799 | Imputed | C | ADD | 671 | | | | | −3.486 | 0.000491 | 1 | 83 | 166 | 73 |
| rs10046799 | Imputed | T | GEN | 682 | | | | | −3.539 | 0.000395 | 1 | 133 | 173 | 73 |
| rs10051148 | Imputed | A | DOM | 681 | | | | | −3.543 | 0.000402 | 1 | 133 | 198 | 138 |
| rs10054055 | Imputed | A | DOM | 681 | | | | | −3.539 | 0.000395 | 1 | 45 | 198 | 138 |
| rs10067895 | Imputed | T | DOM | 672 | | | | | −3.543 | 0.000395 | 1 | 45 | 193 | 137 |
| rs1008705 | Imputed | A | DOM | 505 | | | | | −3.532 | 0.000413 | 1 | 20 | 111 | 156 |
| rs10105871 | Imputed | C | DOM | 592 | | | | | −3.581 | 0.000343 | 0.8253 | 52 | 132 | 149 |
| rs10116807 | Imputed | A | GEN | 652 | | | | | 2.223 | 0.02622 | 0.8536 | 10 | 129 | 226 |
| rs10116807 | Imputed | A | REC | 652 | | | | | −2.249 | 0.02452 | 0.7545 | 10 | 129 | 226 |
| rs10121941 | Imputed | C | DOM | 682 | | | | | −3.548 | 0.000343 | 0.8253 | 2 | 83 | 293 |
| rs10128638 | Genotyped | G | DOM | 682 | | | | | 2.223 | 0.02622 | 0.8536 | 66 | 204 | 81 |
| rs1012924 | Imputed | G | ADD | 682 | | | | | −2.249 | 0.02452 | 0.7545 | 97 | 86 | 289 |
| rs1012924 | Imputed | G | DOM | 682 | | | | | −3.374 | 0.000742 | 0.08656 | 7 | 86 | 289 |
| rs1016030 | Genotyped | G | ADD | 680 | | | | | 3.481 | 0.0005 | 0.7646 | 51 | 177 | 153 |

TABLE 9-continued

| rs ID | Genotyped/Imputed | Allele | Model | | | | | | |
|---|---|---|---|---|---|---|---|---|---|
| rs1016030 | Genotyped | G | GEN | 680 | 61 | 144 | 94 | 51 | 177 | 153 |
| rs1017558 | Imputed | A | REC | 668 | 52 | 112 | 130 | 39 | 185 | 150 |
| rs10183431 | Imputed | T | DOM | 677 | 14 | 135 | 147 | 17 | 133 | 231 |
| rs10195401 | Imputed | C | DOM | 671 | 45 | 157 | 94 | 52 | 162 | 161 |
| rs10239416 | Imputed | A | DOM | 658 | 34 | 124 | 136 | 53 | 185 | 126 |
| rs1032188 | Imputed | G | GEN | 682 | 20 | 123 | 157 | 43 | 165 | 174 |
| rs1032188 | Imputed | G | REC | 682 | 20 | 123 | 157 | 43 | 165 | 174 |
| rs10468988 | Imputed | G | ADD | 679 | 30 | 125 | 144 | 18 | 133 | 229 |
| rs10478919 | Imputed | G | DOM | 681 | 36 | 112 | 152 | 46 | 198 | 137 |
| rs10506623 | Imputed | C | DOM | 682 | 46 | 128 | 126 | 65 | 198 | 119 |
| rs10506626 | Imputed | A | DOM | 682 | 49 | 122 | 129 | 61 | 204 | 117 |
| rs10509477 | Imputed | T | DOM | 682 | 26 | 149 | 125 | 34 | 136 | 212 |
| rs10511071 | Imputed | C | DOM | 682 | 2 | 64 | 234 | 6 | 49 | 327 |
| rs10511072 | Imputed | G | DOM | 682 | 2 | 64 | 234 | 6 | 49 | 327 |
| rs10511199 | Imputed | C | ADD | 679 | 21 | 111 | 166 | 11 | 123 | 247 |
| rs10513283 | Imputed | G | GEN | 680 | 26 | 92 | 181 | 8 | 108 | 265 |
| rs10520072 | Imputed | T | DOM | 681 | 36 | 113 | 151 | 45 | 198 | 138 |
| rs1065639 | Imputed | C | DOM | 645 | 35 | 156 | 91 | 48 | 157 | 158 |
| rs10733846 | Imputed | G | ADD | 676 | 5 | 73 | 221 | 29 | 116 | 232 |
| rs10733846 | Imputed | G | DOM | 676 | 5 | 73 | 221 | 29 | 116 | 232 |
| rs10737390 | Imputed | T | DOM | 678 | 42 | 119 | 139 | 62 | 192 | 124 |
| rs10749293 | Imputed | G | DOM | 682 | 25 | 149 | 126 | 33 | 134 | 215 |
| rs10752159 | Imputed | G | DOM | 676 | 16 | 113 | 169 | 15 | 117 | 246 |
| rs10753760 | Imputed | T | ADD | 650 | 61 | 141 | 81 | 49 | 181 | 137 |
| rs10753760 | Imputed | T | GEN | 650 | 61 | 141 | 81 | 49 | 181 | 137 |
| rs10757887 | Imputed | C | DOM | 677 | 18 | 92 | 188 | 21 | 161 | 197 |
| rs10758326 | Imputed | A | ADD | 679 | 32 | 138 | 128 | 68 | 177 | 136 |
| rs10758326 | Imputed | A | GEN | 679 | 32 | 138 | 128 | 68 | 177 | 136 |
| rs10758326 | Imputed | A | REC | 679 | 32 | 138 | 128 | 68 | 177 | 136 |
| rs10762236 | Genotyped | G | ADD | 682 | 7 | 76 | 217 | 30 | 122 | 230 |
| rs10765769 | Imputed | C | ADD | 676 | 66 | 150 | 81 | 59 | 174 | 146 |
| rs10765769 | Imputed | C | GEN | 676 | 66 | 150 | 81 | 59 | 174 | 146 |
| rs10784891 | Imputed | C | ADD | 656 | 49 | 138 | 101 | 83 | 195 | 90 |
| rs10784891 | Imputed | C | DOM | 656 | 49 | 138 | 101 | 83 | 195 | 90 |
| rs10787923 | Imputed | G | DOM | 672 | 25 | 149 | 123 | 33 | 131 | 211 |
| rs10787949 | Imputed | G | DOM | 682 | 27 | 150 | 123 | 35 | 137 | 210 |
| rs10787951 | Imputed | A | DOM | 682 | 27 | 150 | 123 | 35 | 137 | 210 |
| rs10787983 | Imputed | C | DOM | 682 | 26 | 149 | 125 | 33 | 136 | 213 |
| rs10788380 | Imputed | C | ADD | 675 | 78 | 162 | 56 | 78 | 192 | 109 |
| rs10788380 | Imputed | C | DOM | 675 | 78 | 162 | 56 | 78 | 192 | 109 |
| rs10788380 | Imputed | C | GEN | 675 | 78 | 162 | 56 | 78 | 192 | 109 |
| rs10814418 | Imputed | C | DOM | 680 | 2 | 40 | 256 | 6 | 83 | 293 |
| rs10831417 | Imputed | A | ADD | 674 | 61 | 143 | 94 | 47 | 176 | 153 |
| rs10831417 | Imputed | A | GEN | 674 | 61 | 143 | 94 | 47 | 176 | 153 |
| rs10831422 | Imputed | A | DOM | 676 | 61 | 143 | 93 | 47 | 178 | 152 |
| rs10831422 | Imputed | C | ADD | 676 | 61 | 144 | 93 | 48 | 178 | 152 |
| rs10862931 | Imputed | C | GEN | 676 | 21 | 129 | 146 | 60 | 159 | 161 |
| rs10865197 | Imputed | C | DOM | 679 | 14 | 136 | 147 | 17 | 134 | 231 |
| rs10871302 | Imputed | A | DOM | 677 | 8 | 82 | 207 | 7 | 77 | 296 |
| rs10877463 | Imputed | C | DOM | 681 | 45 | 115 | 139 | 50 | 182 | 150 |
| rs10877468 | Imputed | C | ADD | 681 | 45 | 116 | 138 | 49 | 183 | 150 |
| rs10879240 | Imputed | C | DOM | 561 | 6 | 143 | 104 | 21 | 191 | 96 |
| rs10879242 | Imputed | A | DOM | 600 | 52 | 113 | 99 | 70 | 184 | 82 |

TABLE 9-continued

| rsID | Status | Allele | Model | | | | | | |
|---|---|---|---|---|---|---|---|---|---|
| rs10879245 | Imputed | G | DOM | 600 | 52 | 113 | 99 | 70 | 184 | 82 |
| rs10879249 | Imputed | T | DOM | 676 | 46 | 127 | 125 | 65 | 197 | 116 |
| rs10886452 | Imputed | A | DOM | 682 | 27 | 150 | 123 | 35 | 137 | 210 |
| rs10886463 | Imputed | C | DOM | 682 | 27 | 150 | 123 | 35 | 137 | 210 |
| rs10886465 | Imputed | A | DOM | 681 | 25 | 150 | 125 | 36 | 137 | 209 |
| rs10886526 | Imputed | C | DOM | 658 | 61 | 149 | 125 | 34 | 136 | 212 |
| rs10902437 | Imputed | G | ADD | 682 | 0 | 135 | 97 | 51 | 151 | 163 |
| rs10941126 | Imputed | G | DOM | 682 | 0 | 9 | 291 | 3 | 36 | 343 |
| rs10941126 | Imputed | G | ADD | 682 | 5 | 9 | 291 | 3 | 36 | 343 |
| rs10947871 | Imputed | A | DOM | 658 | 2 | 90 | 205 | 4 | 86 | 292 |
| rs10972978 | Imputed | G | DOM | 682 | 2 | 38 | 248 | 6 | 81 | 283 |
| rs10973012 | Imputed | A | DOM | 682 | 9 | 40 | 258 | 6 | 83 | 293 |
| rs10974028 | Genotyped | G | ADD | 682 | 9 | 57 | 234 | 13 | 122 | 247 |
| rs10974028 | Genotyped | G | DOM | 682 | 9 | 57 | 234 | 13 | 122 | 247 |
| rs11021302 | Imputed | A | ADD | 681 | 61 | 144 | 95 | 48 | 180 | 153 |
| rs11021302 | Imputed | A | DOM | 681 | 61 | 144 | 95 | 48 | 180 | 153 |
| rs11099644 | Imputed | G | GEN | 668 | 52 | 112 | 130 | 39 | 185 | 150 |
| rs11138315 | Imputed | G | REC | 646 | 3 | 46 | 236 | 8 | 75 | 278 |
| rs11149802 | Imputed | T | ADD | 677 | 8 | 82 | 207 | 7 | 77 | 296 |
| rs11116596 | Imputed | T | DOM | 681 | 36 | 112 | 152 | 46 | 198 | 137 |
| rs11178531 | Imputed | A | ADD | 678 | 60 | 140 | 98 | 92 | 204 | 84 |
| rs11178531 | Imputed | A | DOM | 678 | 60 | 140 | 98 | 92 | 204 | 84 |
| rs11178575 | Imputed | C | GEN | 679 | 44 | 121 | 133 | 28 | 168 | 185 |
| rs11178575 | Imputed | C | REC | 679 | 44 | 121 | 133 | 28 | 168 | 185 |
| rs11178577 | Imputed | T | GEN | 680 | 44 | 121 | 133 | 28 | 169 | 185 |
| rs11178577 | Imputed | T | REC | 680 | 44 | 121 | 133 | 28 | 169 | 185 |
| rs11178583 | Imputed | A | ADD | 665 | 46 | 124 | 121 | 65 | 197 | 112 |
| rs11178589 | Imputed | T | DOM | 678 | 48 | 131 | 120 | 69 | 199 | 111 |
| rs11178594 | Imputed | C | DOM | 680 | 46 | 127 | 125 | 65 | 199 | 118 |
| rs11178602 | Imputed | T | DOM | 680 | 46 | 126 | 126 | 65 | 199 | 118 |
| rs11178648 | Imputed | T | DOM | 680 | 49 | 121 | 129 | 62 | 202 | 117 |
| rs11198877 | Imputed | T | DOM | 682 | 27 | 150 | 123 | 35 | 137 | 210 |
| rs11198942 | Imputed | T | DOM | 680 | 26 | 149 | 124 | 34 | 135 | 212 |
| rs11221075 | Imputed | A | ADD | 674 | 1 | 57 | 238 | 12 | 88 | 278 |
| rs11242020 | Imputed | T | DOM | 682 | 36 | 112 | 152 | 46 | 199 | 137 |
| rs11242021 | Imputed | T | DOM | 682 | 36 | 113 | 151 | 46 | 198 | 138 |
| rs11242022 | Imputed | T | DOM | 682 | 36 | 112 | 151 | 46 | 198 | 138 |
| rs11242023 | Imputed | T | DOM | 682 | 36 | 121 | 152 | 45 | 197 | 140 |
| rs1149350 | Imputed | A | ADD | 682 | 11 | 121 | 167 | 12 | 119 | 250 |
| rs1150143 | Imputed | G | GEN | 658 | 23 | 157 | 107 | 40 | 149 | 182 |
| rs11576627 | Imputed | T | DOM | 682 | 3 | 89 | 208 | 2 | 71 | 309 |
| rs11576627 | Imputed | T | DOM | 682 | 3 | 89 | 208 | 2 | 71 | 309 |
| rs11602189 | Imputed | A | ADD | 677 | 29 | 112 | 156 | 48 | 180 | 152 |
| rs11605163 | Imputed | A | DOM | 679 | 2 | 53 | 244 | 2 | 36 | 342 |
| rs11615214 | Imputed | A | ADD | 660 | 31 | 122 | 139 | 76 | 161 | 131 |
| rs11615214 | Imputed | A | DOM | 660 | 31 | 122 | 139 | 76 | 161 | 131 |
| rs11642394 | Imputed | G | GEN | 677 | 8 | 82 | 207 | 7 | 77 | 296 |
| rs1644943 | Imputed | C | DOM | 655 | 21 | 103 | 168 | 9 | 128 | 226 |
| rs11656608 | Imputed | A | DOM | 682 | 8 | 58 | 233 | 6 | 109 | 267 |
| rs11661309 | Imputed | T | ADD | 681 | 7 | 76 | 214 | 20 | 130 | 229 |
| rs11661309 | Imputed | A | DOM | 676 | 7 | 76 | 214 | 20 | 130 | 229 |
| rs11666131 | Imputed | A | ADD | 675 | 20 | 114 | 161 | 10 | 129 | 241 |
| rs11743355 | Imputed | C | ADD | 650 | 0 | 8 | 279 | 3 | 34 | 326 |

TABLE 9-continued

| | | | | | | | | |
|---|---|---|---|---|---|---|---|---|
| rs11743355 | Imputed | C | DOM | 650 | 0 | 8 | 279 | 3 | 34 | 326 |
| rs11746806 | Imputed | T | ADD | 682 | 0 | 10 | 290 | 3 | 36 | 343 |
| rs11746806 | Imputed | T | DOM | 682 | 0 | 10 | 290 | 3 | 36 | 343 |
| rs11746959 | Imputed | T | ADD | 682 | 0 | 9 | 291 | 3 | 36 | 343 |
| rs11746959 | Imputed | T | DOM | 682 | 0 | 9 | 291 | 3 | 36 | 343 |
| rs11749272 | Imputed | T | DOM | 679 | 36 | 111 | 151 | 46 | 198 | 137 |
| rs11901899 | Imputed | A | DOM | 668 | 22 | 129 | 145 | 24 | 132 | 216 |
| rs11926319 | Imputed | G | ADD | 675 | 1 | 36 | 260 | 6 | 82 | 290 |
| rs11926319 | Imputed | G | DOM | 675 | 1 | 36 | 260 | 6 | 82 | 290 |
| rs11956952 | Imputed | C | DOM | 671 | 21 | 104 | 171 | 35 | 166 | 174 |
| rs12025826 | Imputed | G | DOM | 664 | 61 | 139 | 88 | 59 | 156 | 161 |
| rs1204522 | Imputed | G | DOM | 676 | 27 | 143 | 128 | 68 | 178 | 132 |
| rs1204524 | Imputed | C | GEN | 678 | 27 | 143 | 128 | 68 | 180 | 132 |
| rs12153185 | Imputed | A | GEN | 672 | 36 | 110 | 151 | 45 | 193 | 137 |
| rs12182651 | Imputed | T | ADD | 678 | 3 | 62 | 234 | 3 | 41 | 335 |
| rs12182651 | Imputed | T | DOM | 678 | 3 | 62 | 234 | 3 | 41 | 335 |
| rs12193568 | Imputed | G | DOM | 565 | 8 | 89 | 156 | 6 | 84 | 222 |
| rs12264914 | Imputed | C | DOM | 361 | 17 | 59 | 84 | 33 | 89 | 79 |
| rs12307767 | Imputed | C | DOM | 661 | 44 | 114 | 134 | 49 | 178 | 142 |
| rs1232298 | Imputed | G | REC | 658 | 33 | 119 | 136 | 27 | 180 | 163 |
| rs12407412 | Imputed | C | ADD | 682 | 3 | 89 | 208 | 2 | 71 | 309 |
| rs12407412 | Imputed | C | DOM | 682 | 3 | 89 | 208 | 2 | 71 | 309 |
| rs12420184 | Imputed | G | ADD | 681 | 9 | 57 | 234 | 10 | 118 | 253 |
| rs12422750 | Imputed | A | DOM | 679 | 45 | 116 | 137 | 51 | 180 | 150 |
| rs12446951 | Imputed | A | ADD | 520 | 1 | 41 | 187 | 0 | 29 | 262 |
| rs12446951 | Imputed | A | DOM | 520 | 1 | 41 | 187 | 0 | 29 | 262 |
| rs12457400 | Imputed | G | DOM | 680 | 4 | 42 | 253 | 5 | 88 | 288 |
| rs1247340 | Imputed | C | DOM | 680 | 11 | 121 | 167 | 12 | 119 | 250 |
| rs1247341 | Imputed | C | DOM | 680 | 11 | 121 | 167 | 12 | 119 | 250 |
| rs12521291 | Imputed | G | ADD | 673 | 28 | 123 | 147 | 56 | 172 | 147 |
| rs12526849 | Imputed | T | ADD | 656 | 63 | 137 | 87 | 52 | 164 | 153 |
| rs12526849 | Imputed | T | GEN | 656 | 63 | 137 | 87 | 52 | 164 | 153 |
| rs12543110 | Imputed | T | DOM | 681 | 17 | 119 | 163 | 27 | 108 | 247 |
| rs12678600 | Imputed | A | DOM | 675 | 27 | 118 | 153 | 44 | 184 | 149 |
| rs12719415 | Imputed | T | DOM | 673 | 31 | 111 | 151 | 43 | 199 | 138 |
| rs12831292 | Imputed | G | DOM | 678 | 46 | 126 | 125 | 65 | 199 | 117 |
| rs12923993 | Imputed | C | DOM | 677 | 8 | 82 | 207 | 7 | 77 | 296 |
| rs12936964 | Imputed | T | DOM | 673 | 45 | 149 | 102 | 45 | 155 | 177 |
| rs12960663 | Imputed | G | ADD | 672 | 7 | 76 | 213 | 20 | 127 | 229 |
| rs13038146 | Imputed | G | ADD | 681 | 54 | 130 | 116 | 40 | 170 | 171 |
| rs13038146 | Imputed | G | ADD | 681 | 54 | 130 | 116 | 40 | 170 | 171 |
| rs13134222 | Imputed | A | GEN | 597 | 10 | 105 | 152 | 32 | 132 | 166 |
| rs13172910 | Imputed | A | GEN | 675 | 22 | 105 | 171 | 35 | 168 | 174 |
| rs13194907 | Imputed | A | DOM | 682 | 3 | 49 | 248 | 2 | 31 | 349 |
| rs13195745 | Imputed | A | ADD | 682 | 3 | 49 | 248 | 2 | 31 | 349 |
| rs13195745 | Imputed | A | DOM | 682 | 3 | 49 | 248 | 2 | 31 | 349 |
| rs1321432 | Imputed | A | REC | 681 | 60 | 145 | 94 | 39 | 186 | 157 |
| rs1321457 | Imputed | G | REC | 665 | 59 | 140 | 93 | 39 | 181 | 153 |
| rs13265054 | Imputed | T | DOM | 671 | 27 | 116 | 153 | 42 | 182 | 151 |
| rs13282131 | Imputed | C | GEN | 675 | 72 | 142 | 80 | 65 | 190 | 126 |
| rs13355526 | Imputed | C | DOM | 674 | 2 | 64 | 230 | 6 | 48 | 324 |
| rs1336382 | Imputed | T | DOM | 682 | 26 | 149 | 125 | 34 | 136 | 212 |

TABLE 9-continued

| | | | | | | | | | |
|---|---|---|---|---|---|---|---|---|---|
| rs1336383 | Imputed | T | DOM | 682 | 26 | 149 | 125 | 34 | 136 | 212 |
| rs1336407 | Imputed | T | DOM | 682 | 26 | 149 | 125 | 34 | 136 | 212 |
| rs1336409 | Imputed | T | DOM | 682 | 26 | 149 | 125 | 34 | 136 | 212 |
| rs1336596 | Imputed | A | DOM | 682 | 37 | 114 | 149 | 46 | 194 | 142 |
| rs1343560 | Imputed | T | ADD | 678 | 3 | 37 | 257 | 7 | 86 | 288 |
| rs1343560 | Imputed | T | DOM | 678 | 3 | 37 | 257 | 7 | 86 | 288 |
| rs1361987 | Imputed | T | GEN | 682 | 28 | 145 | 127 | 72 | 180 | 130 |
| rs1386153 | Imputed | T | ADD | 677 | 27 | 115 | 157 | 47 | 180 | 151 |
| rs1386153 | Imputed | T | DOM | 677 | 27 | 115 | 157 | 47 | 180 | 151 |
| rs1394015 | Imputed | C | DOM | 669 | 35 | 160 | 97 | 49 | 160 | 168 |
| rs1407038 | Imputed | A | REC | 678 | 59 | 141 | 96 | 39 | 184 | 159 |
| rs1407039 | Imputed | A | REC | 680 | 61 | 144 | 93 | 42 | 186 | 154 |
| rs1412802 | Imputed | T | GEN | 681 | 17 | 128 | 155 | 43 | 163 | 175 |
| rs1414865 | Imputed | T | DOM | 682 | 27 | 150 | 123 | 35 | 137 | 210 |
| rs1414873 | Imputed | A | DOM | 682 | 26 | 149 | 125 | 33 | 136 | 213 |
| rs1414876 | Imputed | C | DOM | 682 | 26 | 149 | 125 | 33 | 136 | 213 |
| rs1418671 | Imputed | C | REC | 655 | 57 | 125 | 106 | 36 | 165 | 166 |
| rs1419490 | Genotyped | T | GEN | 682 | 28 | 144 | 128 | 72 | 180 | 130 |
| rs1434507 | Imputed | A | ADD | 681 | 28 | 126 | 146 | 18 | 132 | 231 |
| rs1434508 | Imputed | T | ADD | 681 | 28 | 126 | 146 | 18 | 133 | 230 |
| rs1435205 | Imputed | A | ADD | 679 | 21 | 111 | 166 | 11 | 123 | 247 |
| rs1443928 | Imputed | C | REC | 672 | 66 | 165 | 65 | 123 | 177 | 76 |
| rs1452235 | Imputed | G | GEN | 682 | 21 | 130 | 149 | 60 | 159 | 163 |
| rs1452236 | Imputed | G | GEN | 681 | 21 | 130 | 149 | 60 | 159 | 162 |
| rs1452237 | Imputed | G | GEN | 682 | 21 | 130 | 149 | 60 | 159 | 163 |
| rs1452243 | Genotyped | T | GEN | 682 | 63 | 135 | 102 | 57 | 184 | 141 |
| rs1463768 | Genotyped | G | REC | 682 | 63 | 135 | 102 | 56 | 184 | 142 |
| rs1463769 | Imputed | G | REC | 675 | 0 | 31 | 267 | 5 | 55 | 317 |
| rs1472435 | Imputed | A | ADD | 675 | 0 | 31 | 267 | 5 | 55 | 317 |
| rs1472435 | Imputed | A | DOM | 681 | 36 | 112 | 151 | 46 | 198 | 138 |
| rs1476714 | Imputed | A | DOM | 671 | 19 | 125 | 150 | 48 | 170 | 159 |
| rs1495159 | Imputed | G | ADD | 671 | 19 | 125 | 150 | 48 | 170 | 159 |
| rs1495159 | Imputed | G | GEN | 674 | 52 | 127 | 117 | 70 | 202 | 106 |
| rs1495375 | Imputed | A | DOM | 649 | 70 | 125 | 87 | 86 | 202 | 79 |
| rs1495376 | Imputed | T | DOM | 652 | 71 | 126 | 87 | 86 | 202 | 80 |
| rs1495377 | Imputed | G | DOM | 682 | 59 | 140 | 101 | 41 | 198 | 143 |
| rs1495381 | Imputed | T | GEN | 682 | 59 | 140 | 101 | 41 | 198 | 143 |
| rs1495381 | Imputed | T | REC | 681 | 28 | 109 | 162 | 47 | 179 | 156 |
| rs1498992 | Imputed | G | DOM | 661 | 16 | 100 | 173 | 38 | 159 | 175 |
| rs1499001 | Imputed | T | DOM | 681 | 45 | 128 | 126 | 65 | 198 | 119 |
| rs1512988 | Imputed | A | DOM | 681 | 45 | 128 | 126 | 65 | 198 | 119 |
| rs1512989 | Imputed | T | DOM | 677 | 57 | 141 | 99 | 88 | 203 | 89 |
| rs1512991 | Imputed | T | REC | 657 | 49 | 140 | 100 | 88 | 203 | 89 |
| rs1512991 | Imputed | G | ADD | 670 | 61 | 143 | 94 | 37 | 188 | 143 |
| rs1516855 | Imputed | T | DOM | 670 | 61 | 143 | 94 | 47 | 174 | 151 |
| rs1527450 | Imputed | T | GEN | 657 | 46 | 126 | 125 | 47 | 174 | 151 |
| rs1527450 | Imputed | T | DOM | 679 | 16 | 104 | 167 | 65 | 198 | 119 |
| rs1567740 | Imputed | A | ADD | 657 | 16 | 104 | 167 | 13 | 85 | 272 |
| rs1572573 | Imputed | A | DOM | 673 | 70 | 161 | 63 | 13 | 85 | 272 |
| rs1572573 | Imputed | C | DOM | 665 | 67 | 159 | 63 | 86 | 160 | 133 |
| rs1584003 | Imputed | C | DOM | 665 | 67 | 159 | 63 | 86 | 158 | 132 |
| rs1584005 | Imputed | G | ADD | 674 | 31 | 119 | 145 | 20 | 133 | 226 |

TABLE 9-continued

| | | | | | | | | |
|---|---|---|---|---|---|---|---|---|
| rs1592015 | Imputed | G | DOM | 681 | 10 | 62 | 227 | 14 | 130 | 238 |
| rs1594885 | Imputed | A | ADD | 681 | 30 | 126 | 144 | 19 | 133 | 229 |
| rs1603232 | Imputed | A | DOM | 655 | 72 | 126 | 89 | 84 | 201 | 83 |
| rs1614565 | Imputed | C | DOM | 671 | 75 | 127 | 93 | 85 | 210 | 81 |
| rs1648200 | Imputed | G | ADD | 623 | 19 | 120 | 129 | 20 | 120 | 215 |
| rs16877387 | Imputed | C | GEN | 677 | 51 | 124 | 122 | 32 | 166 | 182 |
| rs16877387 | Imputed | C | REC | 677 | 51 | 124 | 122 | 32 | 166 | 182 |
| rs16938626 | Imputed | G | DOM | 663 | 23 | 106 | 167 | 33 | 170 | 164 |
| rs1694334 | Imputed | G | ADD | 599 | 10 | 82 | 169 | 36 | 116 | 186 |
| rs16998821 | Imputed | C | DOM | 681 | 10 | 62 | 227 | 14 | 130 | 238 |
| rs1700400 | Imputed | T | ADD | 672 | 11 | 110 | 175 | 31 | 155 | 190 |
| rs17007620 | Imputed | G | ADD | 599 | 16 | 110 | 134 | 15 | 108 | 216 |
| rs17007620 | Imputed | G | DOM | 599 | 16 | 110 | 134 | 15 | 108 | 216 |
| rs17023290 | Imputed | C | DOM | 682 | 2 | 64 | 234 | 6 | 49 | 327 |
| rs17047957 | Imputed | C | DOM | 681 | 7 | 101 | 191 | 16 | 87 | 279 |
| rs1705237 | Imputed | A | DOM | 666 | 71 | 127 | 93 | 85 | 209 | 81 |
| rs1705261 | Imputed | A | GEN | 682 | 59 | 140 | 101 | 41 | 196 | 145 |
| rs1705261 | Imputed | A | REC | 682 | 59 | 140 | 101 | 41 | 196 | 145 |
| rs17076972 | Imputed | C | ADD | 682 | 86 | 144 | 70 | 68 | 196 | 118 |
| rs17076972 | Imputed | C | GEN | 682 | 86 | 144 | 70 | 68 | 196 | 118 |
| rs17076972 | Imputed | C | REC | 682 | 86 | 144 | 70 | 68 | 196 | 118 |
| rs17189710 | Imputed | T | ADD | 681 | 54 | 130 | 116 | 40 | 170 | 171 |
| rs17189710 | Imputed | T | GEN | 681 | 54 | 130 | 116 | 40 | 170 | 171 |
| rs17196143 | Imputed | A | ADD | 682 | 12 | 118 | 170 | 12 | 103 | 267 |
| rs17353809 | Imputed | A | ADD | 674 | 22 | 106 | 167 | 10 | 121 | 248 |
| rs17368986 | Imputed | G | GEN | 682 | 26 | 93 | 181 | 8 | 108 | 266 |
| rs17369097 | Imputed | A | GEN | 681 | 24 | 95 | 181 | 8 | 106 | 267 |
| rs17434511 | Imputed | A | GEN | 679 | 26 | 92 | 180 | 8 | 108 | 265 |
| rs17434589 | Imputed | C | GEN | 673 | 26 | 92 | 177 | 8 | 107 | 263 |
| rs17434603 | Imputed | C | GEN | 680 | 26 | 92 | 181 | 8 | 108 | 265 |
| rs17434840 | Imputed | G | GEN | 681 | 24 | 95 | 181 | 8 | 106 | 267 |
| rs17446418 | Imputed | C | DOM | 678 | 35 | 119 | 144 | 59 | 193 | 128 |
| rs17530747 | Imputed | G | DOM | 669 | 32 | 117 | 144 | 58 | 190 | 128 |
| rs17604285 | Imputed | C | ADD | 681 | 2 | 37 | 261 | 7 | 80 | 294 |
| rs17604285 | Imputed | C | DOM | 681 | 2 | 37 | 261 | 7 | 80 | 294 |
| rs17662322 | Imputed | C | DOM | 681 | 4 | 74 | 221 | 18 | 129 | 235 |
| rs17769826 | Imputed | T | ADD | 677 | 22 | 106 | 169 | 10 | 121 | 249 |
| rs17821641 | Imputed | T | ADD | 679 | 21 | 111 | 166 | 11 | 123 | 247 |
| rs1782328 | Imputed | A | ADD | 647 | 6 | 74 | 203 | 26 | 117 | 221 |
| rs1796337 | Imputed | T | DOM | 669 | 77 | 131 | 88 | 102 | 195 | 76 |
| rs1798083 | Imputed | C | DOM | 674 | 74 | 130 | 92 | 85 | 210 | 83 |
| rs1798085 | Imputed | C | DOM | 668 | 74 | 127 | 92 | 85 | 209 | 81 |
| rs1798086 | Imputed | T | DOM | 668 | 73 | 125 | 95 | 85 | 209 | 81 |
| rs1798089 | Imputed | T | DOM | 675 | 59 | 138 | 100 | 40 | 195 | 143 |
| rs1798089 | Imputed | C | GEN | 675 | 59 | 138 | 100 | 40 | 195 | 143 |
| rs1798090 | Imputed | C | REC | 674 | 59 | 139 | 98 | 41 | 195 | 142 |
| rs1798090 | Imputed | C | GEN | 674 | 59 | 139 | 98 | 41 | 195 | 142 |
| rs1832222 | Imputed | G | DOM | 682 | 26 | 149 | 125 | 33 | 136 | 213 |
| rs1838104 | Imputed | G | ADD | 668 | 71 | 157 | 64 | 128 | 187 | 61 |
| rs1838104 | Imputed | A | GEN | 668 | 71 | 157 | 64 | 128 | 187 | 61 |
| rs1866616 | Imputed | A | ADD | 671 | 4 | 78 | 213 | 18 | 133 | 225 |
| rs1874313 | Imputed | A | DOM | 674 | 46 | 126 | 124 | 65 | 198 | 115 |
| rs1884902 | Imputed | C | REC | 678 | 61 | 145 | 93 | 41 | 185 | 153 |

TABLE 9-continued

| SNP | Status | Allele | Model | | | | | | |
|---|---|---|---|---|---|---|---|---|---|
| rs1913201 | Imputed | G | ADD | 650 | 45 | 139 | 101 | 79 | 194 | 92 |
| rs1913201 | Imputed | G | DOM | 650 | 45 | 139 | 101 | 79 | 194 | 92 |
| rs1913201 | Imputed | G | GEN | 650 | 45 | 139 | 101 | 79 | 194 | 92 |
| rs1944279 | Imputed | A | ADD | 679 | 30 | 125 | 144 | 18 | 133 | 229 |
| rs198461 | Imputed | C | DOM | 676 | 71 | 152 | 74 | 101 | 212 | 66 |
| rs1987179 | Imputed | T | DOM | 680 | 10 | 91 | 198 | 11 | 149 | 221 |
| rs1990023 | Imputed | T | DOM | 682 | 36 | 112 | 152 | 46 | 199 | 137 |
| rs2016194 | Imputed | G | DOM | 682 | 36 | 113 | 151 | 46 | 198 | 138 |
| rs2024789 | Imputed | C | ADD | 666 | 49 | 133 | 108 | 94 | 186 | 96 |
| rs2024789 | Imputed | C | GEN | 666 | 49 | 133 | 108 | 94 | 186 | 96 |
| rs2024902 | Imputed | A | ADD | 678 | 3 | 52 | 243 | 3 | 36 | 341 |
| rs2024902 | Imputed | A | DOM | 678 | 3 | 52 | 243 | 3 | 36 | 341 |
| rs2025107 | Imputed | A | ADD | 682 | 3 | 66 | 231 | 4 | 46 | 332 |
| rs2025107 | Imputed | A | DOM | 682 | 3 | 66 | 231 | 4 | 46 | 332 |
| rs2025108 | Imputed | T | ADD | 682 | 3 | 66 | 231 | 4 | 46 | 332 |
| rs2025108 | Imputed | T | DOM | 682 | 3 | 66 | 231 | 4 | 46 | 332 |
| rs2062448 | Imputed | T | ADD | 674 | 2 | 36 | 260 | 7 | 76 | 293 |
| rs2062448 | Imputed | T | DOM | 674 | 2 | 36 | 260 | 7 | 76 | 293 |
| rs2063591 | Imputed | C | ADD | 677 | 61 | 139 | 98 | 92 | 203 | 84 |
| rs2063591 | Imputed | C | DOM | 677 | 61 | 139 | 98 | 92 | 203 | 84 |
| rs2065604 | Imputed | C | ADD | 682 | 2 | 40 | 258 | 6 | 83 | 293 |
| rs2066238 | Imputed | T | DOM | 682 | 10 | 62 | 228 | 14 | 130 | 238 |
| rs2068051 | Imputed | G | ADD | 424 | 55 | 92 | 46 | 98 | 100 | 33 |
| rs2068051 | Imputed | G | DOM | 424 | 55 | 92 | 46 | 98 | 100 | 33 |
| rs2077702 | Genotyped | G | GEN | 682 | 44 | 122 | 134 | 28 | 168 | 186 |
| rs208757 | Imputed | G | ADD | 652 | 9 | 102 | 177 | 8 | 92 | 264 |
| rs208757 | Imputed | G | DOM | 652 | 9 | 102 | 177 | 8 | 92 | 264 |
| rs2095586 | Imputed | A | DOM | 682 | 26 | 149 | 125 | 33 | 136 | 213 |
| rs2108426 | Imputed | C | DOM | 682 | 36 | 113 | 151 | 46 | 198 | 138 |
| rs2110664 | Imputed | A | DOM | 643 | 24 | 125 | 133 | 22 | 132 | 207 |
| rs2132242 | Imputed | A | DOM | 680 | 48 | 130 | 120 | 69 | 201 | 112 |
| rs2151644 | Imputed | T | DOM | 679 | 2 | 40 | 257 | 6 | 83 | 291 |
| rs2157752 | Genotyped | A | GEN | 682 | 24 | 136 | 140 | 65 | 171 | 146 |
| rs2158958 | Imputed | A | DOM | 682 | 36 | 113 | 151 | 46 | 198 | 138 |
| rs2158961 | Imputed | G | DOM | 680 | 36 | 113 | 151 | 45 | 197 | 138 |
| rs2164099 | Imputed | G | ADD | 681 | 30 | 126 | 144 | 19 | 133 | 229 |
| rs2173254 | Imputed | G | GEN | 675 | 17 | 141 | 138 | 51 | 183 | 145 |
| rs2173254 | Imputed | T | REC | 675 | 17 | 141 | 138 | 51 | 183 | 145 |
| rs2188079 | Imputed | C | ADD | 682 | 71 | 148 | 81 | 53 | 190 | 139 |
| rs2188079 | Imputed | C | GEN | 682 | 71 | 148 | 81 | 53 | 190 | 139 |
| rs2190304 | Imputed | G | REC | 682 | 44 | 168 | 88 | 105 | 188 | 89 |
| rs2190597 | Imputed | T | DOM | 681 | 63 | 133 | 104 | 86 | 208 | 87 |
| rs2190598 | Imputed | T | DOM | 682 | 36 | 113 | 151 | 46 | 198 | 138 |
| rs2190600 | Imputed | A | DOM | 672 | 36 | 110 | 151 | 45 | 193 | 137 |
| rs2218084 | Imputed | G | GEN | 664 | 19 | 74 | 202 | 7 | 92 | 270 |
| rs2218084 | Imputed | T | REC | 664 | 19 | 74 | 202 | 7 | 92 | 270 |
| rs2236290 | Genotyped | C | GEN | 680 | 30 | 136 | 134 | 62 | 171 | 147 |
| rs2243860 | Imputed | A | GEN | 548 | 50 | 117 | 74 | 33 | 164 | 110 |
| rs2243860 | Imputed | A | REC | 548 | 50 | 117 | 74 | 33 | 164 | 110 |
| rs2246564 | Imputed | T | DOM | 682 | 2 | 40 | 258 | 6 | 83 | 293 |
| rs2248236 | Imputed | C | DOM | 681 | 10 | 93 | 197 | 11 | 149 | 221 |
| rs2250340 | Imputed | T | DOM | 600 | 2 | 39 | 224 | 6 | 80 | 249 |
| rs2257192 | Imputed | G | DOM | 682 | 2 | 40 | 258 | 6 | 83 | 293 |

TABLE 9-continued

| | | | | | | | | | |
|---|---|---|---|---|---|---|---|---|---|
| rs2270584 | Imputed | A | DOM | 679 | 49 | 121 | 129 | 62 | 201 | 117 |
| rs2270586 | Imputed | A | DOM | 680 | 49 | 121 | 129 | 61 | 203 | 117 |
| rs2270589 | Imputed | A | ADD | 682 | 54 | 133 | 113 | 83 | 202 | 97 |
| rs2270589 | Imputed | A | DOM | 682 | 54 | 133 | 113 | 83 | 202 | 97 |
| rs2270589 | Imputed | A | GEN | 682 | 54 | 133 | 113 | 83 | 202 | 97 |
| rs2296889 | Imputed | C | DOM | 672 | 3 | 98 | 196 | 11 | 79 | 285 |
| rs2301346 | Imputed | C | ADD | 550 | 32 | 106 | 104 | 23 | 112 | 173 |
| rs2301346 | Imputed | C | DOM | 550 | 32 | 106 | 104 | 23 | 112 | 173 |
| rs2327929 | Imputed | G | REC | 682 | 77 | 130 | 93 | 55 | 181 | 146 |
| rs2357486 | Imputed | C | REC | 673 | 48 | 129 | 121 | 25 | 175 | 175 |
| rs2373793 | Imputed | C | DOM | 646 | 11 | 84 | 197 | 9 | 75 | 270 |
| rs2377622 | Imputed | G | GEN | 552 | 18 | 109 | 105 | 49 | 140 | 131 |
| rs2377622 | Imputed | T | REC | 552 | 18 | 109 | 105 | 49 | 140 | 131 |
| rs2383903 | Imputed | G | DOM | 681 | 22 | 103 | 175 | 33 | 172 | 176 |
| rs2389866 | Imputed | C | DOM | 681 | 10 | 91 | 199 | 11 | 149 | 221 |
| rs2389869 | Imputed | C | DOM | 681 | 10 | 91 | 199 | 11 | 149 | 221 |
| rs2418541 | Imputed | A | DOM | 681 | 36 | 112 | 152 | 46 | 198 | 137 |
| rs2418542 | Imputed | A | DOM | 681 | 36 | 112 | 152 | 46 | 198 | 137 |
| rs2418548 | Imputed | C | DOM | 630 | 33 | 102 | 150 | 35 | 174 | 136 |
| rs2476976 | Imputed | C | DOM | 681 | 25 | 149 | 125 | 34 | 138 | 210 |
| rs2483639 | Imputed | A | DOM | 682 | 2 | 40 | 258 | 6 | 83 | 293 |
| rs2483640 | Imputed | A | DOM | 682 | 2 | 40 | 258 | 6 | 83 | 293 |
| rs2544780 | Imputed | T | REC | 670 | 43 | 124 | 125 | 32 | 154 | 192 |
| rs2586458 | Imputed | T | DOM | 322 | 3 | 21 | 105 | 5 | 55 | 133 |
| rs2593272 | Imputed | G | ADD | 682 | 12 | 111 | 177 | 31 | 157 | 194 |
| rs2593273 | Imputed | G | ADD | 678 | 10 | 111 | 177 | 29 | 157 | 194 |
| rs2622499 | Imputed | G | DOM | 682 | 11 | 94 | 195 | 12 | 150 | 220 |
| rs264126 | Imputed | C | DOM | 679 | 63 | 133 | 104 | 86 | 207 | 86 |
| rs264129 | Imputed | T | DOM | 681 | 36 | 113 | 151 | 46 | 197 | 138 |
| rs2656822 | Imputed | T | ADD | 682 | 12 | 111 | 177 | 31 | 157 | 194 |
| rs2656823 | Imputed | G | ADD | 682 | 12 | 111 | 177 | 31 | 157 | 194 |
| rs2656825 | Imputed | T | ADD | 665 | 9 | 109 | 174 | 29 | 151 | 193 |
| rs2764766 | Imputed | C | REC | 678 | 44 | 128 | 125 | 34 | 156 | 191 |
| rs2793101 | Imputed | T | ADD | 680 | 1 | 45 | 254 | 7 | 92 | 281 |
| rs2793101 | Imputed | T | DOM | 680 | 1 | 45 | 254 | 7 | 92 | 281 |
| rs2795871 | Imputed | A | ADD | 676 | 0 | 31 | 267 | 5 | 56 | 317 |
| rs2795886 | Imputed | A | ADD | 681 | 0 | 19 | 281 | 4 | 40 | 337 |
| rs2795886 | Imputed | A | DOM | 681 | 0 | 19 | 281 | 4 | 40 | 337 |
| rs2859994 | Imputed | C | GEN | 645 | 49 | 143 | 95 | 34 | 181 | 143 |
| rs2870464 | Imputed | G | DOM | 682 | 9 | 84 | 207 | 7 | 81 | 294 |
| rs2875528 | Imputed | T | DOM | 640 | 2 | 64 | 234 | 6 | 49 | 327 |
| rs2876227 | Imputed | C | ADD | 640 | 50 | 122 | 107 | 36 | 156 | 169 |
| rs2876227 | Imputed | C | GEN | 640 | 50 | 122 | 107 | 36 | 156 | 169 |
| rs2882097 | Imputed | A | DOM | 682 | 26 | 149 | 125 | 34 | 136 | 212 |
| rs2921983 | Imputed | C | ADD | 640 | 9 | 96 | 176 | 25 | 143 | 191 |
| rs2987537 | Imputed | C | DOM | 682 | 5 | 44 | 251 | 9 | 97 | 276 |
| rs2996416 | Imputed | C | ADD | 682 | 3 | 37 | 260 | 7 | 86 | 289 |
| rs2996416 | Imputed | C | DOM | 682 | 3 | 37 | 260 | 7 | 86 | 289 |
| rs3015527 | Imputed | C | ADD | 677 | 3 | 37 | 259 | 7 | 85 | 286 |
| rs3015527 | Imputed | C | DOM | 677 | 3 | 37 | 259 | 7 | 85 | 286 |
| rs3015530 | Imputed | C | ADD | 682 | 3 | 37 | 260 | 7 | 86 | 289 |
| rs3015530 | Imputed | C | DOM | 682 | 3 | 37 | 260 | 7 | 86 | 289 |
| rs3015531 | Imputed | T | ADD | 682 | 3 | 37 | 260 | 7 | 86 | 289 |

TABLE 9-continued

| | | | | | | | | |
|---|---|---|---|---|---|---|---|---|
| rs3015531 | Imputed | T | DOM | 682 | 3 | 37 | 260 | 7 | 86 | 289 |
| rs3015535 | Imputed | C | ADD | 682 | 3 | 37 | 260 | 7 | 86 | 289 |
| rs3015535 | Imputed | C | DOM | 682 | 3 | 37 | 260 | 7 | 86 | 289 |
| rs3019407 | Imputed | A | GEN | 675 | 17 | 141 | 138 | 51 | 183 | 145 |
| rs3019407 | Imputed | A | REC | 675 | 17 | 141 | 138 | 51 | 183 | 145 |
| rs36071725 | Genotyped | C | GEN | 682 | 49 | 132 | 119 | 25 | 180 | 177 |
| rs373983 | Imputed | G | DOM | 661 | 55 | 151 | 86 | 52 | 155 | 162 |
| rs3756154 | Imputed | C | DOM | 681 | 10 | 91 | 199 | 11 | 149 | 221 |
| rs3793044 | Imputed | C | ADD | 682 | 3 | 49 | 248 | 2 | 31 | 349 |
| rs3793044 | Imputed | C | DOM | 682 | 3 | 49 | 248 | 2 | 31 | 349 |
| rs3793053 | Imputed | C | ADD | 672 | 3 | 62 | 233 | 3 | 43 | 328 |
| rs3793053 | Imputed | C | DOM | 672 | 3 | 62 | 233 | 3 | 43 | 328 |
| rs3796246 | Imputed | G | ADD | 682 | 1 | 37 | 262 | 5 | 81 | 296 |
| rs3796246 | Imputed | G | DOM | 682 | 3 | 37 | 262 | 5 | 81 | 296 |
| rs3805996 | Imputed | G | ADD | 662 | 3 | 51 | 238 | 3 | 33 | 334 |
| rs3805996 | Imputed | G | DOM | 662 | 3 | 51 | 238 | 3 | 33 | 334 |
| rs3806003 | Imputed | A | ADD | 682 | 3 | 49 | 248 | 2 | 31 | 349 |
| rs3806003 | Imputed | A | DOM | 682 | 3 | 49 | 248 | 2 | 31 | 349 |
| rs3806004 | Imputed | T | ADD | 682 | 3 | 66 | 231 | 4 | 46 | 332 |
| rs3806004 | Imputed | T | DOM | 682 | 3 | 66 | 231 | 4 | 46 | 332 |
| rs3806010 | Imputed | T | ADD | 682 | 3 | 66 | 231 | 4 | 46 | 332 |
| rs3806010 | Imputed | T | DOM | 682 | 3 | 66 | 231 | 4 | 46 | 332 |
| rs3806014 | Imputed | T | ADD | 682 | 3 | 66 | 231 | 4 | 46 | 332 |
| rs3806014 | Imputed | T | DOM | 682 | 3 | 66 | 231 | 4 | 46 | 332 |
| rs3806015 | Imputed | A | ADD | 682 | 3 | 66 | 231 | 4 | 46 | 332 |
| rs3806015 | Imputed | A | DOM | 682 | 3 | 66 | 231 | 4 | 46 | 332 |
| rs3806018 | Imputed | A | ADD | 682 | 3 | 66 | 231 | 4 | 46 | 332 |
| rs3806018 | Imputed | A | DOM | 682 | 3 | 66 | 231 | 4 | 46 | 332 |
| rs3806019 | Imputed | A | ADD | 678 | 3 | 63 | 233 | 3 | 41 | 335 |
| rs3806019 | Imputed | A | DOM | 678 | 3 | 63 | 233 | 3 | 41 | 335 |
| rs3806024 | Imputed | T | ADD | 672 | 3 | 62 | 233 | 3 | 43 | 328 |
| rs3806024 | Imputed | T | DOM | 672 | 3 | 62 | 233 | 3 | 43 | 328 |
| rs3847825 | Imputed | G | ADD | 680 | 33 | 126 | 140 | 75 | 166 | 140 |
| rs3847825 | Imputed | G | GEN | 680 | 33 | 126 | 140 | 75 | 166 | 140 |
| rs3852001 | Genotyped | C | REC | 682 | 26 | 93 | 181 | 8 | 108 | 266 |
| rs3852001 | Genotyped | C | GEN | 682 | 26 | 93 | 181 | 8 | 108 | 266 |
| rs3852002 | Imputed | G | GEN | 681 | 25 | 93 | 181 | 8 | 107 | 267 |
| rs3852002 | Imputed | G | REC | 681 | 25 | 93 | 181 | 8 | 107 | 267 |
| rs3852003 | Imputed | G | GEN | 681 | 25 | 93 | 181 | 8 | 107 | 267 |
| rs3852003 | Imputed | A | REC | 681 | 25 | 93 | 181 | 8 | 107 | 267 |
| rs3942254 | Imputed | A | DOM | 678 | 46 | 128 | 123 | 65 | 198 | 118 |
| rs3945085 | Imputed | T | DOM | 682 | 25 | 149 | 126 | 33 | 134 | 215 |
| rs399485 | Imputed | A | DOM | 678 | 27 | 129 | 142 | 24 | 134 | 222 |
| rs4029119 | Imputed | G | ADD | 682 | 0 | 10 | 290 | 3 | 36 | 343 |
| rs4029119 | Imputed | G | DOM | 682 | 0 | 10 | 290 | 3 | 36 | 343 |
| rs412791 | Imputed | C | GEN | 675 | 27 | 143 | 128 | 69 | 178 | 130 |
| rs4146972 | Genotyped | T | DOM | 682 | 8 | 103 | 189 | 16 | 95 | 271 |
| rs4259369 | Imputed | C | REC | 679 | 50 | 142 | 107 | 89 | 159 | 132 |
| rs4273613 | Imputed | T | ADD | 682 | 0 | 10 | 290 | 3 | 36 | 343 |
| rs4273613 | Imputed | T | DOM | 682 | 0 | 10 | 290 | 3 | 36 | 343 |
| rs4294022 | Imputed | T | DOM | 659 | 13 | 88 | 187 | 23 | 147 | 201 |
| rs4310554 | Genotyped | C | DOM | 682 | 81 | 163 | 56 | 79 | 195 | 108 |
| rs4315598 | Imputed | T | ADD | 682 | 54 | 130 | 116 | 40 | 170 | 172 |

TABLE 9-continued

| | | | | | | | | |
|---|---|---|---|---|---|---|---|---|
| rs4315598 | Imputed | T | GEN | 682 | 54 | 130 | 116 | 40 | 170 | 172 |
| rs4370878 | Imputed | G | DOM | 682 | 25 | 149 | 126 | 33 | 136 | 213 |
| rs4436200 | Imputed | C | ADD | 682 | 5 | 56 | 239 | 10 | 92 | 280 |
| rs4444612 | Imputed | G | ADD | 682 | 54 | 130 | 116 | 40 | 170 | 172 |
| rs4444612 | Imputed | G | GEN | 682 | 54 | 130 | 116 | 40 | 170 | 172 |
| rs4450660 | Imputed | C | DOM | 675 | 15 | 135 | 147 | 16 | 131 | 231 |
| rs4463950 | Imputed | C | DOM | 671 | 56 | 128 | 112 | 69 | 203 | 103 |
| rs4509702 | Imputed | G | DOM | 682 | 25 | 149 | 126 | 33 | 136 | 213 |
| rs4533379 | Imputed | A | ADD | 681 | 30 | 126 | 144 | 19 | 133 | 229 |
| rs4569984 | Imputed | C | DOM | 671 | 13 | 90 | 192 | 24 | 146 | 206 |
| rs4570530 | Imputed | C | DOM | 681 | 25 | 149 | 126 | 33 | 135 | 213 |
| rs4571583 | Imputed | T | DOM | 666 | 13 | 89 | 189 | 23 | 147 | 205 |
| rs4586678 | Imputed | A | DOM | 678 | 15 | 136 | 147 | 17 | 132 | 231 |
| rs4615971 | Imputed | C | DOM | 676 | 26 | 148 | 122 | 33 | 136 | 211 |
| rs4629229 | Imputed | G | DOM | 682 | 10 | 62 | 228 | 14 | 130 | 238 |
| rs4632512 | Imputed | G | DOM | 681 | 24 | 95 | 181 | 8 | 106 | 267 |
| rs4641552 | Imputed | T | GEN | 678 | 0 | 29 | 270 | 4 | 60 | 315 |
| rs4682527 | Imputed | A | ADD | 656 | 39 | 157 | 91 | 49 | 163 | 157 |
| rs4688632 | Imputed | C | DOM | 675 | 50 | 168 | 77 | 105 | 182 | 93 |
| rs4702720 | Imputed | G | REC | 530 | 11 | 64 | 166 | 23 | 107 | 159 |
| rs4702720 | Imputed | G | ADD | 530 | 11 | 64 | 166 | 23 | 107 | 159 |
| rs4714484 | Imputed | A | DOM | 681 | 5 | 68 | 227 | 14 | 119 | 248 |
| rs4714484 | Imputed | A | ADD | 681 | 5 | 68 | 227 | 14 | 119 | 248 |
| rs4725142 | Genotyped | A | DOM | 682 | 23 | 156 | 121 | 58 | 171 | 153 |
| rs4725144 | Imputed | G | REC | 677 | 21 | 154 | 123 | 56 | 169 | 154 |
| rs4760785 | Imputed | A | REC | 657 | 49 | 139 | 101 | 82 | 194 | 92 |
| rs4760785 | Imputed | A | ADD | 657 | 49 | 139 | 101 | 82 | 194 | 92 |
| rs4760894 | Imputed | T | ADD | 657 | 49 | 139 | 101 | 82 | 194 | 92 |
| rs4760894 | Imputed | T | DOM | 657 | 49 | 139 | 101 | 82 | 194 | 92 |
| rs4760895 | Imputed | A | ADD | 657 | 49 | 139 | 101 | 82 | 194 | 92 |
| rs4760895 | Imputed | A | DOM | 657 | 49 | 139 | 101 | 82 | 194 | 92 |
| rs4767184 | Imputed | C | ADD | 678 | 37 | 124 | 138 | 75 | 169 | 135 |
| rs4767184 | Imputed | C | GEN | 678 | 37 | 124 | 138 | 75 | 169 | 135 |
| rs4773487 | Imputed | T | ADD | 682 | 3 | 43 | 254 | 9 | 88 | 285 |
| rs4780547 | Imputed | G | GEN | 682 | 9 | 97 | 194 | 31 | 125 | 226 |
| rs4780547 | Imputed | G | REC | 682 | 9 | 97 | 194 | 31 | 125 | 226 |
| rs483159 | Imputed | C | DOM | 611 | 11 | 105 | 155 | 12 | 90 | 238 |
| rs4836502 | Imputed | T | DOM | 682 | 36 | 113 | 151 | 46 | 198 | 138 |
| rs4836507 | Imputed | C | DOM | 672 | 36 | 110 | 151 | 45 | 193 | 137 |
| rs4851531 | Imputed | T | DOM | 677 | 44 | 136 | 118 | 68 | 190 | 121 |
| rs4879931 | Imputed | G | ADD | 678 | 22 | 109 | 166 | 48 | 164 | 169 |
| rs489441 | Imputed | G | ADD | 631 | 20 | 128 | 127 | 19 | 123 | 214 |
| rs489441 | Imputed | G | DOM | 631 | 20 | 128 | 127 | 19 | 123 | 214 |
| rs4976276 | Imputed | T | ADD | 681 | 32 | 143 | 125 | 21 | 166 | 194 |
| rs4977681 | Imputed | C | REC | 682 | 41 | 116 | 143 | 22 | 166 | 194 |
| rs4986197 | Imputed | G | ADD | 679 | 30 | 125 | 146 | 19 | 133 | 229 |
| rs4986220 | Imputed | T | ADD | 681 | 28 | 125 | 143 | 18 | 133 | 231 |
| rs525462 | Imputed | A | GEN | 682 | 88 | 142 | 70 | 136 | 174 | 72 |
| rs552006 | Imputed | G | GEN | 678 | 44 | 108 | 146 | 28 | 143 | 209 |
| rs5756669 | Imputed | C | DOM | 679 | 66 | 164 | 68 | 75 | 173 | 133 |
| rs581905 | Imputed | T | DOM | 681 | 3 | 55 | 242 | 1 | 46 | 334 |
| rs6033138 | Imputed | C | ADD | 682 | 54 | 130 | 116 | 40 | 170 | 172 |
| rs6033138 | Imputed | C | GEN | 682 | 54 | 130 | 116 | 40 | 170 | 172 |

TABLE 9-continued

| | | | | | | | | |
|---|---|---|---|---|---|---|---|---|
| rs6040619 | Imputed | C | ADD | 677 | 55 | 129 | 114 | 41 | 168 | 170 |
| rs6040619 | Imputed | C | GEN | 677 | 55 | 129 | 114 | 41 | 168 | 170 |
| rs6040625 | Imputed | T | ADD | 680 | 55 | 131 | 114 | 41 | 168 | 171 |
| rs6040625 | Imputed | T | GEN | 680 | 55 | 131 | 114 | 41 | 168 | 171 |
| rs6040630 | Imputed | A | ADD | 679 | 54 | 132 | 114 | 40 | 168 | 171 |
| rs6040630 | Imputed | A | GEN | 679 | 54 | 132 | 114 | 40 | 168 | 171 |
| rs6040633 | Imputed | A | ADD | 679 | 54 | 132 | 114 | 40 | 168 | 171 |
| rs6040633 | Imputed | A | GEN | 679 | 54 | 132 | 114 | 40 | 168 | 171 |
| rs6040634 | Imputed | T | ADD | 682 | 54 | 132 | 114 | 40 | 169 | 170 |
| rs6040634 | Imputed | T | GEN | 682 | 54 | 132 | 114 | 43 | 169 | 170 |
| rs6040636 | Imputed | T | ADD | 681 | 54 | 132 | 114 | 43 | 168 | 170 |
| rs6040636 | Imputed | T | GEN | 681 | 54 | 132 | 114 | 43 | 168 | 170 |
| rs6040638 | Imputed | C | ADD | 682 | 54 | 130 | 116 | 40 | 170 | 172 |
| rs6040638 | Imputed | C | GEN | 682 | 54 | 130 | 116 | 40 | 170 | 172 |
| rs6040644 | Imputed | A | ADD | 680 | 54 | 130 | 115 | 40 | 170 | 171 |
| rs6040644 | Imputed | A | GEN | 680 | 54 | 130 | 115 | 40 | 170 | 171 |
| rs6040667 | Imputed | T | ADD | 669 | 50 | 128 | 115 | 36 | 162 | 178 |
| rs6040667 | Imputed | T | GEN | 669 | 50 | 128 | 115 | 36 | 162 | 178 |
| rs6040668 | Imputed | C | ADD | 669 | 50 | 128 | 115 | 36 | 162 | 178 |
| rs6040668 | Imputed | C | GEN | 669 | 50 | 128 | 115 | 36 | 162 | 178 |
| rs6053005 | Imputed | C | DOM | 479 | 78 | 90 | 38 | 94 | 144 | 35 |
| rs6054405 | Genotyped | A | REC | 679 | 61 | 144 | 93 | 41 | 186 | 154 |
| rs6075186 | Imputed | G | GEN | 682 | 59 | 150 | 91 | 44 | 186 | 152 |
| rs608278 | Imputed | G | DOM | 682 | 10 | 62 | 228 | 14 | 130 | 238 |
| rs6111540 | Imputed | A | ADD | 594 | 39 | 114 | 104 | 66 | 173 | 98 |
| rs6131206 | Imputed | A | ADD | 630 | 45 | 138 | 92 | 99 | 174 | 82 |
| rs6131208 | Imputed | C | ADD | 668 | 36 | 120 | 135 | 29 | 149 | 199 |
| rs6131208 | Imputed | T | ADD | 669 | 50 | 128 | 115 | 36 | 162 | 178 |
| rs6131919 | Imputed | G | GEN | 669 | 50 | 128 | 115 | 36 | 162 | 178 |
| rs6134243 | Imputed | C | DOM | 682 | 10 | 62 | 228 | 14 | 130 | 238 |
| rs6134243 | Imputed | C | ADD | 682 | 54 | 130 | 116 | 40 | 170 | 172 |
| rs6136020 | Imputed | C | GEN | 682 | 54 | 130 | 116 | 40 | 170 | 172 |
| rs613799 | Imputed | A | DOM | 681 | 10 | 61 | 228 | 14 | 130 | 238 |
| rs644041 | Imputed | C | DOM | 582 | 20 | 125 | 107 | 28 | 115 | 187 |
| rs644041 | Imputed | G | ADD | 621 | 21 | 126 | 125 | 18 | 123 | 208 |
| rs6464377 | Imputed | G | DOM | 621 | 21 | 126 | 125 | 18 | 123 | 208 |
| rs6474230 | Imputed | C | ADD | 681 | 0 | 59 | 241 | 2 | 36 | 343 |
| rs6476565 | Imputed | T | DOM | 681 | 17 | 119 | 163 | 27 | 108 | 247 |
| rs6511286 | Imputed | A | DOM | 677 | 2 | 39 | 256 | 6 | 82 | 292 |
| rs6541829 | Genotyped | T | ADD | 675 | 37 | 138 | 123 | 35 | 148 | 194 |
| rs6544721 | Imputed | C | REC | 682 | 28 | 117 | 155 | 20 | 146 | 216 |
| rs6544728 | Imputed | G | DOM | 675 | 14 | 134 | 147 | 16 | 132 | 232 |
| rs6565910 | Imputed | T | DOM | 680 | 15 | 135 | 149 | 14 | 133 | 234 |
| rs6581985 | Imputed | G | DOM | 675 | 19 | 87 | 191 | 30 | 152 | 196 |
| rs6581985 | Imputed | G | GEN | 661 | 35 | 120 | 136 | 21 | 161 | 188 |
| rs6685186 | Imputed | G | REC | 661 | 35 | 120 | 136 | 21 | 161 | 188 |
| rs6685186 | Imputed | G | ADD | 680 | 63 | 146 | 90 | 46 | 179 | 156 |
| rs670593 | Imputed | T | GEN | 680 | 63 | 146 | 90 | 46 | 179 | 136 |
| rs6722640 | Imputed | A | REC | 678 | 37 | 157 | 105 | 71 | 172 | 136 |
| rs6746170 | Imputed | T | DOM | 682 | 47 | 133 | 120 | 69 | 193 | 120 |
| rs6757316 | Imputed | A | DOM | 679 | 15 | 135 | 148 | 14 | 133 | 234 |
| rs6805139 | Imputed | A | GEN | 675 | 73 | 131 | 93 | 52 | 189 | 137 |
| rs6805139 | Imputed | G | DOM | 681 | 78 | 170 | 52 | 95 | 180 | 106 |

TABLE 9-continued

| | | | | | | | | |
|---|---|---|---|---|---|---|---|---|
| rs6808571 | Imputed | G | ADD | 675 | 13 | 89 | 197 | 4 | 78 | 294 |
| rs6816479 | Imputed | A | REC | 681 | 52 | 116 | 131 | 39 | 187 | 156 |
| rs6865976 | Imputed | C | DOM | 636 | 53 | 129 | 95 | 88 | 197 | 74 |
| rs687047 | Imputed | C | ADD | 682 | 1 | 57 | 242 | 12 | 89 | 281 |
| rs6871041 | Imputed | G | DOM | 625 | 28 | 100 | 151 | 33 | 175 | 138 |
| rs688358 | Imputed | A | ADD | 672 | 1 | 57 | 238 | 12 | 88 | 276 |
| rs6908481 | Imputed | C | REC | 664 | 66 | 124 | 100 | 47 | 178 | 149 |
| rs6917224 | Imputed | A | ADD | 682 | 64 | 143 | 93 | 51 | 173 | 158 |
| rs6917224 | Imputed | A | GEN | 682 | 64 | 143 | 93 | 51 | 173 | 158 |
| rs6920677 | Imputed | G | DOM | 669 | 41 | 124 | 132 | 61 | 184 | 127 |
| rs6994498 | Imputed | G | DOM | 679 | 16 | 119 | 163 | 27 | 107 | 247 |
| rs6998772 | Imputed | T | DOM | 682 | 2 | 43 | 255 | 2 | 25 | 355 |
| rs7022281 | Imputed | C | ADD | 678 | 33 | 142 | 124 | 69 | 177 | 133 |
| rs7022281 | Imputed | C | GEN | 678 | 33 | 142 | 124 | 69 | 177 | 133 |
| rs7022281 | Imputed | C | REC | 678 | 33 | 142 | 124 | 69 | 177 | 133 |
| rs7043983 | Imputed | T | DOM | 678 | 2 | 39 | 256 | 6 | 82 | 293 |
| rs7077799 | Imputed | A | DOM | 682 | 26 | 149 | 125 | 34 | 136 | 212 |
| rs7088947 | Imputed | A | ADD | 681 | 0 | 31 | 269 | 5 | 56 | 320 |
| rs7089661 | Imputed | C | DOM | 682 | 26 | 149 | 125 | 33 | 136 | 213 |
| rs7102072 | Imputed | A | DOM | 681 | 24 | 97 | 179 | 36 | 171 | 174 |
| rs710832 | Genotyped | A | REC | 682 | 12 | 120 | 168 | 37 | 127 | 218 |
| rs712531 | Imputed | A | DOM | 671 | 35 | 161 | 95 | 48 | 164 | 168 |
| rs7129817 | Imputed | T | ADD | 674 | 30 | 120 | 148 | 56 | 178 | 142 |
| rs7134262 | Imputed | T | GEN | 678 | 55 | 117 | 127 | 30 | 196 | 153 |
| rs7134262 | Imputed | T | REC | 678 | 55 | 117 | 127 | 30 | 196 | 153 |
| rs7138300 | Imputed | C | ADD | 657 | 49 | 139 | 101 | 82 | 194 | 92 |
| rs7138300 | Imputed | C | DOM | 657 | 49 | 139 | 101 | 82 | 194 | 92 |
| rs722927 | Imputed | G | ADD | 660 | 1 | 27 | 267 | 5 | 62 | 298 |
| rs722927 | Imputed | G | DOM | 660 | 1 | 27 | 267 | 5 | 62 | 298 |
| rs726424 | Genotyped | G | ADD | 682 | 35 | 127 | 138 | 76 | 166 | 140 |
| rs726424 | Genotyped | G | GEN | 682 | 35 | 127 | 138 | 76 | 166 | 140 |
| rs7295817 | Imputed | C | ADD | 677 | 36 | 132 | 129 | 85 | 170 | 125 |
| rs7295817 | Imputed | C | GEN | 677 | 36 | 132 | 129 | 85 | 170 | 125 |
| rs7295817 | Imputed | C | REC | 677 | 36 | 132 | 129 | 85 | 170 | 125 |
| rs7297372 | Imputed | A | ADD | 682 | 80 | 152 | 68 | 139 | 186 | 57 |
| rs7297372 | Imputed | A | GEN | 682 | 80 | 152 | 68 | 139 | 186 | 57 |
| rs7298255 | Imputed | A | ADD | 682 | 57 | 142 | 101 | 89 | 203 | 90 |
| rs7298255 | Imputed | A | DOM | 682 | 57 | 142 | 101 | 89 | 203 | 90 |
| rs7305832 | Imputed | C | GEN | 678 | 55 | 117 | 127 | 30 | 196 | 153 |
| rs7305832 | Imputed | C | REC | 678 | 55 | 117 | 127 | 30 | 196 | 153 |
| rs737542 | Imputed | A | REC | 678 | 28 | 116 | 154 | 20 | 145 | 215 |
| rs742827 | Imputed | A | ADD | 637 | 50 | 123 | 105 | 37 | 155 | 167 |
| rs742827 | Imputed | A | GEN | 637 | 50 | 123 | 105 | 37 | 155 | 167 |
| rs7446891 | Imputed | G | DOM | 681 | 36 | 113 | 151 | 45 | 198 | 138 |
| rs7448641 | Imputed | C | ADD | 682 | 0 | 9 | 291 | 3 | 36 | 343 |
| rs7448641 | Imputed | C | DOM | 682 | 0 | 9 | 291 | 3 | 36 | 343 |
| rs7460605 | Imputed | G | DOM | 638 | 52 | 144 | 87 | 60 | 146 | 149 |
| rs7468898 | Imputed | T | ADD | 674 | 74 | 153 | 72 | 61 | 195 | 119 |
| rs7468898 | Imputed | T | GEN | 674 | 74 | 153 | 72 | 61 | 195 | 119 |
| rs7501186 | Imputed | A | DOM | 677 | 8 | 82 | 207 | 7 | 77 | 296 |
| rs755117 | Imputed | A | DOM | 651 | 13 | 105 | 171 | 16 | 93 | 253 |
| rs7557560 | Imputed | T | GEN | 679 | 18 | 95 | 186 | 7 | 120 | 253 |
| rs7557560 | Imputed | T | REC | 679 | 18 | 95 | 186 | 7 | 120 | 253 |

TABLE 9-continued

| | | | | | | | | |
|---|---|---|---|---|---|---|---|---|
| rs7562462 | Imputed | T | DOM | 673 | 65 | 153 | 75 | 70 | 161 | 149 |
| rs757173 | Genotyped | G | DOM | 682 | 32 | 122 | 146 | 57 | 194 | 131 |
| rs7607447 | Imputed | T | REC | 676 | 33 | 111 | 153 | 24 | 162 | 193 |
| rs7639053 | Imputed | A | ADD | 682 | 22 | 107 | 171 | 10 | 121 | 251 |
| rs7648163 | Imputed | C | REC | 654 | 45 | 111 | 132 | 31 | 167 | 168 |
| rs7651273 | Imputed | A | GEN | 680 | 26 | 93 | 180 | 8 | 108 | 265 |
| rs7653190 | Imputed | C | ADD | 677 | 22 | 106 | 169 | 10 | 121 | 249 |
| rs7653685 | Genotyped | C | DOM | 682 | 2 | 64 | 234 | 6 | 49 | 327 |
| rs7684899 | Imputed | G | DOM | 682 | 10 | 93 | 197 | 11 | 150 | 221 |
| rs7701604 | Imputed | G | ADD | 682 | 0 | 9 | 291 | 3 | 36 | 343 |
| rs7701604 | Imputed | G | DOM | 682 | 0 | 9 | 291 | 3 | 36 | 343 |
| rs7703676 | Imputed | C | ADD | 682 | 0 | 9 | 291 | 3 | 36 | 343 |
| rs7703676 | Imputed | C | DOM | 682 | 0 | 9 | 291 | 3 | 36 | 343 |
| rs7711358 | Imputed | A | DOM | 677 | 36 | 112 | 149 | 46 | 197 | 137 |
| rs7713251 | Imputed | C | REC | 661 | 44 | 130 | 120 | 28 | 171 | 168 |
| rs7737608 | Imputed | G | DOM | 676 | 44 | 155 | 96 | 48 | 150 | 183 |
| rs7755903 | Imputed | A | GEN | 681 | 44 | 145 | 111 | 80 | 190 | 111 |
| rs7762993 | Imputed | A | ADD | 677 | 16 | 111 | 170 | 14 | 90 | 276 |
| rs7762993 | Imputed | A | DOM | 677 | 16 | 111 | 170 | 14 | 90 | 276 |
| rs7767265 | Imputed | G | DOM | 663 | 22 | 116 | 149 | 19 | 98 | 259 |
| rs7769415 | Imputed | C | GEN | 670 | 39 | 126 | 129 | 31 | 166 | 179 |
| rs7771264 | Imputed | T | DOM | 654 | 13 | 88 | 184 | 23 | 147 | 199 |
| rs7795792 | Imputed | T | REC | 679 | 50 | 142 | 107 | 89 | 159 | 132 |
| rs7806481 | Imputed | G | REC | 682 | 44 | 168 | 88 | 105 | 188 | 89 |
| rs7808536 | Imputed | G | DOM | 678 | 11 | 115 | 173 | 16 | 111 | 252 |
| rs7814819 | Imputed | G | ADD | 395 | 2 | 41 | 138 | 1 | 22 | 191 |
| rs7814819 | Imputed | G | DOM | 395 | 2 | 41 | 138 | 1 | 22 | 191 |
| rs7815952 | Imputed | T | DOM | 682 | 2 | 43 | 255 | 2 | 25 | 355 |
| rs7834090 | Imputed | T | DOM | 679 | 2 | 43 | 256 | 2 | 25 | 355 |
| rs7859250 | Genotyped | C | DOM | 682 | 1 | 39 | 259 | 6 | 83 | 293 |
| rs7863577 | Genotyped | A | ADD | 682 | 1 | 40 | 259 | 7 | 85 | 290 |
| rs7863577 | Genotyped | A | DOM | 682 | 1 | 40 | 259 | 7 | 85 | 290 |
| rs7902140 | Imputed | C | ADD | 673 | 6 | 79 | 212 | 26 | 120 | 230 |
| rs7921834 | Imputed | C | DOM | 682 | 26 | 149 | 125 | 33 | 136 | 213 |
| rs7939893 | Imputed | C | ADD | 682 | 33 | 113 | 154 | 64 | 161 | 157 |
| rs7939893 | Imputed | C | DOM | 682 | 33 | 113 | 154 | 64 | 161 | 157 |
| rs7955901 | Imputed | T | ADD | 675 | 57 | 140 | 101 | 89 | 199 | 89 |
| rs7955901 | Imputed | T | DOM | 675 | 57 | 140 | 101 | 89 | 199 | 89 |
| rs7956274 | Imputed | T | DOM | 677 | 57 | 141 | 99 | 88 | 202 | 90 |
| rs7956274 | Imputed | T | DOM | 677 | 57 | 141 | 99 | 88 | 202 | 90 |
| rs7957932 | Imputed | G | ADD | 671 | 60 | 139 | 97 | 89 | 202 | 84 |
| rs7957932 | Imputed | G | DOM | 671 | 60 | 139 | 97 | 89 | 202 | 84 |
| rs7984294 | Imputed | A | DOM | 678 | 5 | 69 | 224 | 4 | 66 | 310 |
| rs7994286 | Imputed | A | ADD | 674 | 3 | 39 | 252 | 8 | 87 | 285 |
| rs7994286 | Imputed | A | DOM | 674 | 3 | 39 | 252 | 8 | 87 | 285 |
| rs8038229 | Genotyped | A | ADD | 682 | 26 | 109 | 165 | 40 | 162 | 180 |
| rs8038229 | Genotyped | A | DOM | 682 | 26 | 109 | 165 | 40 | 162 | 180 |
| rs8043336 | Imputed | C | GEN | 647 | 21 | 132 | 129 | 56 | 158 | 151 |
| rs8054431 | Imputed | C | REC | 652 | 21 | 132 | 129 | 56 | 158 | 151 |
| rs8066502 | Imputed | T | DOM | 681 | 41 | 155 | 90 | 49 | 161 | 156 |
| rs8068714 | Imputed | T | DOM | 682 | 8 | 60 | 232 | 6 | 107 | 268 |
| | | | | | 8 | 59 | 233 | 6 | 107 | 269 |

TABLE 9-continued

| | | | | | | | | | |
|---|---|---|---|---|---|---|---|---|---|
| rs892575 | Imputed | T | ADD | 681 | 28 | 127 | 145 | 19 | 131 | 231 |
| rs892583 | Imputed | G | ADD | 679 | 28 | 126 | 145 | 18 | 133 | 229 |
| rs915494 | Imputed | A | ADD | 647 | 23 | 140 | 123 | 25 | 126 | 210 |
| rs915494 | Imputed | A | DOM | 647 | 23 | 140 | 123 | 25 | 126 | 210 |
| rs917295 | Imputed | G | DOM | 681 | 36 | 113 | 151 | 45 | 198 | 138 |
| rs922594 | Imputed | T | DOM | 681 | 45 | 115 | 139 | 50 | 182 | 150 |
| rs9301653 | Imputed | T | ADD | 682 | 3 | 37 | 260 | 7 | 86 | 289 |
| rs9301653 | Imputed | T | DOM | 682 | 3 | 37 | 260 | 7 | 86 | 289 |
| rs9309988 | Imputed | G | DOM | 682 | 2 | 64 | 234 | 6 | 49 | 327 |
| rs9309989 | Genotyped | C | DOM | 682 | 2 | 66 | 232 | 8 | 48 | 326 |
| rs9310221 | Imputed | A | DOM | 631 | 50 | 161 | 71 | 65 | 141 | 143 |
| rs9327555 | Imputed | T | DOM | 682 | 36 | 113 | 151 | 45 | 199 | 138 |
| rs937890 | Imputed | G | DOM | 638 | 8 | 55 | 218 | 6 | 102 | 249 |
| rs9454967 | Imputed | G | ADD | 678 | 3 | 62 | 234 | 3 | 41 | 335 |
| rs9454967 | Imputed | G | DOM | 678 | 3 | 62 | 234 | 3 | 41 | 335 |
| rs9471295 | Imputed | T | DOM | 682 | 5 | 90 | 205 | 4 | 86 | 292 |
| rs9477007 | Imputed | A | ADD | 651 | 65 | 136 | 85 | 52 | 164 | 149 |
| rs9477007 | Imputed | A | GEN | 651 | 65 | 136 | 85 | 52 | 164 | 149 |
| rs9487279 | Imputed | T | DOM | 653 | 45 | 118 | 126 | 62 | 187 | 115 |
| rs949016 | Imputed | C | ADD | 682 | 29 | 125 | 146 | 18 | 133 | 231 |
| rs9555973 | Imputed | G | ADD | 681 | 3 | 41 | 256 | 8 | 88 | 285 |
| rs9555973 | Imputed | G | DOM | 681 | 3 | 41 | 256 | 8 | 88 | 285 |
| rs9557510 | Imputed | G | ADD | 680 | 6 | 91 | 202 | 6 | 76 | 299 |
| rs9557510 | Imputed | G | DOM | 680 | 6 | 91 | 202 | 6 | 76 | 299 |
| rs9560584 | Imputed | T | ADD | 660 | 3 | 37 | 251 | 7 | 83 | 279 |
| rs9588770 | Imputed | T | DOM | 680 | 3 | 42 | 255 | 8 | 86 | 286 |
| rs9588848 | Imputed | C | ADD | 682 | 3 | 37 | 260 | 7 | 86 | 289 |
| rs9588848 | Imputed | C | DOM | 682 | 3 | 37 | 260 | 7 | 86 | 289 |
| rs966583 | Imputed | A | ADD | 679 | 45 | 127 | 126 | 65 | 198 | 118 |
| rs966583 | Imputed | A | DOM | 679 | 45 | 127 | 126 | 65 | 198 | 118 |
| rs974130 | Genotyped | A | REC | 682 | 52 | 117 | 131 | 39 | 187 | 156 |
| rs977160 | Imputed | T | ADD | 681 | 26 | 130 | 144 | 17 | 125 | 239 |
| rs9812206 | Imputed | G | ADD | 682 | 1 | 36 | 263 | 6 | 82 | 294 |
| rs9812206 | Imputed | G | DOM | 682 | 1 | 36 | 263 | 6 | 82 | 294 |
| rs9813552 | Imputed | G | ADD | 673 | 1 | 36 | 261 | 5 | 82 | 288 |
| rs9813552 | Imputed | G | DOM | 673 | 1 | 36 | 261 | 5 | 82 | 288 |

TABLE 9-continued

| | | | | | | | | |
|---|---|---|---|---|---|---|---|---|
| rs9815037 | Imputed | T | ADD | 682 | 1 | 36 | 263 | 5 | 83 | 294 |
| rs9815037 | Imputed | T | DOM | 682 | 1 | 36 | 263 | 5 | 83 | 294 |
| rs9825349 | Imputed | A | ADD | 682 | 1 | 36 | 263 | 5 | 83 | 294 |
| rs9825349 | Imputed | A | DOM | 682 | 1 | 36 | 263 | 5 | 83 | 294 |
| rs9834217 | Imputed | T | ADD | 681 | 1 | 36 | 262 | 5 | 83 | 294 |
| rs9834217 | Imputed | T | DOM | 681 | 1 | 36 | 262 | 5 | 83 | 294 |
| rs9840460 | Imputed | T | ADD | 682 | 1 | 36 | 263 | 5 | 83 | 294 |
| rs9840460 | Imputed | T | DOM | 682 | 1 | 36 | 263 | 5 | 83 | 294 |
| rs9840756 | Imputed | A | ADD | 682 | 1 | 36 | 263 | 5 | 83 | 294 |
| rs9840756 | Imputed | A | DOM | 682 | 1 | 36 | 263 | 5 | 83 | 294 |
| rs9844801 | Imputed | A | DOM | 682 | 2 | 64 | 234 | 6 | 49 | 327 |
| rs985375 | Imputed | A | GEN | 655 | 30 | 110 | 146 | 16 | 131 | 222 |
| rs9869187 | Imputed | C | ADD | 681 | 0 | 35 | 264 | 6 | 74 | 302 |
| rs9869187 | Imputed | C | DOM | 681 | 0 | 35 | 264 | 6 | 74 | 302 |
| rs9872327 | Imputed | T | DOM | 682 | 2 | 64 | 234 | 6 | 49 | 327 |
| rs9881685 | Imputed | A | ADD | 682 | 1 | 36 | 263 | 6 | 82 | 294 |
| rs9881685 | Imputed | A | DOM | 682 | 1 | 36 | 263 | 6 | 82 | 294 |
| rs9909499 | Imputed | C | DOM | 668 | 29 | 136 | 132 | 29 | 146 | 196 |
| rs9911847 | Imputed | G | DOM | 680 | 9 | 58 | 233 | 6 | 107 | 267 |
| rs9946886 | Imputed | G | REC | 232 | 13 | 61 | 35 | 40 | 41 | 42 |
| rs9958823 | Imputed | A | ADD | 679 | 30 | 125 | 144 | 18 | 133 | 229 |
| rs9965248 | Imputed | T | ADD | 671 | 27 | 128 | 140 | 20 | 128 | 228 |

TABLE 10

| SNP rs # | SOURCE | ALLELE (A1) | MODEL | NMISS | OR | SE | L95 | U95 | STAT | P | HW_PVALUE | ALLELE_FREQ | PRAVA_ALLELE_FREQ | PLACEBO_ALLELE_FREQ |
|---|---|---|---|---|---|---|---|---|---|---|---|---|---|---|
| rs198460 | Genotyped | G | REC | 383 | 2.115 | 0.2449 | 1.309 | 3.418 | 3.058 | 0.00223 | 1 | 0.48695 | 0.53145 | 0.45536 |
| rs603940 | Genotyped | G | REC | 383 | 0.5858 | 0.2988 | 0.3261 | 1.052 | -1.79 | 0.07347 | 0.7489 | 0.39687 | 0.36164 | 0.42188 |
| rs10021016 | Genotyped | G | GEN | 383 | | | | | 3.838 | 0.1467 | 0.8921 | 0.25196 | 0.28931 | 0.22545 |
| rs1003148 | Imputed | C | ADD | 383 | 0.7355 | 0.153 | 0.545 | 0.9926 | -2.009 | 0.04457 | 0.9158 | 0.4047 | 0.36164 | 0.43527 |
| rs1003148 | Imputed | C | GEN | 383 | | | | | 4.552 | 0.1027 | 0.9158 | 0.4047 | 0.36164 | 0.43527 |
| rs1003148 | Imputed | C | REC | 383 | 0.7366 | 0.2895 | 0.4176 | 1.299 | -1.056 | 0.2911 | 0.9158 | 0.4047 | 0.36164 | 0.43527 |
| rs10046799 | Imputed | C | ADD | 381 | 0.617 | 0.1556 | 0.4548 | 0.837 | -3.103 | 0.00192 | 0.7499 | 0.60105 | 0.53797 | 0.64574 |
| rs10046799 | Imputed | C | GEN | 381 | | | | | 9.722 | 0.00774 | 0.7499 | 0.60105 | 0.53797 | 0.64574 |
| rs10051148 | Imputed | C | DOM | 383 | 0.609 | 0.2097 | 0.4037 | 0.9185 | -2.365 | 0.01802 | 0.6338 | 0.3107 | 0.27358 | 0.33705 |
| rs10054055 | Imputed | T | DOM | 383 | 0.6113 | 0.2097 | 0.4053 | 0.9221 | -2.347 | 0.01893 | 0.5542 | 0.31593 | 0.27987 | 0.34152 |
| rs10067895 | Imputed | A | DOM | 379 | 0.6022 | 0.2112 | 0.398 | 0.911 | -2.401 | 0.01634 | 0.724 | 0.3219 | 0.28526 | 0.34753 |
| rs1008705 | Imputed | C | DOM | 276 | 1.451 | 0.2489 | 0.8906 | 2.363 | 1.495 | 0.135 | 0.3442 | 0.33514 | 0.36752 | 0.31132 |
| rs10105871 | Imputed | C | DOM | 355 | 1.427 | 0.2237 | 0.9203 | 2.212 | 1.589 | 0.1121 | 0.3678 | 0.37887 | 0.40203 | 0.36232 |
| rs10116807 | Imputed | A | GEN | 376 | | | | | 4.005 | 0.135 | 1 | 0.20346 | 0.23077 | 0.18409 |
| rs10116807 | Imputed | A | REC | 376 | 2.952 | 0.5596 | 0.9858 | 8.84 | 1.934 | 0.05307 | 1 | 0.20346 | 0.23077 | 0.18409 |
| rs10121941 | Imputed | C | DOM | 383 | 0.4711 | 0.3006 | 0.2614 | 0.8493 | -2.503 | 0.0123 | 0.2271 | 0.09138 | 0.06289 | 0.11161 |
| rs10128638 | Genotyped | G | DOM | 383 | 0.6529 | 0.2374 | 0.41 | 1.04 | -1.796 | 0.07252 | 0.4134 | 0.50783 | 0.4717 | 0.53348 |
| rs1012924 | Imputed | G | ADD | 383 | 0.5758 | 0.2661 | 0.3418 | 0.97 | -2.074 | 0.03805 | 0.7681 | 0.09661 | 0.06918 | 0.11607 |
| rs1012924 | Imputed | G | DOM | 383 | 0.554 | 0.2856 | 0.3166 | 0.9696 | -2.068 | 0.03864 | 0.7681 | 0.09661 | 0.06918 | 0.11607 |
| rs1016030 | Genotyped | G | ADD | 382 | 1.554 | 0.1629 | 1.129 | 2.139 | 2.707 | 0.0068 | 0.02038 | 0.40969 | 0.46519 | 0.37054 |
| rs1016030 | Genotyped | G | GEN | 382 | | | | | 7.336 | 0.02553 | 0.02038 | 0.40969 | 0.46519 | 0.37054 |
| rs1017558 | Imputed | A | REC | 382 | 2.201 | 0.2868 | 1.254 | 3.861 | 2.75 | 0.00596 | 0.8317 | 0.40052 | 0.45912 | 0.35874 |
| rs10183431 | Imputed | T | DOM | 383 | 1.719 | 0.2141 | 1.13 | 2.615 | 2.53 | 0.01141 | 0.6453 | 0.21149 | 0.24843 | 0.18527 |
| rs10195401 | Imputed | C | DOM | 377 | 1.766 | 0.2208 | 1.146 | 2.722 | 2.575 | 0.01001 | 0.00985 | 0.35544 | 0.39172 | 0.32955 |
| rs10239416 | Imputed | A | DOM | 381 | 0.5548 | 0.2123 | 0.3659 | 0.8412 | -2.775 | 0.00553 | 0.497 | 0.34646 | 0.29245 | 0.38514 |
| rs1032188 | Imputed | G | GEN | 381 | | | | | 8.656 | 0.01319 | 0.3118 | 0.28084 | 0.2327 | 0.31532 |
| rs1032188 | Imputed | G | REC | 381 | 0.2613 | 0.4645 | 0.1051 | 0.6494 | -2.89 | 0.00386 | 0.3118 | 0.28084 | 0.2327 | 0.31532 |
| rs10468988 | Imputed | G | ADD | 380 | 1.448 | 0.1681 | 1.042 | 2.013 | 2.202 | 0.02767 | 0.3889 | 0.29342 | 0.33228 | 0.26577 |
| rs10478919 | Imputed | C | DOM | 383 | 0.6113 | 0.2097 | 0.4053 | 0.9221 | -2.347 | 0.01893 | 0.4104 | 0.31723 | 0.28302 | 0.34152 |
| rs10506623 | Imputed | C | DOM | 383 | 0.6268 | 0.2197 | 0.4075 | 0.9641 | -2.126 | 0.03347 | 0.133 | 0.39034 | 0.34591 | 0.42188 |
| rs10506626 | Imputed | A | DOM | 371 | 0.5858 | 0.2268 | 0.3756 | 0.9138 | -2.358 | 0.0184 | 0.0525 | 0.40296 | 0.35526 | 0.43607 |
| rs10509477 | Imputed | T | DOM | 383 | 1.367 | 0.2096 | 0.9065 | 2.062 | 1.491 | 0.1358 | 0.4613 | 0.29373 | 0.31761 | 0.27679 |
| rs10511071 | Imputed | C | DOM | 383 | 2.42 | 0.2725 | 1.419 | 4.128 | 3.244 | 0.00118 | 0.3464 | 0.09138 | 0.12893 | 0.06473 |
| rs10511072 | Imputed | C | DOM | 383 | 2.42 | 0.2725 | 1.419 | 4.128 | 3.244 | 0.00118 | 0.3464 | 0.09138 | 0.12893 | 0.06473 |
| rs10511199 | Imputed | G | ADD | 379 | 1.571 | 0.1825 | 1.099 | 2.247 | 2.475 | 0.01331 | 0.3801 | 0.22559 | 0.2707 | 0.19369 |
| rs10513283 | Imputed | G | DOM | 383 | | | | | 3.158 | 0.2061 | 0.4152 | 0.19452 | 0.21384 | 0.1808 |
| rs10520072 | Imputed | T | DOM | 383 | 0.6021 | 0.2099 | 0.3991 | 0.9085 | -2.417 | 0.01564 | 0.7244 | 0.31984 | 0.28302 | 0.34598 |
| rs1065639 | Imputed | C | DOM | 364 | 1.785 | 0.2238 | 1.151 | 2.767 | 2.588 | 0.00965 | 0.08775 | 0.35852 | 0.40523 | 0.32464 |
| rs10733846 | Imputed | G | ADD | 381 | 0.6607 | 0.2049 | 0.4422 | 0.9872 | -2.023 | 0.04308 | 0.3007 | 0.18241 | 0.14968 | 0.20536 |
| rs10733846 | Imputed | G | DOM | 381 | 0.6237 | 0.2255 | 0.4009 | 0.9704 | -2.093 | 0.03632 | 0.3007 | 0.18241 | 0.14968 | 0.20536 |
| rs10737390 | Imputed | T | DOM | 367 | 0.6571 | 0.2203 | 0.4267 | 1.012 | -1.906 | 0.05666 | 0.7431 | 0.39373 | 0.36218 | 0.41706 |
| rs10749293 | Imputed | G | DOM | 382 | 1.379 | 0.2098 | 0.914 | 2.08 | 1.531 | 0.1257 | 0.5373 | 0.29188 | 0.31761 | 0.27354 |
| rs10752159 | Imputed | C | DOM | 382 | 1.921 | 0.2194 | 1.25 | 2.953 | 2.976 | 0.00292 | 0.8691 | 0.19241 | 0.2327 | 0.16368 |
| rs10753760 | Imputed | T | ADD | 374 | 1.478 | 0.1517 | 1.098 | 1.99 | 2.576 | 0.00999 | 0.3803 | 0.37968 | 0.43506 | 0.34091 |
| rs10757887 | Imputed | T | GEN | 374 | | | | | 6.677 | 0.0355 | 0.4152 | 0.37968 | 0.43506 | 0.34091 |
| rs10758326 | Imputed | C | DOM | 383 | 0.5825 | 0.2158 | 0.3816 | 0.8891 | -2.505 | 0.01226 | 0.1637 | 0.24021 | 0.19497 | 0.27232 |
| rs10758326 | Imputed | A | ADD | 382 | | | | | -1.91 | 0.0561 | 0.2409 | 0.39921 | 0.36164 | 0.42601 |
| rs10758326 | Imputed | A | GEN | 382 | 0.7394 | 0.1581 | 0.5424 | 1.008 | 3.771 | 0.1518 | 0.2409 | 0.39921 | 0.36164 | 0.42601 |

TABLE 10-continued

| | | | | | | | | | | |
|---|---|---|---|---|---|---|---|---|---|---|
| rs10758326 | Imputed | A | REC | 382 | 0.6985 | 0.3059 | 0.3835 | 1.272 | -1.173 | 0.2408 | 0.2409 | 0.39921 | 0.36164 | 0.42601 |
| rs10762236 | Genotyped | G | ADD | 383 | 0.6676 | 0.2037 | 0.4479 | 0.9952 | -1.984 | 0.04728 | 0.233 | 0.18277 | 0.15094 | 0.20536 |
| rs10765769 | Imputed | C | ADD | 378 | 1.537 | 0.1636 | 1.115 | 2.118 | 2.627 | 0.00862 | 0.01547 | 0.42725 | 0.48089 | 0.38914 |
| rs10765769 | Imputed | C | GEN | 378 | | | | | 6.932 | 0.03125 | 1.55E-02 | 0.42725 | 0.48089 | 0.38914 |
| rs10784891 | Imputed | C | ADD | 372 | 0.7477 | 0.1606 | 0.5458 | 1.024 | -1.811 | 0.07022 | 0.2351 | 0.40188 | 0.36129 | 0.43088 |
| rs10784891 | Imputed | C | DOM | 372 | 0.5753 | 0.2241 | 0.3708 | 0.8925 | -2.467 | 0.01361 | 0.2351 | 0.40188 | 0.36129 | 0.43088 |
| rs10787923 | Imputed | G | DOM | 383 | 1.391 | 0.2096 | 0.9222 | 2.098 | 1.574 | 0.1155 | 0.5365 | 0.29112 | 0.31761 | 0.27232 |
| rs10787949 | Imputed | A | DOM | 382 | 1.33 | 0.2097 | 0.8818 | 2.006 | 1.36 | 0.1737 | 0.5395 | 0.29581 | 0.32075 | 0.27803 |
| rs10787951 | Imputed | G | DOM | 382 | 1.33 | 0.2097 | 0.8818 | 2.006 | 1.36 | 0.1737 | 0.5395 | 0.29581 | 0.32075 | 0.27803 |
| rs10787983 | Imputed | C | DOM | 382 | 1.351 | 0.2099 | 0.8952 | 2.038 | 1.432 | 0.152 | 0.4588 | 0.29319 | 0.31646 | 0.27679 |
| rs10788380 | Imputed | C | ADD | 377 | 1.299 | 0.1485 | 0.9713 | 1.738 | 1.764 | 0.07781 | 0.6046 | 0.53581 | 0.57643 | 0.50682 |
| rs10788380 | Imputed | C | DOM | 377 | 1.624 | 0.2633 | 0.9695 | 2.721 | 1.842 | 0.06541 | 0.6046 | 0.53581 | 0.57643 | 0.50682 |
| rs10788380 | Imputed | C | GEN | 377 | | | | | 3.622 | 0.1635 | 0.6046 | 0.53581 | 0.57643 | 0.50682 |
| rs10814418 | Imputed | G | DOM | 383 | 0.4711 | 0.3006 | 0.2614 | 0.8493 | -2.503 | 0.0123 | 0.2271 | 0.09138 | 0.06289 | 0.11161 |
| rs10831417 | Imputed | A | ADD | 383 | 1.615 | 0.1632 | 1.173 | 2.224 | 2.937 | 0.00332 | 0.02621 | 0.40862 | 0.46855 | 0.36607 |
| rs10831417 | Imputed | A | GEN | 383 | | | | | 8.69 | 0.01297 | 0.02621 | 0.40862 | 0.46855 | 0.36607 |
| rs10831422 | Imputed | C | ADD | 378 | 1.53 | 0.1629 | 1.112 | 2.106 | 2.611 | 0.00902 | 0.03304 | 0.40212 | 0.4557 | 0.36364 |
| rs10831422 | Imputed | C | DOM | 378 | | | | | 7.075 | 0.02908 | 0.03304 | 0.40212 | 0.4557 | 0.36364 |
| rs10862931 | Imputed | C | GEN | 377 | | | | | 3.939 | 0.1395 | 0.4279 | 0.34748 | 0.30645 | 0.37613 |
| rs10865197 | Imputed | A | DOM | 383 | 1.719 | 0.2141 | 1.13 | 2.615 | 2.53 | 0.01141 | 0.6453 | 0.21149 | 0.24843 | 0.18527 |
| rs10871302 | Imputed | C | DOM | 382 | 1.272 | 0.2475 | 0.7828 | 2.066 | 0.9709 | 0.3316 | 0.8085 | 0.12042 | 0.13836 | 0.10762 |
| rs10877463 | Imputed | A | DOM | 381 | 0.5962 | 0.213 | 0.3927 | 0.9052 | -2.428 | 0.0152 | 0.424 | 0.3399 | 0.30063 | 0.36771 |
| rs10877468 | Imputed | C | DOM | 375 | 0.5825 | 0.2147 | 0.3824 | 0.8872 | -2.518 | 0.01181 | 0.4237 | 0.34133 | 0.3 | 0.37045 |
| rs10879240 | Imputed | C | ADD | 383 | 0.7632 | 0.1542 | 0.5641 | 1.032 | -1.753 | 0.07966 | 0.6 | 0.41775 | 0.37736 | 0.44643 |
| rs10879242 | Imputed | A | DOM | 383 | 0.643 | 0.2198 | 0.418 | 0.9893 | -2.009 | 0.04455 | 0.1989 | 0.39426 | 0.3522 | 0.42411 |
| rs10879245 | Imputed | A | DOM | 383 | 0.643 | 0.2198 | 0.418 | 0.9893 | -2.009 | 0.04455 | 0.1989 | 0.39426 | 0.3522 | 0.42411 |
| rs10879249 | Imputed | T | DOM | 383 | 0.6376 | 0.2187 | 0.4154 | 0.9789 | -2.057 | 0.03964 | 0.1621 | 0.38903 | 0.34591 | 0.41964 |
| rs10886452 | Imputed | A | ADD | 382 | 1.33 | 0.2097 | 0.8818 | 2.006 | 1.36 | 0.1737 | 0.5395 | 0.29581 | 0.32075 | 0.27803 |
| rs10886463 | Imputed | C | DOM | 381 | 1.346 | 0.21 | 0.8919 | 2.032 | 1.415 | 0.157 | 0.3912 | 0.29659 | 0.32075 | 0.27928 |
| rs10886465 | Imputed | A | DOM | 383 | 1.341 | 0.2095 | 0.8897 | 2.022 | 1.402 | 0.161 | 0.3936 | 0.29634 | 0.32075 | 0.27902 |
| rs10886526 | Imputed | C | DOM | 381 | 1.361 | 0.21 | 0.9017 | 2.054 | 1.467 | 0.1423 | 0.3889 | 0.29265 | 0.31646 | 0.27578 |
| rs10902437 | Imputed | G | ADD | 355 | 1.176 | 0.1625 | 0.8556 | 1.618 | 1 | 0.3172 | 0.1268 | 0.41972 | 0.44257 | 0.40338 |
| rs10941126 | Imputed | G | DOM | 383 | 0.235 | 0.778 | 0.05116 | 1.08 | -1.861 | 0.0627 | 1 | 0.01697 | 0.00629 | 0.02455 |
| rs10941126 | Imputed | G | REC | 383 | 0.235 | 0.778 | 0.05116 | 1.08 | -1.861 | 0.0627 | 1 | 0.01697 | 0.00629 | 0.02455 |
| rs10947871 | Imputed | A | ADD | 383 | 1.488 | 0.2326 | 0.9435 | 2.348 | 1.71 | 0.08731 | 0.5442 | 0.14883 | 0.16667 | 0.13616 |
| rs10972978 | Imputed | C | DOM | 383 | 0.4711 | 0.3006 | 0.2614 | 0.8493 | -2.503 | 0.0123 | 0.2271 | 0.09138 | 0.06289 | 0.11161 |
| rs10973012 | Imputed | A | ADD | 383 | 0.4711 | 0.3006 | 0.2614 | 0.8493 | -2.503 | 0.0123 | 0.2271 | 0.09138 | 0.06289 | 0.11161 |
| rs10974028 | Genotyped | G | ADD | 383 | 0.6345 | 0.2091 | 0.4211 | 0.956 | -2.175 | 0.02963 | 0.5604 | 0.15666 | 0.12264 | 0.1808 |
| rs10974028 | Genotyped | G | DOM | 383 | 0.5711 | 0.2392 | 0.3573 | 0.9127 | -2.342 | 0.01918 | 0.5604 | 0.15666 | 0.12264 | 0.1808 |
| rs11021302 | Imputed | A | ADD | 378 | 1.53 | 0.1629 | 1.112 | 2.106 | 2.611 | 0.00902 | 0.03304 | 0.40212 | 0.4557 | 0.36364 |
| rs11021302 | Imputed | A | GEN | 378 | | | | | 7.075 | 0.02908 | 0.03304 | 0.40212 | 0.4557 | 0.36364 |
| rs11099644 | Imputed | G | REC | 382 | 2.201 | 0.2868 | 1.254 | 3.861 | 2.75 | 0.00596 | 0.8317 | 0.40052 | 0.45912 | 0.35874 |
| rs11138315 | Imputed | A | ADD | 364 | 0.5496 | 0.2588 | 0.3309 | 0.9128 | -2.313 | 0.02075 | 0.4098 | 0.10852 | 0.07566 | 0.13208 |
| rs11149802 | Imputed | T | DOM | 382 | 1.272 | 0.2475 | 0.7828 | 2.066 | 0.9709 | 0.3316 | 0.8085 | 0.12042 | 0.13836 | 0.10762 |
| rs11116596 | Imputed | T | DOM | 383 | 0.6113 | 0.2097 | 0.4053 | 0.9221 | -2.347 | 0.01893 | 0.4104 | 0.31723 | 0.28302 | 0.34152 |
| rs11178531 | Imputed | A | ADD | 381 | 0.778 | 0.1538 | 0.5755 | 1.052 | -1.632 | 0.1027 | 0.5321 | 0.42913 | 0.39172 | 0.45536 |
| rs11178531 | Imputed | A | DOM | 381 | 0.5967 | 0.2247 | 0.3841 | 0.9269 | -2.298 | 0.02156 | 0.5321 | 0.42913 | 0.39172 | 0.45536 |
| rs11178575 | Imputed | G | GEN | 382 | | | | | 2.149 | 0.3415 | 0.6639 | 0.37696 | 0.39937 | 0.36099 |
| rs11021302 | Imputed | C | REC | 382 | 1.549 | 0.3014 | 0.8578 | 2.796 | 1.451 | 0.1468 | 0.6635 | 0.40212 | 0.4557 | 0.36364 |
| rs11099644 | Imputed | A | GEN | 383 | | | | | 2.22 | 0.3296 | 0.6635 | 0.45912 | 0.45912 | 0.35874 |
| rs11178577 | Imputed | T | REC | 383 | 1.557 | 0.3014 | 0.8625 | 2.811 | 1.469 | 0.1418 | 0.6635 | 0.37728 | 0.39937 | 0.36161 |
| rs11178583 | Imputed | A | DOM | 383 | 0.6376 | 0.2187 | 0.4154 | 0.9789 | -2.057 | 0.03964 | 0.1621 | 0.38903 | 0.34591 | 0.41964 |
| rs11178589 | Imputed | T | DOM | 382 | 0.6428 | 0.2192 | 0.4183 | 0.9878 | -2.016 | 0.0438 | 0.1627 | 0.38874 | 0.34591 | 0.41928 |

TABLE 10-continued

| | | | | | | | | | | |
|---|---|---|---|---|---|---|---|---|---|---|
| rs11178594 | Imputed | DOM | C | 383 | 0.6253 | 0.2193 | 0.4068 | 0.9611 | -2.141 | 0.0323 | 0.133 | 0.39034 | 0.34591 | 0.42188 |
| rs11178602 | Imputed | DOM | T | 383 | 0.6388 | 0.2193 | 0.4159 | 0.9811 | -2.047 | 0.04066 | 0.1621 | 0.38903 | 0.34591 | 0.41964 |
| rs11178648 | Imputed | DOM | T | 382 | 0.5988 | 0.2187 | 0.3901 | 0.9193 | -2.345 | 0.01904 | 0.2351 | 0.38613 | 0.33861 | 0.41964 |
| rs11198877 | Imputed | DOM | T | 382 | 1.33 | 0.2097 | 0.8818 | 2.006 | 1.36 | 0.1737 | 0.5395 | 0.29581 | 0.32075 | 0.27803 |
| rs11198942 | Imputed | DOM | T | 383 | 1.367 | 0.2096 | 0.9065 | 2.062 | 1.491 | 0.1358 | 0.4613 | 0.29373 | 0.31761 | 0.27679 |
| rs11221075 | Imputed | ADD | A | 378 | 0.7098 | 0.2323 | 0.4502 | 1.119 | -1.475 | 0.1401 | 1 | 0.12434 | 0.1051 | 0.13801 |
| rs11242020 | Imputed | DOM | T | 382 | 0.6024 | 0.2102 | 0.399 | 0.9096 | -2.411 | 0.01591 | 0.4079 | 0.31675 | 0.28165 | 0.34152 |
| rs11242021 | Imputed | DOM | T | 381 | 0.602 | 0.2105 | 0.3986 | 0.9094 | -2.411 | 0.01591 | 0.7248 | 0.32152 | 0.28481 | 0.34753 |
| rs11242022 | Imputed | DOM | T | 380 | 0.617 | 0.2103 | 0.4086 | 0.9318 | -2.296 | 0.02168 | 1 | 0.31316 | 0.27987 | 0.3371 |
| rs11242023 | Imputed | DOM | T | 379 | 0.6116 | 0.2108 | 0.4046 | 0.9244 | -2.333 | 0.01964 | 0.7243 | 0.31926 | 0.28481 | 0.34389 |
| rs1149350 | Imputed | DOM | A | 382 | 1.97 | 0.2254 | 1.266 | 3.065 | 3.007 | 0.00264 | 0.05226 | 0.17801 | 0.22327 | 0.14574 |
| rs1150143 | Imputed | DOM | G | 379 | 1.782 | 0.2127 | 1.175 | 2.704 | 2.717 | 0.00659 | 0.128 | 0.32586 | 0.38217 | 0.28604 |
| rs11576627 | Imputed | ADD | T | 383 | 1.437 | 0.2014 | 0.9684 | 2.132 | 1.8 | 0.0718 | 0.2168 | 0.14491 | 0.17296 | 0.125 |
| rs11576627 | Imputed | DOM | T | 383 | 1.496 | 0.2351 | 0.9433 | 2.371 | 1.712 | 0.08693 | 0.2168 | 0.14491 | 0.17296 | 0.125 |
| rs11602189 | Imputed | DOM | A | 374 | 0.5948 | 0.2142 | 0.3909 | 0.905 | -2.426 | 0.01527 | 1 | 0.31818 | 0.27124 | 0.35068 |
| rs11605163 | Imputed | DOM | A | 376 | 2.186 | 0.3185 | 1.171 | 4.08 | 2.455 | 0.01408 | 0.3822 | 0.0625 | 0.08654 | 0.04545 |
| rs11615214 | Imputed | ADD | G | 382 | 0.7639 | 0.1532 | 0.5657 | 1.032 | -1.758 | 0.07882 | 1 | 0.38874 | 0.35127 | 0.41518 |
| rs11615214 | Imputed | GEN | G | 382 | | | | | 3.652 | 0.161 | | 0.38874 | 0.35127 | 0.41518 |
| rs11642394 | Imputed | DOM | C | 383 | 1.277 | 0.2476 | 0.7859 | 2.074 | 0.9866 | 0.3238 | 0.8082 | 0.1201 | 0.13836 | 0.10714 |
| rs11644943 | Imputed | ADD | A | 380 | 1.606 | 0.1767 | 1.136 | 2.27 | 2.68 | 0.00736 | 0.7774 | 0.23816 | 0.28616 | 0.20362 |
| rs11656608 | Imputed | DOM | T | 383 | 0.7037 | 0.2279 | 0.4502 | 1.1 | -1.542 | 0.1231 | 0.8589 | 0.17363 | 0.15409 | 0.1875 |
| rs11661309 | Imputed | ADD | A | 383 | 0.5977 | 0.199 | 0.4046 | 0.8827 | -2.587 | 0.00969 | 0.1541 | 0.17493 | 0.13208 | 0.20536 |
| rs11661309 | Imputed | DOM | A | 383 | 0.5564 | 0.2336 | 0.352 | 0.8796 | -2.509 | 0.01211 | 0.1541 | 0.17493 | 0.13208 | 0.20536 |
| rs11666131 | Imputed | ADD | A | 382 | 1.578 | 0.1755 | 1.119 | 2.226 | 2.6 | 0.00931 | 0.2905 | 0.21466 | 0.26266 | 0.1808 |
| rs11743355 | Imputed | DOM | C | 379 | 0.2291 | 0.7784 | 0.04984 | 1.054 | -1.893 | 0.05836 | 1 | 0.01715 | 0.00629 | 0.025 |
| rs11743355 | Imputed | DOM | C | 379 | 0.2291 | 0.7784 | 0.04984 | 1.054 | -1.893 | 0.05836 | 1 | 0.01715 | 0.00629 | 0.025 |
| rs11746806 | Imputed | DOM | T | 383 | 0.235 | 0.778 | 0.05116 | 1.08 | -1.861 | 0.0627 | 1 | 0.01697 | 0.00629 | 0.02455 |
| rs11746806 | Imputed | DOM | T | 383 | 0.235 | 0.778 | 0.05116 | 1.08 | -1.861 | 0.0627 | 1 | 0.01697 | 0.00629 | 0.02455 |
| rs11746959 | Imputed | DOM | T | 383 | 0.235 | 0.778 | 0.05116 | 1.08 | -1.861 | 0.0627 | 1 | 0.01697 | 0.00629 | 0.02455 |
| rs11746959 | Imputed | DOM | T | 383 | 0.235 | 0.778 | 0.05116 | 1.08 | -1.861 | 0.0627 | 1 | 0.01697 | 0.00629 | 0.02455 |
| rs11749272 | Imputed | DOM | T | 383 | 0.6113 | 0.2097 | 0.4053 | 0.9221 | -2.347 | 0.01893 | 0.4104 | 0.31723 | 0.28302 | 0.34152 |
| rs11901899 | Imputed | DOM | A | 378 | 1.83 | 0.2121 | 1.208 | 2.774 | 2.851 | 0.00436 | 0.1985 | 0.27646 | 0.33333 | 0.23649 |
| rs11926319 | Imputed | ADD | G | 380 | 0.3536 | 0.2967 | 0.1977 | 0.6325 | -3.504 | 0.00046 | 1 | 0.09868 | 0.05414 | 0.13004 |
| rs11926319 | Imputed | DOM | G | 380 | 0.3514 | 0.3031 | 0.194 | 0.6364 | -3.451 | 0.00056 | 1 | 0.09868 | 0.05414 | 0.13004 |
| rs11956952 | Imputed | DOM | C | 378 | 0.7003 | 0.2121 | 0.4621 | 1.061 | -1.679 | 0.09313 | 0.2413 | 0.26984 | 0.25478 | 0.28054 |
| rs12025826 | Imputed | DOM | G | 377 | 1.354 | 0.2159 | 0.8867 | 2.067 | 1.403 | 0.1607 | 0.1274 | 0.38462 | 0.39809 | 0.375 |
| rs1204522 | Imputed | GEN | C | 378 | | | | | 3.915 | 0.1412 | 0.58 | 0.36243 | 0.32595 | 0.38864 |
| rs1204524 | Imputed | GEN | A | 378 | | | | | 3.758 | 0.1527 | 0.5784 | 0.36376 | 0.32803 | 0.38914 |
| rs121153185 | Imputed | DOM | T | 379 | 0.6022 | 0.2112 | 0.398 | 0.911 | -2.401 | 0.01634 | 0.724 | 0.3219 | 0.28526 | 0.34753 |
| rs12182651 | Imputed | ADD | T | 383 | 2.387 | 0.3056 | 1.311 | 4.345 | 2.847 | 0.00442 | 0.1765 | 0.06283 | 0.09494 | 0.04018 |
| rs12182651 | Imputed | DOM | T | 383 | 2.904 | 0.3322 | 1.514 | 5.569 | 3.209 | 0.00133 | 0.1765 | 0.06283 | 0.09494 | 0.04018 |
| rs12193568 | Imputed | DOM | G | 382 | 2.406 | 0.3051 | 1.323 | 4.375 | 2.878 | 0.00401 | 0.2704 | 0.13713 | 0.18557 | 0.10357 |
| rs12264914 | Imputed | DOM | G | 237 | 0.7523 | 0.29 | 0.4261 | 1.328 | -0.9814 | 0.3264 | 0.7359 | 0.29167 | 0.2625 | 0.31048 |
| rs12307767 | Imputed | DOM | C | 204 | 0.5633 | 0.2206 | 0.3656 | 0.868 | -2.602 | 0.00928 | 0.4648 | 0.32102 | 0.27931 | 0.35024 |
| rs1232298 | Imputed | REC | C | 352 | 2.839 | 0.3328 | 1.479 | 5.45 | 3.135 | 0.00172 | 0.2379 | 0.32661 | 0.37742 | 0.29032 |
| rs12407412 | Imputed | ADD | C | 383 | 1.437 | 0.2014 | 0.9684 | 2.132 | 1.8 | 0.0718 | 0.2168 | 0.14491 | 0.17296 | 0.125 |
| rs12407412 | Imputed | DOM | C | 383 | 1.496 | 0.2351 | 0.9433 | 2.371 | 1.712 | 0.08693 | 0.2168 | 0.14491 | 0.17296 | 0.125 |
| rs12420184 | Imputed | DOM | G | 382 | 0.6069 | 0.2381 | 0.3805 | 0.9678 | -2.097 | 0.03596 | 0.1285 | 0.16099 | 0.1195 | 0.19058 |
| rs12422750 | Imputed | DOM | A | 383 | 0.5915 | 0.2116 | 0.3907 | 0.8956 | -2.481 | 0.0131 | 0.2019 | 0.32637 | 0.28616 | 0.35491 |
| rs12446951 | Imputed | ADD | A | 266 | 3.123 | 0.3652 | 1.526 | 6.388 | 3.118 | 0.00182 | 0.1047 | 0.06767 | 0.11429 | 0.03727 |
| rs12446951 | Imputed | DOM | A | 266 | 3.166 | 0.3883 | 1.479 | 6.776 | 2.968 | 0.003 | 0.1047 | 0.06767 | 0.11429 | 0.03727 |
| rs12457400 | Imputed | DOM | G | 383 | 0.6578 | 0.2682 | 0.3889 | 1.113 | -1.562 | 0.1183 | 0.7834 | 0.10444 | 0.08491 | 0.1183 |
| rs1247340 | Imputed | DOM | C | 383 | 1.98 | 0.2254 | 1.273 | 3.079 | 3.03 | 0.00244 | 0.07793 | 0.17624 | 0.22327 | 0.14286 |

TABLE 10-continued

| | | | | | | | | | | |
|---|---|---|---|---|---|---|---|---|---|---|
| rs1247341 | Imputed | C | DOM | 382 | 2.017 | 0.2261 | 1.295 | 3.103 | 0.07501 | 0.17539 | 0.22327 | 0.14126 |
| rs12521291 | Imputed | G | ADD | 380 | 0.6882 | 0.1569 | 0.506 | 0.9361 | 0.6567 | 0.35921 | 0.3121 | 0.39238 |
| rs12526849 | Imputed | T | ADD | 380 | 1.357 | 0.1432 | 1.025 | 2.132 | 0.04681 | 0.42763 | 0.47484 | 0.39367 |
| rs12528849 | Imputed | T | GEN | 380 | | | | 5.531 | 0.04681 | 0.42763 | 0.47484 | 0.39367 |
| rs12543110 | Imputed | G | DOM | 383 | 1.832 | 0.2138 | 1.205 | 2.832 | 0.06295 | 0.22454 | 0.28302 | 0.18304 |
| rs12678600 | Imputed | A | DOM | 381 | 0.5988 | 0.211 | 0.396 | -2.43 | 0.4624 | 0.33202 | 0.28616 | 0.36486 |
| rs12719415 | Imputed | T | DOM | 383 | 0.6021 | 0.2099 | 0.3991 | 0.9055 | 0.9081 | 0.31984 | 0.28302 | 0.34598 |
| rs12831292 | Imputed | G | DOM | 382 | 0.643 | 0.219 | 0.4186 | 0.9085 | 0.01509 | 0.38874 | 0.34591 | 0.41928 |
| rs12923993 | Imputed | C | DOM | 383 | 1.277 | 0.2476 | 0.7859 | 0.9878 | 0.01564 | 0.1201 | 0.13836 | 0.10714 |
| rs12936964 | Imputed | T | DOM | 380 | 1.581 | 0.2211 | 1.025 | 2.074 | 0.04381 | 0.38553 | 0.40823 | 0.36937 |
| rs12960663 | Imputed | G | DOM | 383 | 0.5977 | 0.199 | 0.4046 | 2.439 | 0.3238 | 0.3863 | 0.13208 | 0.20536 |
| rs13038146 | Imputed | C | ADD | 383 | 1.429 | 0.1494 | 1.066 | 0.8827 | 0.03817 | 0.17493 | 0.40566 | 0.32366 |
| rs13038146 | Imputed | C | GEN | 383 | | | | 1.915 | 0.00969 | 0.3577 | 0.40566 | 0.32366 |
| rs13134222 | Imputed | A | DOM | 382 | 0.6946 | 0.212 | 0.4585 | 6.537 | 0.01695 | 0.3577 | 0.18553 | 0.26233 |
| rs13172910 | Imputed | A | ADD | 379 | 2.378 | 0.3248 | 1.258 | 6.996 | 0.03806 | 0.23037 | 0.25478 | 0.28153 |
| rs13194907 | Imputed | A | DOM | 383 | 2.64 | 0.3358 | 1.367 | -1.719 | 0.03026 | 0.27045 | 0.08491 | 0.03795 |
| rs13194907 | Imputed | A | ADD | 383 | 2.378 | 0.3248 | 1.258 | 2.668 | 0.08561 | 0.05744 | 0.08491 | 0.03795 |
| rs13195745 | Imputed | A | DOM | 383 | 2.64 | 0.3358 | 1.367 | 2.891 | 0.00763 | 0.05744 | 0.08491 | 0.03795 |
| rs13195745 | Imputed | A | ADD | 383 | 2.64 | 0.3358 | 1.367 | 2.668 | 0.00384 | 0.05744 | 0.08491 | 0.03795 |
| rs1321432 | Imputed | A | REC | 383 | 1.784 | 0.3115 | 0.9689 | 2.891 | 0.00763 | 0.05744 | 0.08491 | 0.03795 |
| rs1321457 | Imputed | G | REC | 383 | 1.704 | 0.3084 | 0.9308 | 3.286 | 0.00384 | 0.05744 | 0.39308 | 0.35714 |
| rs13265054 | Imputed | T | DOM | 381 | 0.5995 | 0.211 | 0.3965 | 1.728 | 0.0631 | 0.37206 | 0.38679 | 0.35268 |
| rs13282131 | Imputed | C | GEN | 383 | | | | 3.118 | 0.08407 | 0.36684 | 0.28616 | 0.36486 |
| rs13353526 | Imputed | C | DOM | 383 | 2.299 | 0.2671 | 1.362 | 0.9065 | 0.01529 | 0.33202 | 0.51887 | 0.4442 |
| rs1336382 | Imputed | T | DOM | 383 | 1.367 | 0.2096 | 0.9065 | 3.881 | 0.00183 | 0.4752 | 0.13208 | 0.0692 |
| rs1336383 | Imputed | T | DOM | 383 | 1.367 | 0.2096 | 0.9065 | 2.062 | 0.1358 | 0.3575 | 0.31761 | 0.27679 |
| rs1336407 | Imputed | T | DOM | 383 | 1.367 | 0.2096 | 0.9065 | 2.062 | 0.1358 | 0.0953 | 0.31761 | 0.27679 |
| rs1336409 | Imputed | T | DOM | 382 | 1.355 | 0.2098 | 0.8985 | 2.062 | 0.1358 | 0.2945 | 0.31761 | 0.27679 |
| rs1336596 | Imputed | A | DOM | 380 | 0.6528 | 0.2133 | 0.4297 | 1.45 | 0.1471 | 0.29373 | 0.32595 | 0.27803 |
| rs1343560 | Imputed | T | ADD | 383 | 0.5758 | 0.2661 | 0.3418 | -2 | 0.04554 | 0.29373 | 0.06918 | 0.37838 |
| rs1343560 | Imputed | T | DOM | 383 | 0.554 | 0.2856 | 0.3166 | -2.074 | 0.03805 | 0.35658 | 0.06918 | 0.11607 |
| rs1361987 | Imputed | T | GEN | 383 | | | | -2.068 | 0.03864 | 0.09661 | 0.3239 | 0.11607 |
| rs1386153 | Imputed | T | ADD | 379 | 0.6655 | 0.164 | 0.4826 | 3.272 | 0.1948 | 0.09661 | 0.26752 | 0.3817 |
| rs1386153 | Imputed | T | DOM | 379 | 0.5913 | 0.212 | 0.3902 | -2.484 | 0.01299 | 0.3577 | 0.26752 | 0.35135 |
| rs1394015 | Imputed | C | DOM | 356 | 1.898 | 0.243 | 1.179 | -2.478 | 0.01321 | 0.31662 | 0.47569 | 0.35135 |
| rs1407038 | Imputed | A | REC | 379 | 1.717 | 0.3085 | 0.9381 | 2.637 | 0.00837 | 0.31662 | 0.38608 | 0.37972 |
| rs1407039 | Imputed | A | REC | 379 | 1.715 | 0.3088 | 0.9365 | 1.753 | 0.07963 | 0.41854 | 0.38854 | 0.35648 |
| rs1412802 | Imputed | T | GEN | 381 | | | | 3.144 | 0.08054 | 0.36649 | 0.2327 | 0.35811 |
| rs1414865 | Imputed | T | DOM | 382 | 1.33 | 0.2097 | 0.8818 | 3.142 | 0.06914 | 0.37071 | 0.32075 | 0.30405 |
| rs1414873 | Imputed | A | DOM | 383 | 1.367 | 0.2096 | 0.9065 | 2.006 | 0.3707 | 0.27428 | 0.31761 | 0.27803 |
| rs1414876 | Imputed | C | DOM | 383 | 1.367 | 0.2096 | 0.9065 | 2.062 | 0.1737 | 0.29581 | 0.31761 | 0.27679 |
| rs1418671 | Imputed | C | REC | 377 | 2.067 | 0.2706 | 1.216 | 2.684 | 0.1358 | 0.29373 | 0.4557 | 0.27679 |
| rs1419490 | Genotyped | T | GEN | 383 | | | | 3.125 | 0.00728 | 0.43236 | 0.3239 | 0.41553 |
| rs1434507 | Imputed | A | ADD | 381 | 1.405 | 0.1664 | 1.014 | 2.044 | 0.2096 | 0.3564 | 0.33019 | 0.37946 |
| rs1434508 | Imputed | T | ADD | 382 | 1.399 | 0.1663 | 1.01 | 1.938 | 0.04098 | 0.29396 | 0.33019 | 0.26802 |
| rs1435205 | Imputed | A | ADD | 379 | 1.571 | 0.1825 | 1.099 | 2.247 | 0.04355 | 0.2945 | 0.2707 | 0.26906 |
| rs1443928 | Imputed | C | REC | 380 | 0.5055 | 0.2469 | 0.3116 | -2.763 | 0.01331 | 0.22559 | 0.43671 | 0.19369 |
| rs1452235 | Imputed | G | GEN | 383 | | | | | 0.00572 | 0.51579 | 0.31132 | 0.57207 |
| rs1452236 | Imputed | G | GEN | 383 | | | | 4.025 | 0.1337 | 0.35248 | 0.31132 | 0.3817 |
| rs1452237 | Imputed | G | GEN | 383 | | | | 4.025 | 0.1337 | 0.35248 | 0.31132 | 0.3817 |
| rs1452243 | Genotyped | T | GEN | 383 | | | | 4.025 | 0.1337 | 0.35248 | 0.31132 | 0.3817 |
| rs1463768 | Genotyped | G | REC | 383 | 2.557 | 0.2969 | 1.429 | 3.162 | 0.00157 | 0.38251 | 0.41195 | 0.36161 |
| rs1463769 | Imputed | G | REC | 383 | 2.557 | 0.2969 | 1.429 | 3.162 | 0.00157 | 0.38251 | 0.41195 | 0.36161 |

TABLE 10-continued

| | | | | | | | | | | | | |
|---|---|---|---|---|---|---|---|---|---|---|---|---|
| rs1472435 | Imputed | A | ADD | 374 | 0.3624 | 0.3387 | 0.1866 | 0.704 | -2.996 | 0.2433 | 0.07353 | 0.0414 | 0.09677 |
| rs1472435 | Imputed | A | DOM | 374 | 0.3624 | 0.3387 | 0.1866 | 0.704 | -2.996 | 0.2433 | 0.07353 | 0.0414 | 0.09677 |
| rs1476714 | Imputed | A | DOM | 381 | 0.5994 | 0.2104 | 0.3969 | 0.9054 | -2.432 | 0.6369 | 0.3189 | 0.28165 | 0.34529 |
| rs1495159 | Imputed | G | ADD | 377 | 0.6292 | 0.1647 | 0.4556 | 0.8688 | -2.814 | 0.01409 | 0.27454 | 0.21935 | 0.31306 |
| rs1495159 | Imputed | G | GEN | 377 | | | | | 8.035 | 0.0049 | 0.27454 | 0.21935 | 0.31306 |
| rs1495375 | Imputed | A | DOM | 383 | 0.643 | 0.2198 | 0.418 | 0.9893 | -2.009 | 0.018 | 0.39426 | 0.3522 | 0.42411 |
| rs1495376 | Imputed | T | DOM | 371 | 0.4469 | 0.2418 | 0.2782 | 0.7178 | -3.331 | 0.04455 | 0.47844 | 0.43182 | 0.51152 |
| rs1495377 | Imputed | G | DOM | 370 | 0.4491 | 0.2417 | 0.2797 | 0.7213 | -3.312 | 0.00086 | 0.47838 | 0.43182 | 0.51157 |
| rs1495381 | Imputed | T | GEN | 383 | | | | | 5.394 | 0.00093 | 0.43473 | 0.46541 | 0.41295 |
| rs1495381 | Imputed | T | REC | 383 | 1.786 | 0.2638 | 1.065 | 2.996 | 2.199 | 0.06741 | 0.43473 | 0.46541 | 0.41295 |
| rs1498992 | Imputed | G | DOM | 383 | 0.6967 | 0.2093 | 0.4622 | 1.05 | -1.727 | 0.07553 | 0.29373 | 0.27358 | 0.30804 |
| rs1499001 | Imputed | T | DOM | 378 | 0.6855 | 0.2116 | 0.4528 | 1.038 | -1.784 | 0.08421 | 0.2619 | 0.24214 | 0.27626 |
| rs1512988 | Imputed | A | DOM | 380 | 0.6145 | 0.2204 | 0.3989 | 0.9466 | -2.209 | 0.5379 | 0.39079 | 0.34494 | 0.42342 |
| rs1512989 | Imputed | T | DOM | 380 | 0.6145 | 0.2204 | 0.3989 | 0.9466 | -2.209 | 0.352 | 0.39079 | 0.34494 | 0.42342 |
| rs1512991 | Imputed | T | ADD | 382 | 0.7489 | 0.1551 | 0.5526 | 1.015 | -1.864 | 0.161 | 0.41623 | 0.37342 | 0.44643 |
| rs1512991 | Imputed | T | DOM | 382 | 0.571 | 0.2227 | 0.3691 | 0.8835 | -2.516 | 0.5292 | 0.41623 | 0.37342 | 0.44643 |
| rs1516855 | Imputed | G | REC | 382 | 2.635 | 0.3326 | 1.373 | 5.056 | 2.913 | 0.06235 | 0.35864 | 0.38679 | 0.33857 |
| rs1527450 | Imputed | T | ADD | 383 | 1.615 | 0.1632 | 1.173 | 2.224 | 2.937 | 0.01186 | 0.40862 | 0.46855 | 0.36607 |
| rs1527450 | Imputed | T | GEN | 383 | | | | | 8.69 | 0.00358 | 0.40862 | 0.46855 | 0.36607 |
| rs1567740 | Imputed | T | DOM | 381 | 0.6186 | 0.2199 | 0.402 | 0.9518 | -2.185 | 0.00332 | 0.39108 | 0.34591 | 0.42342 |
| rs1572573 | Imputed | A | ADD | 362 | 1.424 | 0.201 | 0.9603 | 2.112 | 1.759 | 0.01297 | 0.18646 | 0.21622 | 0.16589 |
| rs1572573 | Imputed | A | DOM | 362 | 1.608 | 0.2249 | 1.035 | 2.498 | 2.112 | 0.02891 | 0.18646 | 0.21622 | 0.16589 |
| rs1584003 | Imputed | C | DOM | 380 | 1.619 | 0.2537 | 0.9846 | 2.661 | 1.899 | 0.07865 | 0.49605 | 0.52548 | 0.47534 |
| rs1584005 | Imputed | C | DOM | 380 | 1.619 | 0.2537 | 0.9846 | 2.661 | 1.899 | 0.03472 | 0.49605 | 0.52548 | 0.47534 |
| rs1585771 | Imputed | G | ADD | 382 | 1.485 | 0.1701 | 1.064 | 2.073 | 2.325 | 0.05761 | 0.27225 | 0.31646 | 0.24107 |
| rs1592015 | Imputed | T | DOM | 383 | 0.6821 | 0.2397 | 0.4264 | 1.091 | -1.596 | 0.05761 | 0.15013 | 0.12579 | 0.16741 |
| rs1594885 | Imputed | G | DOM | 380 | 1.429 | 0.1671 | 1.03 | 1.983 | 2.138 | 0.02005 | 0.29737 | 0.33544 | 0.27027 |
| rs1603232 | Imputed | A | DOM | 370 | 0.4692 | 0.2395 | 0.2935 | 0.7503 | -3.159 | 0.1105 | 0.47432 | 0.43137 | 0.50461 |
| rs1614565 | Imputed | A | DOM | 372 | 0.4727 | 0.2424 | 0.2939 | 0.7602 | -3.091 | 0.03253 | 0.48253 | 0.44156 | 0.51147 |
| rs1648200 | Imputed | C | ADD | 363 | 1.513 | 0.1861 | 1.05 | 2.179 | 2.224 | 0.00158 | 0.25207 | 0.29333 | 0.223 |
| rs16877387 | Imputed | C | DOM | 382 | | | | | 6.901 | 0.00199 | 0.37304 | 0.40506 | 0.35045 |
| rs16877387 | Imputed | C | REC | 382 | 2.182 | 0.3041 | 1.202 | 3.961 | 2.566 | 0.03174 | 0.37304 | 0.40506 | 0.35045 |
| rs16938626 | Imputed | G | DOM | 382 | 0.5784 | 0.2111 | 0.3825 | 0.8747 | -2.594 | 0.02618 | 0.27618 | 0.23101 | 0.30804 |
| rs1694334 | Imputed | G | ADD | 351 | 0.6042 | 0.1961 | 0.4114 | 0.8874 | -2.569 | 0.01029 | 0.21225 | 0.16443 | 0.24752 |
| rs16998821 | Imputed | C | DOM | 383 | 0.6821 | 0.2397 | 0.4264 | 1.091 | -1.596 | 0.00948 | 0.15013 | 0.12579 | 0.16741 |
| rs1700400 | Imputed | T | ADD | 362 | 0.5776 | 0.1758 | 0.4093 | 0.8151 | -3.123 | 0.8277 | 0.25552 | 0.19156 | 0.30288 |
| rs17007620 | Imputed | C | ADD | 363 | 1.653 | 0.1777 | 1.167 | 2.341 | 2.828 | 0.01019 | 0.24656 | 0.3 | 0.20892 |
| rs17007620 | Imputed | C | DOM | 363 | 1.767 | 0.2175 | 1.154 | 2.707 | 2.619 | 0.1105 | 0.24656 | 0.3 | 0.20892 |
| rs17023290 | Imputed | G | DOM | 383 | 2.42 | 0.2725 | 1.419 | 4.128 | 3.244 | 0.00179 | 0.09138 | 0.12893 | 0.06473 |
| rs17047957 | Imputed | C | DOM | 383 | 1.726 | 0.2428 | 1.073 | 2.778 | 2.249 | 0.00468 | 0.12924 | 0.16352 | 0.10491 |
| rs1705237 | Imputed | A | DOM | 369 | 0.4663 | 0.2431 | 0.2895 | 0.7508 | -3.139 | 0.00883 | 0.48238 | 0.44079 | 0.51152 |
| rs1705261 | Imputed | A | GEN | 383 | | | | | 5.394 | 0.00118 | 0.43473 | 0.46541 | 0.41295 |
| rs1705261 | Imputed | A | REC | 383 | 1.786 | 0.2638 | 1.065 | 2.996 | 2.199 | 0.0017 | 0.43473 | 0.46541 | 0.41295 |
| rs17076972 | Imputed | C | ADD | 383 | 1.44 | 0.1509 | 1.071 | 1.935 | 2.416 | 0.06741 | 0.46736 | 0.51887 | 0.4308 |
| rs17076972 | Imputed | C | DOM | 383 | | | | | 6.553 | 0.02786 | 0.46736 | 0.51887 | 0.4308 |
| rs17076972 | Imputed | C | REC | 383 | 1.85 | 0.2521 | 1.128 | 3.032 | 2.439 | 0.01568 | 0.3577 | 0.40566 | 0.32366 |
| rs17189710 | Imputed | T | ADD | 383 | 1.429 | 0.1494 | 1.066 | 1.915 | 2.388 | 0.03777 | 0.3577 | 0.40566 | 0.32366 |
| rs17196143 | Imputed | A | GEN | 383 | | | | | 6.537 | 0.01473 | 0.1893 | 0.22956 | 0.16071 |
| rs17353809 | Imputed | G | ADD | 383 | 1.543 | 0.1879 | 1.068 | 2.231 | 2.308 | 0.01695 | 0.23037 | 0.27848 | 0.19643 |
| rs17368986 | Imputed | A | ADD | 382 | 1.616 | 0.1806 | 1.134 | 2.302 | 2.658 | 0.03806 | 0.19423 | 0.21384 | 0.18018 |
| rs17369097 | Imputed | A | GEN | 381 | | | | | 3.069 | 0.02098 | 0.19713 | 0.21698 | 0.18304 |
| rs17434511 | Imputed | C | GEN | 383 | | | | | 4.104 | 0.00786 | 0.19452 | 0.21384 | 0.1808 |
| | | | | | | | | | 3.158 | 0.2155 | | | |
| | | | | | | | | | | 0.1285 | | | |
| | | | | | | | | | | 0.2061 | | | |

TABLE 10-continued

| | | | | | | | | | | | | |
|---|---|---|---|---|---|---|---|---|---|---|---|---|
| rs17434589 | Imputed | C | GEN | 376 | 0.6878 | 0.2135 | 0.4526 | 1.045 | 3.386 | 0.4114 | 0.19548 | 0.2129 | 0.18326 |
| rs17434603 | Imputed | G | GEN | 383 | | | | | 3.158 | 0.4152 | 0.19452 | 0.21384 | 0.1808 |
| rs17434840 | Imputed | C | GEN | 383 | | | | | 4.104 | 0.3319 | 0.19713 | 0.21698 | 0.18304 |
| rs17446418 | Imputed | G | DOM | 382 | 0.6878 | 0.2135 | 0.4526 | 1.045 | −1.753 | 0.07956 | 0.38089 | 0.34906 | 0.40359 |
| rs17553747 | Imputed | T | DOM | 382 | 0.6878 | 0.2135 | 0.4526 | 1.045 | −1.753 | 0.07956 | 0.38089 | 0.34906 | 0.40359 |
| rs17604285 | Imputed | C | ADD | 383 | 0.4148 | 0.2819 | 0.2387 | 0.7208 | −3.122 | 0.0018 | 0.10183 | 0.06289 | 0.12946 |
| rs17604285 | Imputed | C | DOM | 383 | 0.4153 | 0.2867 | 0.2368 | 0.7285 | −3.065 | 0.00218 | 0.10183 | 0.06289 | 0.12946 |
| rs17662322 | Imputed | T | DOM | 383 | 0.6835 | 0.2193 | 0.4447 | 1.05 | −1.735 | 0.08267 | 0.19974 | 0.17296 | 0.21875 |
| rs17769826 | Imputed | T | ADD | 382 | 1.616 | 0.1806 | 1.134 | 2.302 | 2.658 | 0.00786 | 0.23037 | 0.27848 | 0.19643 |
| rs17821641 | Imputed | T | ADD | 379 | 1.571 | 0.1825 | 1.099 | 2.247 | 2.475 | 0.01331 | 0.22559 | 0.2707 | 0.19369 |
| rs1782328 | Imputed | A | ADD | 356 | 0.5789 | 0.2144 | 0.3803 | 0.8814 | −2.549 | 0.0108 | 0.17978 | 0.13667 | 0.21117 |
| rs1796337 | Imputed | T | DOM | 379 | 0.5422 | 0.239 | 0.3394 | 0.8661 | −2.561 | 0.01043 | 0.4722 | 0.44937 | 0.52262 |
| rs1798083 | Imputed | C | DOM | 370 | 0.4733 | 0.2427 | 0.2942 | 0.7617 | −3.081 | 0.00206 | 0.8372 | 0.43791 | 0.51152 |
| rs1798085 | Imputed | T | DOM | 372 | 0.4727 | 0.2424 | 0.2939 | 0.7602 | −3.091 | 0.00199 | 0.6044 | 0.44156 | 0.51147 |
| rs1798086 | Imputed | T | DOM | 370 | 0.4689 | 0.2427 | 0.2914 | 0.7545 | −3.12 | 0.00181 | 0.6778 | 0.44118 | 0.51152 |
| rs1798089 | Imputed | C | GEN | 371 | | | | | 5.637 | 0.0597 | 0.7547 | 0.51316 | 0.43836 |
| rs1798089 | Imputed | C | REC | 371 | 1.806 | 0.2499 | 1.106 | 2.947 | 2.365 | 0.01804 | 0.2536 | 0.51316 | 0.43836 |
| rs1798090 | Imputed | C | GEN | 371 | | | | | 5.595 | 0.06097 | 0.2536 | 0.51645 | 0.43836 |
| rs1798090 | Imputed | C | REC | 371 | 1.806 | 0.2499 | 1.106 | 2.947 | 2.365 | 0.01804 | 0.2992 | 0.51645 | 0.43836 |
| rs1832222 | Imputed | G | DOM | 382 | 1.351 | 0.2099 | 0.8952 | 2.038 | 1.432 | 0.152 | 0.2992 | 0.31646 | 0.27679 |
| rs1838104 | Imputed | A | ADD | 370 | 0.6393 | 0.1498 | 0.4766 | 0.8574 | −2.987 | 0.00282 | 0.4588 | 0.46104 | 0.57176 |
| rs1838104 | Imputed | A | GEN | 370 | | | | | 11.02 | 0.00404 | 0.3479 | 0.46104 | 0.57176 |
| rs1868616 | Imputed | G | ADD | 372 | 0.7123 | 0.1959 | 0.4852 | 1.046 | −1.732 | 0.08332 | 0.3479 | 0.17419 | 0.22581 |
| rs1868616 | Imputed | G | DOM | 372 | 0.6182 | 0.22 | 0.4017 | 0.9516 | −2.185 | 0.02885 | 0.3379 | 0.2043 | 0.42377 |
| rs1874313 | Imputed | A | DOM | 382 | 1.796 | 0.3119 | 0.9747 | 3.31 | 1.878 | 0.0604 | 0.1324 | 0.39136 | 0.35586 |
| rs1884902 | Imputed | C | REC | 379 | 0.7632 | 0.1542 | 0.5641 | 1.032 | −1.753 | 0.07966 | 0.4419 | 0.38854 | 0.44643 |
| rs1913201 | Imputed | G | ADD | 383 | 0.5772 | 0.2224 | 0.3733 | 0.8926 | −2.471 | 0.01349 | 0.6 | 0.37736 | 0.44643 |
| rs1913201 | Imputed | G | DOM | 383 | | | | | 6.592 | 0.03704 | 0.6 | 0.41775 | 0.44643 |
| rs1913201 | Imputed | G | GEN | 383 | | | | | 6.592 | 0.03704 | 0.6 | 0.41775 | 0.44643 |
| rs1944279 | Imputed | A | ADD | 377 | 1.444 | 0.1687 | 1.038 | 2.01 | 2.179 | 0.02933 | 0.3868 | 0.29576 | 0.26818 |
| rs198461 | Imputed | C | DOM | 382 | 0.4755 | 0.245 | 0.2942 | 0.7685 | −3.035 | 0.00241 | 0.9187 | 0.51309 | 0.54484 |
| rs19871179 | Imputed | T | DOM | 383 | 0.6667 | 0.216 | 0.4366 | 1.018 | −1.877 | 0.06051 | 0.7691 | 0.22324 | 0.23884 |
| rs1990023 | Imputed | T | DOM | 382 | 0.6024 | 0.2102 | 0.399 | 0.9096 | −2.411 | 0.01591 | 0.4079 | 0.28165 | 0.34152 |
| rs2016194 | Imputed | G | DOM | 381 | 0.602 | 0.2105 | 0.3986 | 0.9094 | −2.411 | 0.01591 | 0.7248 | 0.32152 | 0.34753 |
| rs2024789 | Imputed | C | ADD | 381 | 0.7464 | 0.1501 | 0.5562 | 1.002 | −1.949 | 0.05131 | 0.9185 | 0.49081 | 0.52018 |
| rs2024789 | Imputed | C | DOM | 381 | | | | | 3.798 | 0.1497 | 0.9185 | 0.49081 | 0.52018 |
| rs2024902 | Imputed | A | ADD | 382 | 2.395 | 0.3248 | 1.267 | 4.526 | 2.688 | 0.00718 | 1 | 0.05759 | 0.03795 |
| rs2024902 | Imputed | A | DOM | 382 | 2.659 | 0.3358 | 1.377 | 5.135 | 2.912 | 0.00359 | 1 | 0.08544 | 0.03795 |
| rs2025107 | Imputed | A | ADD | 383 | 2.387 | 0.3056 | 1.311 | 4.345 | 2.847 | 0.00442 | 0.1765 | 0.09494 | 0.04018 |
| rs2025107 | Imputed | A | DOM | 383 | 2.904 | 0.3322 | 1.514 | 5.569 | 3.209 | 0.00133 | 0.1765 | 0.09494 | 0.04018 |
| rs2025108 | Imputed | T | ADD | 382 | 2.387 | 0.3056 | 1.311 | 4.345 | 2.847 | 0.00442 | 0.1765 | 0.06283 | 0.04018 |
| rs2025108 | Imputed | T | DOM | 382 | 2.904 | 0.3322 | 1.514 | 5.569 | 3.209 | 0.00133 | 0.1765 | 0.06283 | 0.04018 |
| rs2062448 | Imputed | T | ADD | 383 | 0.4148 | 0.2819 | 0.2387 | 0.7208 | −3.122 | 0.0018 | 0.4026 | 0.10183 | 0.12946 |
| rs2062448 | Imputed | T | DOM | 383 | 0.4153 | 0.2867 | 0.2368 | 0.7285 | −3.065 | 0.00218 | 0.4026 | 0.10183 | 0.12946 |
| rs2063591 | Imputed | C | ADD | 382 | 0.7711 | 0.1536 | 0.5706 | 1.042 | −1.692 | 0.09058 | 0.6013 | 0.42801 | 0.45536 |
| rs2063591 | Imputed | C | DOM | 382 | 0.5884 | 0.2242 | 0.3791 | 0.9131 | −2.366 | 0.018 | 0.6013 | 0.38924 | 0.45536 |
| rs2065604 | Imputed | C | DOM | 383 | 0.4711 | 0.3006 | 0.2614 | 0.8493 | −2.503 | 0.0123 | 0.2271 | 0.06289 | 0.11161 |
| rs2066238 | Imputed | C | ADD | 383 | 0.6821 | 0.2397 | 0.4264 | 1.091 | −1.596 | 0.1105 | 0.3197 | 0.12579 | 0.16741 |
| rs2068051 | Imputed | G | ADD | 264 | 0.6426 | 0.1952 | 0.4383 | 0.9422 | −2.265 | 0.02351 | 0.06451 | 0.45045 | 0.53595 |
| rs2068051 | Imputed | G | GEN | 264 | | | | | 5.343 | 0.06914 | 0.06451 | 0.45045 | 0.53595 |
| rs2077702 | Genotyped | G | GEN | 383 | | | | | 2.22 | 0.3296 | 0.6635 | 0.37728 | 0.36161 |
| rs208757 | Imputed | G | ADD | 345 | 1.353 | 0.2024 | 0.9102 | 2.012 | 1.495 | 0.1348 | 0.8529 | 0.17536 | 0.15672 |
| rs208757 | Imputed | G | DOM | 345 | 1.453 | 0.2347 | 0.917 | 2.301 | 1.591 | 0.1116 | 0.8529 | 0.20139 | 0.15672 |
| rs2095586 | Imputed | A | DOM | 382 | 1.351 | 0.2099 | 0.8952 | 2.038 | 1.432 | 0.152 | 0.4588 | 0.31646 | 0.27679 |

TABLE 10-continued

| | | | | | | | | | | | | |
|---|---|---|---|---|---|---|---|---|---|---|---|---|
| rs2108426 | Imputed | C | DOM | 381 | 0.5994 | 0.2104 | 0.3969 | 0.9054 | −2.432 | 0.01501 | 0.6369 | 0.3189 | 0.28165 | 0.34529 |
| rs2110664 | Imputed | A | DOM | 349 | 1.697 | 0.2201 | 1.102 | 2.613 | 2.403 | 0.01627 | 0.1922 | 0.28797 | 0.34028 | 0.25122 |
| rs2132242 | Imputed | A | DOM | 382 | 0.6291 | 0.2196 | 0.4091 | 0.9676 | −2.11 | 0.03486 | 0.1617 | 0.39005 | 0.34591 | 0.42152 |
| rs2151644 | Imputed | T | DOM | 383 | 0.4711 | 0.3006 | 0.2614 | 0.8493 | −2.503 | 0.0123 | 0.2271 | 0.09138 | 0.06289 | 0.11161 |
| rs2157752 | Genotyped | A | GEN | 383 | | | | | 3.356 | 0.1868 | 0.3575 | 0.3329 | 0.30189 | 0.35491 |
| rs2158958 | Imputed | A | DOM | 383 | 0.6021 | 0.2099 | 0.3991 | 0.9085 | −2.417 | 0.01564 | 0.7244 | 0.31984 | 0.28302 | 0.34598 |
| rs2158961 | Imputed | G | DOM | 383 | 0.6113 | 0.2097 | 0.4053 | 0.9221 | −2.347 | 0.01893 | 0.7244 | 0.31593 | 0.27987 | 0.34152 |
| rs2164099 | Imputed | G | ADD | 382 | 1.424 | 0.1667 | 1.027 | 1.974 | 2.121 | 0.03389 | 0.4616 | 0.29581 | 0.33333 | 0.26906 |
| rs2173254 | Imputed | G | GEN | 381 | | | | | 4.978 | 0.08298 | 0.06174 | 0.32546 | 0.30063 | 0.34305 |
| rs2173254 | Imputed | G | REC | 381 | 0.3756 | 0.4421 | 0.1579 | 0.8933 | −2.215 | 0.02675 | 0.06174 | 0.32546 | 0.30063 | 0.34305 |
| rs2188079 | Imputed | C | ADD | 383 | 1.5 | 0.1541 | 1.109 | 2.029 | 2.63 | 0.00854 | 0.6716 | 0.40339 | 0.45912 | 0.36384 |
| rs2188079 | Imputed | C | GEN | 383 | | | | | 6.918 | 0.03146 | 0.6716 | 0.40339 | 0.45912 | 0.36384 |
| rs2190304 | Imputed | G | REC | 383 | 0.628 | 0.2629 | 0.3751 | 1.051 | −1.77 | 0.0768 | 0.47 | 0.4517 | 0.43082 | 0.46652 |
| rs2190597 | Imputed | T | DOM | 381 | 0.7825 | 0.223 | 0.5054 | 1.211 | −1.1 | 0.2713 | 0.8344 | 0.43045 | 0.4172 | 0.43973 |
| rs2190598 | Imputed | T | DOM | 383 | 0.6021 | 0.2099 | 0.3991 | 0.9085 | −2.417 | 0.01564 | 0.7244 | 0.31984 | 0.28302 | 0.34598 |
| rs2190600 | Imputed | A | DOM | 379 | 0.6022 | 0.2112 | 0.398 | 0.911 | −2.401 | 0.01634 | 0.724 | 0.3219 | 0.28526 | 0.34753 |
| rs2218084 | Imputed | T | GEN | 383 | | | | | 6.969 | 0.03066 | 0.3636 | 0.16971 | 0.21069 | 0.14063 |
| rs2218084 | Imputed | T | REC | 383 | 4.673 | 0.8259 | 0.9259 | 23.58 | 1.867 | 0.06194 | 0.3636 | 0.16971 | 0.21069 | 0.14063 |
| rs2236290 | Genotyped | C | GEN | 381 | | | | | 3.686 | 0.1583 | 1 | 0.37664 | 0.33861 | 0.40359 |
| rs2243860 | Imputed | A | GEN | 306 | | | | | 4.567 | 0.1019 | 1 | 0.35131 | 0.39431 | 0.3224 |
| rs2243860 | Imputed | A | REC | 306 | 2.063 | 0.3516 | 1.035 | 4.108 | 2.059 | 0.03949 | 1 | 0.35131 | 0.39431 | 0.3224 |
| rs2246564 | Imputed | T | DOM | 383 | 0.4711 | 0.3006 | 0.2614 | 0.8493 | −2.503 | 0.0123 | 0.2271 | 0.09138 | 0.06289 | 0.11161 |
| rs2248236 | Imputed | C | DOM | 383 | 0.6667 | 0.216 | 0.4366 | 1.018 | −1.877 | 0.06051 | 0.7691 | 0.22324 | 0.20126 | 0.23884 |
| rs2250340 | Imputed | T | DOM | 333 | 0.4723 | 0.3046 | 0.26 | 0.858 | −2.463 | 0.01378 | 0.3862 | 0.10511 | 0.07299 | 0.12755 |
| rs2257192 | Imputed | G | DOM | 383 | 0.4711 | 0.3006 | 0.2614 | 0.8493 | −2.503 | 0.0123 | 0.2271 | 0.09138 | 0.06289 | 0.11161 |
| rs2270584 | Imputed | A | DOM | 382 | 0.5988 | 0.2187 | 0.3901 | 0.9193 | −2.345 | 0.01904 | 0.2351 | 0.38613 | 0.33861 | 0.41964 |
| rs2270586 | Imputed | A | DOM | 371 | 0.5858 | 0.2268 | 0.3756 | 0.9138 | −2.358 | 0.0184 | 0.0525 | 0.40296 | 0.35526 | 0.43607 |
| rs2270589 | Imputed | A | ADD | 308 | 0.6907 | 0.1757 | 0.4895 | 0.9746 | −2.106 | 0.03518 | 0.1384 | 0.4724 | 0.42188 | 0.50833 |
| rs2270589 | Imputed | A | DOM | 308 | 0.4396 | 0.2688 | 0.2596 | 0.7445 | −3.058 | 0.00223 | 0.1384 | 0.4724 | 0.42188 | 0.50833 |
| rs2270589 | Imputed | A | GEN | 308 | | | | | 9.89 | 0.00712 | 0.6901 | 0.15223 | 0.19811 | 0.11937 |
| rs2296889 | Imputed | C | ADD | 381 | 1.88 | 0.2321 | 1.193 | 2.963 | 2.721 | 0.00651 | 0.2971 | 0.293 | 0.34932 | 0.25127 |
| rs2301346 | Imputed | C | DOM | 343 | 1.627 | 0.1791 | 1.145 | 2.311 | 2.717 | 0.00658 | 0.00149 | 0.293 | 0.34932 | 0.25127 |
| rs2327929 | Imputed | C | REC | 343 | 2.008 | 0.2246 | 1.293 | 3.119 | 3.103 | 0.00191 | 0.8372 | 0.45431 | 0.47799 | 0.4375 |
| rs2357486 | Imputed | C | REC | 383 | 1.756 | 0.2541 | 1.068 | 2.89 | 2.217 | 0.02662 | 0.6199 | 0.32322 | 0.33228 | 0.31674 |
| rs2373793 | Imputed | G | DOM | 379 | 1.682 | 0.4091 | 0.7542 | 3.75 | 1.27 | 0.2039 | 0.6199 | 0.19251 | 0.22549 | 0.16968 |
| rs2377622 | Imputed | T | GEN | 374 | 1.775 | 0.2221 | 1.149 | 2.743 | 2.583 | 0.00978 | 0.6851 | 0.32686 | 0.28205 | 0.35843 |
| rs2377622 | Imputed | T | REC | 283 | | | | | 3.778 | 0.1513 | 0.6851 | 0.32686 | 0.28205 | 0.35843 |
| rs2383903 | Imputed | G | DOM | 283 | 0.5046 | 0.4168 | 0.2229 | 1.142 | −1.641 | 0.1008 | 0.444 | 0.27822 | 0.23418 | 0.30942 |
| rs2389866 | Imputed | C | DOM | 381 | 0.5866 | 0.211 | 0.3879 | 0.8871 | −2.528 | 0.01148 | 0.7691 | 0.22324 | 0.20126 | 0.23884 |
| rs2389869 | Imputed | C | DOM | 383 | 0.6667 | 0.216 | 0.4366 | 1.018 | −1.877 | 0.06051 | 0.7691 | 0.22324 | 0.20126 | 0.23884 |
| rs2418541 | Imputed | A | DOM | 383 | 0.6113 | 0.2097 | 0.4053 | 0.9221 | −2.347 | 0.01893 | 0.4104 | 0.31723 | 0.28302 | 0.34152 |
| rs2418542 | Imputed | C | ADD | 383 | 0.6113 | 0.2097 | 0.4053 | 0.9221 | −2.347 | 0.01893 | 0.4104 | 0.31723 | 0.28302 | 0.34152 |
| rs2418548 | Imputed | G | ADD | 378 | 0.6382 | 0.211 | 0.4221 | 0.965 | −2.129 | 0.03326 | 0.4132 | 0.32672 | 0.29618 | 0.34842 |
| rs2476976 | Imputed | T | DOM | 382 | 1.351 | 0.2099 | 0.8952 | 2.038 | 1.432 | 0.152 | 0.4588 | 0.29319 | 0.31646 | 0.27679 |
| rs2483639 | Imputed | A | DOM | 383 | 0.4711 | 0.3006 | 0.2614 | 0.8493 | −2.503 | 0.0123 | 0.2271 | 0.09138 | 0.06289 | 0.11161 |
| rs2483640 | Imputed | A | DOM | 383 | 0.4711 | 0.3006 | 0.2614 | 0.8493 | −2.503 | 0.0123 | 0.2271 | 0.09138 | 0.06289 | 0.11161 |
| rs2544780 | Imputed | T | REC | 381 | 1.683 | 0.3502 | 0.8473 | 3.344 | 1.487 | 0.137 | 0.7246 | 0.3189 | 0.32166 | 0.31696 |
| rs2586458 | Imputed | T | DOM | 323 | 0.4393 | 0.2682 | 0.2597 | 0.7431 | −3.067 | 0.00216 | 0.65 | 0.14396 | 0.09929 | 0.17857 |
| rs2593272 | Imputed | G | ADD | 383 | 0.5962 | 0.1685 | 0.4285 | 0.8294 | −3.07 | 0.00214 | 0.05071 | 0.26762 | 0.2044 | 0.3125 |
| rs2593273 | Imputed | T | ADD | 383 | 0.5962 | 0.1685 | 0.4285 | 0.8294 | −3.07 | 0.00214 | 0.05071 | 0.26762 | 0.2044 | 0.3125 |
| rs2622499 | Imputed | G | DOM | 383 | 0.6667 | 0.216 | 0.4366 | 1.018 | −1.877 | 0.06051 | 0.7691 | 0.22324 | 0.20126 | 0.23884 |
| rs264126 | Imputed | C | DOM | 381 | 0.7975 | 0.2216 | 0.5165 | 1.231 | −1.022 | 0.307 | 1 | 0.42782 | 0.4172 | 0.43527 |

| | | | | | | | | | | |
|---|---|---|---|---|---|---|---|---|---|---|
| rs264129 | Imputed | T | DOM | 383 | 0.6113 | 0.2097 | 0.4053 | 0.9221 | −2.347 | 0.01893 | 0.5542 | 0.31593 | 0.27987 | 0.34152 |
| rs2656822 | Imputed | T | ADD | 383 | 0.5962 | 0.1685 | 0.4285 | 0.8294 | −3.07 | 0.00214 | 0.05071 | 0.26762 | 0.2044 | 0.3125 |
| rs2656823 | Imputed | G | ADD | 383 | 0.5962 | 0.1685 | 0.4285 | 0.8294 | −3.07 | 0.00214 | 0.05071 | 0.26762 | 0.2044 | 0.3125 |
| rs2656825 | Imputed | T | ADD | 362 | 0.558 | 0.1868 | 0.387 | 0.8047 | −3.123 | 0.00179 | 0.4731 | 0.23895 | 0.17763 | 0.28333 |
| rs2764766 | Imputed | C | REC | 383 | 1.776 | 0.3462 | 0.901 | 3.5 | 1.659 | 0.09717 | 0.8147 | 0.32115 | 0.32704 | 0.31696 |
| rs2793101 | Imputed | T | ADD | 383 | 0.6263 | 0.2568 | 0.3786 | 1.036 | −1.822 | 0.06842 | 0.2863 | 0.10705 | 0.08491 | 0.12277 |
| rs2795871 | Imputed | T | DOM | 383 | 0.5997 | 0.2668 | 0.3555 | 1.012 | −1.916 | 0.05534 | 0.2863 | 0.10705 | 0.08491 | 0.12277 |
| rs2795886 | Imputed | A | ADD | 382 | 0.3627 | 0.3488 | 0.1831 | 0.7186 | −2.908 | 0.00364 | 0.2402 | 0.06806 | 0.03774 | 0.08969 |
| rs2795886 | Imputed | A | DOM | 383 | 0.3343 | 0.376 | 0.16 | 0.6986 | −2.914 | 0.00357 | 0.3826 | 0.06005 | 0.03145 | 0.08036 |
| rs2859994 | Imputed | C | ADD | 383 | 0.3343 | 0.376 | 0.16 | 0.6986 | −2.914 | 0.00357 | 0.3826 | 0.06005 | 0.03145 | 0.08036 |
| rs2870464 | Imputed | G | GEN | 378 | | | | | 6.173 | 0.04567 | 0.2908 | 0.41931 | 0.47115 | 0.38288 |
| rs2875528 | Imputed | G | DOM | 383 | 1.373 | 0.2699 | 0.8092 | 2.331 | 1.176 | 0.2398 | 0.7607 | 0.09399 | 0.11006 | 0.08259 |
| rs2876227 | Imputed | C | ADD | 383 | 2.42 | 0.2725 | 1.419 | 4.128 | 3.244 | 0.00118 | 0.3464 | 0.09138 | 0.12893 | 0.06473 |
| rs2876227 | Imputed | C | GEN | 380 | 1.396 | 0.1502 | 1.04 | 1.874 | 2.221 | 0.02634 | 0.1846 | 0.36579 | 0.41026 | 0.33482 |
| rs2882097 | Imputed | A | DOM | 383 | | | | | 5.549 | 0.06238 | 0.1846 | 0.36579 | 0.41026 | 0.33482 |
| rs2921983 | Imputed | C | ADD | 383 | 1.367 | 0.2096 | 0.9065 | 2.062 | 1.491 | 0.1358 | 0.4613 | 0.29373 | 0.31761 | 0.27679 |
| rs2987537 | Imputed | C | DOM | 375 | 0.5761 | 0.1731 | 0.4103 | 0.8087 | −3.187 | 0.00144 | 0.04386 | 0.26 | 0.19355 | 0.30682 |
| rs2996416 | Imputed | C | ADD | 383 | 0.5886 | 0.2614 | 0.3526 | 0.9826 | −2.027 | 0.04264 | 0.8057 | 0.1188 | 0.09119 | 0.13839 |
| rs2996416 | Imputed | C | DOM | 382 | 0.5791 | 0.2661 | 0.3437 | 0.9755 | −2.053 | 0.04007 | 0.7684 | 0.09686 | 0.06962 | 0.11607 |
| rs3015527 | Imputed | C | ADD | 382 | 0.5573 | 0.2856 | 0.3184 | 0.9754 | −2.047 | 0.04066 | 0.7684 | 0.09686 | 0.06962 | 0.11607 |
| rs3015527 | Imputed | C | DOM | 377 | 0.5922 | 0.2667 | 0.3511 | 0.9989 | −1.964 | 0.04953 | 0.7661 | 0.09682 | 0.07051 | 0.11538 |
| rs3015530 | Imputed | C | DOM | 377 | 0.572 | 0.2869 | 0.326 | 1.004 | −1.947 | 0.05151 | 0.7661 | 0.09682 | 0.07051 | 0.11538 |
| rs3015530 | Imputed | C | ADD | 383 | 0.5758 | 0.2661 | 0.3418 | 0.97 | −2.074 | 0.03805 | 0.7681 | 0.09661 | 0.06918 | 0.11607 |
| rs3015531 | Imputed | C | DOM | 383 | 0.554 | 0.2856 | 0.3166 | 0.9696 | −2.068 | 0.03864 | 0.7681 | 0.09661 | 0.06918 | 0.11607 |
| rs3015531 | Imputed | T | ADD | 383 | 0.5758 | 0.2661 | 0.3418 | 0.97 | −2.074 | 0.03805 | 0.7681 | 0.09661 | 0.06918 | 0.11607 |
| rs3015535 | Imputed | C | DOM | 383 | 0.554 | 0.2856 | 0.3166 | 0.9696 | −2.068 | 0.03864 | 0.7681 | 0.09661 | 0.06918 | 0.11607 |
| rs3015535 | Imputed | C | ADD | 383 | 0.5758 | 0.2661 | 0.3418 | 0.97 | −2.074 | 0.03805 | 0.7681 | 0.09661 | 0.06918 | 0.11607 |
| rs3019407 | Imputed | A | DOM | 383 | 0.554 | 0.2856 | 0.3166 | 0.9696 | −2.068 | 0.03864 | 0.7681 | 0.09661 | 0.06918 | 0.11607 |
| rs3019407 | Genotyped | C | GEN | 381 | | | | | 5.56 | 0.06205 | 0.1023 | 0.32546 | 0.30063 | 0.34305 |
| rs36011725 | Imputed | G | REC | 381 | 0.3598 | 0.4403 | 0.1518 | 0.8529 | −2.321 | 0.02026 | 0.08914 | 0.35248 | 0.30063 | 0.34305 |
| rs373983 | Imputed | C | GEN | 383 | | | | | 4.835 | 0.08914 | 0.9112 | 0.35248 | 0.39623 | 0.32143 |
| rs37561654 | Imputed | G | DOM | 380 | 1.266 | 0.2223 | 0.8189 | 1.957 | 1.061 | 0.2888 | 0.7504 | 0.41053 | 0.42038 | 0.40359 |
| rs3793044 | Imputed | C | ADD | 383 | 0.6667 | 0.216 | 0.4366 | 1.018 | −1.877 | 0.06051 | 0.7691 | 0.22324 | 0.20126 | 0.23884 |
| rs3793044 | Imputed | C | DOM | 383 | 2.378 | 0.3248 | 1.258 | 4.495 | 2.668 | 0.00763 | 1 | 0.05744 | 0.08491 | 0.03795 |
| rs3793053 | Imputed | C | ADD | 380 | 2.64 | 0.3358 | 1.367 | 5.099 | 2.891 | 0.00384 | 1 | 0.05744 | 0.08491 | 0.03795 |
| rs3793053 | Imputed | C | DOM | 383 | 2.28 | 0.3065 | 1.25 | 4.157 | 2.689 | 0.00717 | 1 | 0.06184 | 0.09117 | 0.04054 |
| rs3796246 | Imputed | G | ADD | 380 | 2.764 | 0.3341 | 1.436 | 5.32 | 3.042 | 0.00235 | 1 | 0.06184 | 0.09177 | 0.04054 |
| rs3796246 | Imputed | G | DOM | 383 | 0.3513 | 0.2964 | 0.1965 | 0.6279 | −3.53 | 0.00042 | 1 | 0.09791 | 0.05346 | 0.12946 |
| rs3805996 | Imputed | G | ADD | 383 | 0.3489 | 0.3028 | 0.1928 | 0.6316 | −3.478 | 0.00051 | 1 | 0.09791 | 0.05346 | 0.12946 |
| rs3805996 | Imputed | G | DOM | 382 | 2.395 | 0.3248 | 1.267 | 4.526 | 2.688 | 0.00718 | 1 | 0.05759 | 0.08544 | 0.03795 |
| rs3806003 | Imputed | G | ADD | 382 | 2.659 | 0.3358 | 1.377 | 5.135 | 2.912 | 0.00359 | 1 | 0.05759 | 0.08544 | 0.03795 |
| rs3806003 | Imputed | A | DOM | 383 | 2.378 | 0.3248 | 1.258 | 4.495 | 2.668 | 0.00763 | 1 | 0.05744 | 0.08491 | 0.03795 |
| rs3806004 | Imputed | T | ADD | 383 | 2.473 | 0.3048 | 1.361 | 4.493 | 2.97 | 0.00298 | 0.193 | 0.06414 | 0.0981 | 0.04018 |
| rs3806004 | Imputed | T | DOM | 382 | 3.015 | 0.3305 | 1.578 | 5.763 | 3.339 | 0.00084 | 0.193 | 0.06414 | 0.0981 | 0.04018 |
| rs3806010 | Imputed | T | ADD | 383 | 2.387 | 0.3056 | 1.311 | 4.345 | 2.847 | 0.00442 | 0.1765 | 0.06283 | 0.09494 | 0.04018 |
| rs3806010 | Imputed | T | DOM | 382 | 2.904 | 0.3322 | 1.514 | 5.569 | 3.209 | 0.00133 | 0.1765 | 0.06283 | 0.09494 | 0.04018 |
| rs3806014 | Imputed | T | ADD | 382 | 2.387 | 0.3056 | 1.311 | 4.345 | 2.847 | 0.00442 | 0.1765 | 0.06283 | 0.09494 | 0.04018 |
| rs3806014 | Imputed | A | DOM | 382 | 2.904 | 0.3322 | 1.514 | 5.569 | 3.209 | 0.00133 | 0.1765 | 0.06283 | 0.09494 | 0.04018 |
| rs3806015 | Imputed | A | ADD | 382 | 2.387 | 0.3056 | 1.311 | 4.345 | 2.847 | 0.00442 | 0.1765 | 0.06283 | 0.09494 | 0.04018 |
| rs3806015 | Imputed | A | DOM | 382 | 2.904 | 0.3322 | 1.514 | 5.569 | 3.209 | 0.00133 | 0.1765 | 0.06283 | 0.09494 | 0.04018 |
| rs3806018 | Imputed | A | ADD | 382 | 2.387 | 0.3056 | 1.311 | 4.345 | 2.847 | 0.00442 | 0.1765 | 0.06283 | 0.09494 | 0.04018 |
| rs3806018 | Imputed | A | DOM | 382 | 2.904 | 0.3322 | 1.514 | 5.569 | 3.209 | 0.00133 | 0.1765 | 0.06283 | 0.09494 | 0.04018 |

TABLE 10-continued

| | | | | | | | | | | |
|---|---|---|---|---|---|---|---|---|---|---|
| rs3806019 | Imputed | A | ADD | 382 | 2.387 | 0.3056 | 1.311 | 4.345 | 2.847 | 0.00442 | 0.1765 | 0.06283 | 0.09494 | 0.04018 |
| rs3806019 | Imputed | A | DOM | 382 | 2.904 | 0.3322 | 1.514 | 5.569 | 3.209 | 0.00133 | 0.1765 | 0.06283 | 0.09494 | 0.04018 |
| rs3806024 | Imputed | T | ADD | 382 | 2.274 | 0.3063 | 1.248 | 4.146 | 2.682 | 0.00732 | 0.1608 | 0.06152 | 0.09119 | 0.04036 |
| rs3806024 | Imputed | T | DOM | 382 | 2.756 | 0.334 | 1.432 | 5.303 | 3.035 | 0.0024 | 0.1608 | 0.06152 | 0.09119 | 0.04036 |
| rs3847825 | Imputed | G | ADD | 382 | 0.7535 | 0.1544 | 0.5568 | 1.02 | -1.833 | 0.06673 | 0.9143 | 0.39005 | 0.35127 | 0.41741 |
| rs3847825 | Imputed | G | GEN | 382 | | | | | 4.284 | 0.1174 | 0.9143 | 0.39005 | 0.35127 | 0.41741 |
| rs3852001 | Genotyped | C | GEN | 383 | | | | | 4.104 | 0.1285 | 0.3319 | 0.19713 | 0.21698 | 0.18304 |
| rs3852001 | Genotyped | C | REC | 383 | 2.797 | 0.5134 | 1.023 | 7.653 | 2.004 | 0.04512 | 0.3319 | 0.19713 | 0.21698 | 0.18304 |
| rs3852002 | Imputed | G | GEN | 383 | | | | | 4.104 | 0.1285 | 0.3319 | 0.19713 | 0.21698 | 0.18304 |
| rs3852002 | Imputed | G | REC | 383 | 2.797 | 0.5134 | 1.023 | 7.653 | 2.004 | 0.04512 | 0.3319 | 0.19713 | 0.21698 | 0.18304 |
| rs3852003 | Imputed | A | GEN | 383 | | | | | 4.104 | 0.1285 | 0.3319 | 0.19713 | 0.21698 | 0.18304 |
| rs3852003 | Imputed | A | REC | 383 | 2.797 | 0.5134 | 1.023 | 7.653 | 2.004 | 0.04512 | 0.3319 | 0.19713 | 0.21698 | 0.18304 |
| rs3942254 | Imputed | T | DOM | 351 | 0.5955 | 0.227 | 0.3817 | 0.9293 | -2.283 | 0.02242 | 0.737 | 0.38746 | 0.33916 | 0.42067 |
| rs3945085 | Imputed | A | DOM | 383 | 1.391 | 0.2096 | 0.9222 | 2.098 | 1.574 | 0.1155 | 0.5365 | 0.29112 | 0.31761 | 0.27232 |
| rs399485 | Imputed | A | DOM | 382 | 1.379 | 0.2101 | 0.9136 | 2.082 | 1.53 | 0.126 | 0.6346 | 0.31283 | 0.33648 | 0.29596 |
| rs4029119 | Imputed | G | ADD | 382 | 0.1157 | 1.052 | 0.01473 | 0.9094 | -2.05 | 0.04034 | 1 | 0.01571 | 0.00316 | 0.02455 |
| rs4029119 | Imputed | G | DOM | 382 | 0.1157 | 1.052 | 0.01473 | 0.9094 | -2.05 | 0.04034 | 1 | 0.01571 | 0.00316 | 0.02455 |
| rs412791 | Imputed | C | GEN | 367 | | | | | 2.832 | 0.2427 | 0.5643 | 0.34605 | 0.31731 | 0.3673 |
| rs4146972 | Genotyped | T | DOM | 383 | 1.672 | 0.2418 | 1.041 | 2.685 | 2.125 | 0.03357 | 0.4985 | 0.13055 | 0.16352 | 0.10714 |
| rs4259369 | Imputed | C | REC | 383 | 0.4161 | 0.2795 | 0.2406 | 0.7196 | -3.137 | 0.00171 | 0.6078 | 0.46867 | 0.39937 | 0.51786 |
| rs4273613 | Imputed | T | ADD | 383 | 0.235 | 0.778 | 0.05116 | 1.08 | -1.861 | 0.0627 | 1 | 0.01697 | 0.00629 | 0.02455 |
| rs4273613 | Imputed | T | DOM | 383 | 0.235 | 0.778 | 0.05116 | 1.08 | -1.861 | 0.0627 | 1 | 0.01697 | 0.00629 | 0.02455 |
| rs4294022 | Imputed | C | DOM | 383 | 0.5507 | 0.2147 | 0.3616 | 0.8388 | -2.779 | 0.00546 | 0.3404 | 0.25065 | 0.21384 | 0.27679 |
| rs4310554 | Genotyped | C | DOM | 382 | 1.609 | 0.2628 | 0.9616 | 2.694 | 1.811 | 0.07014 | 0.681 | 0.53786 | 0.57547 | 0.51116 |
| rs4315598 | Imputed | T | ADD | 382 | 1.42 | 0.1496 | 1.06 | 1.904 | 2.347 | 0.01894 | 0.1477 | 0.35864 | 0.40566 | 0.32511 |
| rs4315598 | Imputed | T | GEN | 382 | | | | | 6.306 | 0.04271 | 0.1477 | 0.35864 | 0.40566 | 0.32511 |
| rs4370878 | Imputed | G | DOM | 383 | 1.391 | 0.2096 | 0.9222 | 2.098 | 1.574 | 0.1155 | 0.5365 | 0.29112 | 0.31761 | 0.27232 |
| rs4436200 | Imputed | G | ADD | 383 | 0.5856 | 0.2343 | 0.37 | 0.9269 | -2.284 | 0.02238 | 0.6515 | 0.12794 | 0.09434 | 0.15179 |
| rs4444612 | Imputed | G | ADD | 383 | 1.429 | 0.1494 | 1.066 | 1.915 | 2.388 | 0.01695 | 0.1203 | 0.3577 | 0.40566 | 0.32366 |
| rs4444612 | Imputed | G | GEN | 383 | | | | | 6.537 | 0.03806 | 0.1203 | 0.3577 | 0.40566 | 0.32366 |
| rs4450660 | Imputed | C | DOM | 383 | 1.719 | 0.2141 | 1.13 | 2.615 | 2.53 | 0.01141 | 0.6453 | 0.21149 | 0.24843 | 0.18527 |
| rs4463950 | Imputed | C | DOM | 379 | 0.5555 | 0.2195 | 0.3613 | 0.8542 | -2.678 | 0.00741 | 0.05998 | 0.43272 | 0.37342 | 0.47511 |
| rs4509702 | Imputed | C | DOM | 383 | 1.391 | 0.2096 | 0.9222 | 2.098 | 1.574 | 0.1155 | 0.5365 | 0.29112 | 0.31761 | 0.27232 |
| rs4533379 | Imputed | A | ADD | 380 | 1.429 | 0.1671 | 1.03 | 1.983 | 2.138 | 0.03253 | 0.461 | 0.29737 | 0.33544 | 0.27027 |
| rs4569984 | Imputed | A | DOM | 374 | 0.5254 | 0.2168 | 0.3436 | 0.8036 | -2.969 | 0.00299 | 0.21184 | 0.25401 | 0.21474 | 0.28211 |
| rs4570530 | Imputed | C | DOM | 383 | 1.391 | 0.2096 | 0.9222 | 2.098 | 1.574 | 0.1155 | 0.5365 | 0.29112 | 0.31761 | 0.27232 |
| rs4571583 | Imputed | T | DOM | 383 | 0.5381 | 0.2149 | 0.3531 | 0.8199 | -2.884 | 0.00392 | 0.2723 | 0.24804 | 0.21069 | 0.27455 |
| rs4586678 | Imputed | A | ADD | 383 | 1.719 | 0.2141 | 1.13 | 2.615 | 2.53 | 0.01141 | 0.6453 | 0.21149 | 0.24843 | 0.18527 |
| rs4615971 | Imputed | A | DOM | 382 | 1.351 | 0.2099 | 0.8952 | 2.038 | 1.432 | 0.152 | 0.4588 | 0.29319 | 0.31646 | 0.27679 |
| rs4629229 | Imputed | G | DOM | 383 | 0.6821 | 0.2397 | 0.4264 | 1.091 | -1.596 | 0.1105 | 0.3197 | 0.15013 | 0.12579 | 0.16741 |
| rs4632512 | Imputed | T | GEN | 383 | | | | | 4.104 | 0.1285 | 0.3319 | 0.19713 | 0.21698 | 0.18304 |
| rs4641552 | Imputed | A | ADD | 377 | 0.5381 | 0.2751 | 0.3138 | 0.9226 | -2.253 | 0.02427 | 1 | 0.09682 | 0.06731 | 0.11765 |
| rs4682527 | Imputed | C | DOM | 364 | 1.785 | 0.2238 | 1.151 | 2.767 | 2.588 | 0.00965 | 0.08775 | 0.35852 | 0.40523 | 0.32464 |
| rs4688632 | Imputed | G | REC | 373 | 0.656 | 0.2381 | 0.4113 | 1.046 | -1.77 | 0.07666 | 0.12 | 0.52145 | 0.49026 | 0.54338 |
| rs4702720 | Imputed | A | ADD | 320 | 0.6922 | 0.2059 | 0.4623 | 1.036 | -1.787 | 0.07392 | 0.7262 | 0.2 | 0.16541 | 0.2246 |
| rs4702720 | Imputed | A | DOM | 320 | 0.7001 | 0.2406 | 0.4369 | 1.122 | -1.481 | 0.1385 | 0.7262 | 0.2 | 0.16541 | 0.2246 |
| rs4714484 | Imputed | A | DOM | 383 | 0.5988 | 0.1942 | 0.4093 | 0.8761 | -2.641 | 0.00827 | 0.1255 | 0.18538 | 0.13836 | 0.21875 |
| rs4714484 | Imputed | A | DOM | 383 | 0.5097 | 0.2319 | 0.3235 | 0.803 | -2.906 | 0.00366 | 0.1255 | 0.18538 | 0.13836 | 0.21875 |
| rs4725142 | Genotyped | G | REC | 383 | 0.3868 | 0.3771 | 0.1847 | 0.81 | -2.519 | 0.01178 | 0.9099 | 0.34204 | 0.3239 | 0.35491 |
| rs4725144 | Imputed | G | REC | 383 | 0.3868 | 0.3771 | 0.1847 | 0.81 | -2.519 | 0.01178 | 0.9099 | 0.34204 | 0.3239 | 0.35491 |
| rs4760785 | Imputed | A | ADD | 383 | 0.7632 | 0.1542 | 0.5641 | 1.032 | -1.753 | 0.07966 | 0.6 | 0.41775 | 0.37736 | 0.44643 |
| rs4760785 | Imputed | A | DOM | 383 | 0.5772 | 0.2224 | 0.3733 | 0.8926 | -2.471 | 0.01349 | 0.6 | 0.41775 | 0.37736 | 0.44643 |
| rs4760894 | Imputed | T | ADD | 383 | 0.7632 | 0.1542 | 0.5641 | 1.032 | -1.753 | 0.07966 | 0.6 | 0.41775 | 0.37736 | 0.44643 |

TABLE 10-continued

| | | | | | | | | | | | |
|---|---|---|---|---|---|---|---|---|---|---|---|
| rs4760894 | Imputed | T | DOM | 383 | 0.5772 | 0.2224 | 0.3733 | 0.8926 | −2.471 | 0.01349 | 0.6 | 0.41775 | 0.37736 | 0.44643 |
| rs4760895 | Imputed | A | ADD | 383 | 0.7632 | 0.1542 | 0.5641 | 1.032 | −1.753 | 0.07966 | 0.6 | 0.41775 | 0.37736 | 0.44643 |
| rs4760895 | Imputed | A | DOM | 383 | 0.5772 | 0.2224 | 0.3733 | 0.8926 | −2.471 | 0.01349 | 0.6 | 0.41775 | 0.37736 | 0.44643 |
| rs4767184 | Imputed | C | ADD | 375 | 0.7432 | 0.1558 | 0.5476 | 1.009 | −1.905 | 0.05677 | 1 | 0.392 | 0.35065 | 0.42081 |
| rs4767184 | Imputed | C | GEN | 375 | | | | | 4.92 | 0.08545 | 1 | 0.392 | 0.35065 | 0.42081 |
| rs4773487 | Imputed | T | ADD | 380 | 0.5534 | 0.2659 | 0.3287 | 0.932 | −2.225 | 0.02609 | 0.7794 | 0.1 | 0.07006 | 0.12108 |
| rs4780547 | Imputed | G | GEN | 382 | | | | | 1.722 | 0.4228 | 1 | 0.22644 | 0.21519 | 0.23438 |
| rs4780547 | Imputed | G | REC | 382 | 0.5086 | 0.5339 | 0.1786 | 1.448 | −1.266 | 0.2054 | 1 | 0.22644 | 0.21519 | 0.23438 |
| rs483159 | Imputed | T | DOM | 369 | 1.242 | 0.2188 | 0.8087 | 1.906 | 0.9893 | 0.3225 | 0.7497 | 0.20461 | 0.21711 | 0.19585 |
| rs4836502 | Imputed | T | DOM | 383 | 0.6021 | 0.2099 | 0.3991 | 0.9085 | −2.417 | 0.01564 | 0.7244 | 0.31984 | 0.28302 | 0.34598 |
| rs4836507 | Imputed | C | DOM | 376 | 0.6042 | 0.212 | 0.3988 | 0.9154 | −2.377 | 0.01745 | 0.5558 | 0.32048 | 0.28387 | 0.34615 |
| rs4851531 | Imputed | T | DOM | 380 | 0.5595 | 0.2166 | 0.366 | 0.8553 | −2.682 | 0.00733 | 0.665 | 0.38553 | 0.35127 | 0.40991 |
| rs4879931 | Imputed | G | ADD | 382 | 0.7554 | 0.1662 | 0.5453 | 1.046 | −1.688 | 0.09145 | 0.2407 | 0.32199 | 0.28931 | 0.34529 |
| rs489441 | Imputed | G | DOM | 357 | 1.491 | 0.172 | 1.064 | 2.089 | 2.322 | 0.02024 | 0.4487 | 0.29552 | 0.34354 | 0.2619 |
| rs489441 | Imputed | G | DOM | 357 | 1.551 | 0.2175 | 1.013 | 2.376 | 2.018 | 0.04362 | 0.4487 | 0.29552 | 0.34354 | 0.2619 |
| rs4976276 | Imputed | T | ADD | 382 | 1.499 | 0.1578 | 1.1 | 2.042 | 2.566 | 0.01029 | 0.6569 | 0.35995 | 0.41456 | 0.32143 |
| rs4977681 | Imputed | C | REC | 380 | 2.078 | 0.3396 | 1.068 | 4.042 | 2.153 | 0.03132 | 0.1768 | 0.34868 | 0.37898 | 0.32735 |
| rs4986197 | Imputed | G | ADD | 379 | 1.42 | 0.1672 | 1.023 | 1.97 | 2.097 | 0.03598 | 0.4609 | 0.29683 | 0.33439 | 0.27027 |
| rs4986220 | Imputed | T | ADD | 383 | 1.437 | 0.1677 | 1.034 | 1.996 | 2.162 | 0.03065 | 0.3893 | 0.29243 | 0.33019 | 0.26563 |
| rs525462 | Imputed | A | GEN | 382 | | | | | 9.552 | 0.00843 | 0.9148 | 0.6034 | 0.54088 | 0.64798 |
| rs552006 | Imputed | G | GEN | 380 | | | | | 6.857 | 0.03243 | 0.3034 | 0.27237 | 0.31447 | 0.24208 |
| rs5756669 | Imputed | C | DOM | 383 | 1.639 | 0.2271 | 1.05 | 2.558 | 2.175 | 0.02962 | 0.8346 | 0.42428 | 0.44654 | 0.40848 |
| rs581905 | Imputed | T | DOM | 383 | 1.341 | 0.2854 | 0.7666 | 2.347 | 1.029 | 0.3036 | 0.7263 | 0.08094 | 0.09119 | 0.07366 |
| rs6033138 | Imputed | C | ADD | 383 | 1.429 | 0.1494 | 1.066 | 1.915 | 2.388 | 0.01695 | 0.1203 | 0.3577 | 0.40566 | 0.32366 |
| rs6033138 | Imputed | C | GEN | 383 | | | | | 6.537 | 0.03806 | 0.1203 | 0.3577 | 0.40566 | 0.32366 |
| rs6040619 | Imputed | C | ADD | 374 | 1.432 | 0.1515 | 1.064 | 1.927 | 2.368 | 0.01789 | 0.1811 | 0.3623 | 0.41026 | 0.32798 |
| rs6040619 | Imputed | C | GEN | 374 | | | | | 6.205 | 0.04493 | 0.1811 | 0.3623 | 0.41026 | 0.32798 |
| rs6040625 | Imputed | T | ADD | 380 | 1.45 | 0.1506 | 1.079 | 1.947 | 2.466 | 0.01364 | 0.1459 | 0.35658 | 0.40705 | 0.32143 |
| rs6040625 | Imputed | T | GEN | 380 | | | | | 6.611 | 0.03669 | 0.1459 | 0.35658 | 0.40705 | 0.32143 |
| rs6040630 | Imputed | A | ADD | 383 | 1.444 | 0.1501 | 1.076 | 1.938 | 2.448 | 0.01435 | 0.1808 | 0.3564 | 0.40566 | 0.32143 |
| rs6040630 | Imputed | A | GEN | 383 | | | | | 6.635 | 0.03624 | 0.1808 | 0.3564 | 0.40566 | 0.32143 |
| rs6040633 | Imputed | A | ADD | 383 | 1.429 | 0.1494 | 1.066 | 1.915 | 2.388 | 0.01695 | 0.1203 | 0.3577 | 0.40566 | 0.32366 |
| rs6040633 | Imputed | A | GEN | 383 | | | | | 6.537 | 0.03806 | 0.1203 | 0.3577 | 0.40566 | 0.32366 |
| rs6040634 | Imputed | T | ADD | 383 | 1.429 | 0.1494 | 1.066 | 1.915 | 2.388 | 0.01695 | 0.1203 | 0.3577 | 0.40566 | 0.32366 |
| rs6040634 | Imputed | T | GEN | 383 | | | | | 6.537 | 0.03806 | 0.1203 | 0.3577 | 0.40566 | 0.32366 |
| rs6040636 | Imputed | T | ADD | 383 | 1.429 | 0.1494 | 1.066 | 1.915 | 2.388 | 0.01695 | 0.1203 | 0.3577 | 0.40566 | 0.32366 |
| rs6040636 | Imputed | T | GEN | 383 | | | | | 6.537 | 0.03806 | 0.1203 | 0.3577 | 0.40566 | 0.32366 |
| rs6040638 | Imputed | C | ADD | 383 | 1.429 | 0.1494 | 1.066 | 1.915 | 2.388 | 0.01695 | 0.1203 | 0.3577 | 0.40566 | 0.32366 |
| rs6040638 | Imputed | C | GEN | 383 | | | | | 6.537 | 0.03806 | 0.1203 | 0.3577 | 0.40566 | 0.32366 |
| rs6040644 | Imputed | A | ADD | 383 | 1.429 | 0.1494 | 1.066 | 1.915 | 2.388 | 0.01695 | 0.1203 | 0.3577 | 0.40566 | 0.32366 |
| rs6040644 | Imputed | A | GEN | 383 | | | | | 6.537 | 0.03806 | 0.1203 | 0.3577 | 0.40566 | 0.32366 |
| rs6040667 | Imputed | A | ADD | 381 | 1.419 | 0.1495 | 1.058 | 1.902 | 2.339 | 0.01935 | 0.09512 | 0.35696 | 0.40446 | 0.32366 |
| rs6040667 | Imputed | A | GEN | 381 | | | | | 6.102 | 0.04731 | 0.09512 | 0.35696 | 0.40446 | 0.32366 |
| rs6040668 | Imputed | C | ADD | 381 | 1.419 | 0.1495 | 1.058 | 1.902 | 2.339 | 0.01935 | 0.09512 | 0.35696 | 0.40446 | 0.32366 |
| rs6040668 | Imputed | C | GEN | 381 | | | | | 6.102 | 0.04731 | 0.09512 | 0.35696 | 0.40446 | 0.32366 |
| rs6053005 | Imputed | C | DOM | 283 | 0.3707 | 0.3223 | 0.1971 | 0.6972 | −3.079 | 0.00207 | 0.3237 | 0.59717 | 0.52542 | 0.64848 |
| rs6054405 | Imputed | A | REC | 379 | 1.796 | 0.3119 | 0.9747 | 3.31 | 1.878 | 0.0604 | 0.4419 | 0.36939 | 0.38854 | 0.35586 |
| rs6054427 | Genotyped | G | DOM | 383 | | | | | 3.524 | 0.1717 | 0.1355 | 0.39687 | 0.43082 | 0.37277 |
| rs6075186 | Imputed | G | ADD | 383 | 0.6821 | 0.2397 | 0.4264 | 1.091 | −1.596 | 0.1105 | 0.3197 | 0.15013 | 0.12579 | 0.16741 |
| rs608278 | Imputed | A | ADD | 345 | 0.6427 | 0.1607 | 0.4691 | 0.8807 | −2.751 | 0.00594 | 0.9142 | 0.42414 | 0.42414 | 0.5225 |
| rs6111540 | Imputed | A | ADD | 347 | 0.7778 | 0.1612 | 0.5671 | 1.067 | −1.558 | 0.1191 | 0.5914 | 0.48116 | 0.44178 | 0.51244 |
| rs6131206 | Imputed | C | ADD | 380 | 1.462 | 0.1555 | 1.078 | 1.983 | 2.445 | 0.01449 | 0.1924 | 0.31447 | 0.36306 | 0.28027 |
| rs6131208 | Imputed | T | ADD | 381 | 1.419 | 0.1495 | 1.058 | 1.902 | 2.339 | 0.01935 | 0.09512 | 0.35696 | 0.40446 | 0.32366 |

TABLE 10-continued

| | | | | | | | | | | | |
|---|---|---|---|---|---|---|---|---|---|---|---|
| rs6131208 | Imputed | T | GEN | 381 | | | | | 6.102 | 0.04731 | 0.09512 | 0.35696 | 0.40446 | 0.32366 |
| rs6131919 | Imputed | G | DOM | 383 | 0.6821 | 0.2397 | 0.4264 | 1.091 | −1.596 | 0.1105 | 0.3197 | 0.15013 | 0.12579 | 0.16741 |
| rs6134243 | Imputed | C | ADD | 383 | 1.429 | 0.1494 | 1.066 | 1.915 | 2.388 | 0.01695 | 0.1203 | 0.3577 | 0.40566 | 0.32366 |
| rs6134243 | Imputed | C | GEN | 383 | | | | | 6.537 | 0.03806 | 0.1203 | 0.3577 | 0.40566 | 0.32366 |
| rs6136020 | Imputed | A | DOM | 383 | 0.6821 | 0.2397 | 0.4264 | 1.091 | −1.596 | 0.1105 | 0.3197 | 0.15013 | 0.12579 | 0.16741 |
| rs613799 | Imputed | C | DOM | 373 | 1.426 | 0.2134 | 0.9386 | 2.167 | 1.663 | 0.0963 | 0.4587 | 0.29759 | 0.32566 | 0.27828 |
| rs644041 | Imputed | G | ADD | 349 | 1.523 | 0.1742 | 1.082 | 2.142 | 2.415 | 0.01575 | 0.5224 | 0.29799 | 0.35 | 0.26316 |
| rs644041 | Imputed | G | DOM | 349 | 1.58 | 0.2213 | 1.024 | 2.438 | 2.067 | 0.03874 | 0.5224 | 0.29799 | 0.35 | 0.26316 |
| rs6464377 | Imputed | C | DOM | 383 | 1.743 | 0.2989 | 0.9701 | 3.131 | 1.859 | 0.06309 | 1 | 0.0718 | 0.08805 | 0.06027 |
| rs6474230 | Imputed | T | DOM | 383 | 1.832 | 0.2138 | 1.205 | 2.786 | 2.832 | 0.00463 | 0.4624 | 0.22454 | 0.28302 | 0.18304 |
| rs6476565 | Imputed | A | DOM | 383 | 0.4711 | 0.3006 | 0.2614 | 0.8493 | −2.503 | 0.0123 | 0.2271 | 0.09138 | 0.06289 | 0.11161 |
| rs6511286 | Imputed | T | ADD | 382 | 1.657 | 0.1628 | 1.204 | 2.28 | 3.103 | 0.00192 | 0.9052 | 0.31021 | 0.37107 | 0.26682 |
| rs6541829 | Genotyped | C | REC | 383 | 3.048 | 0.4236 | 1.329 | 6.991 | 2.631 | 0.00851 | 0.7014 | 0.27415 | 0.29874 | 0.2567 |
| rs6544721 | Imputed | G | DOM | 383 | 1.782 | 0.2114 | 1.178 | 2.697 | 2.733 | 0.00628 | 0.7817 | 0.24413 | 0.29245 | 0.20982 |
| rs6544728 | Imputed | T | DOM | 377 | 1.8 | 0.2171 | 1.177 | 2.755 | 2.709 | 0.00675 | 0.7509 | 0.20424 | 0.24522 | 0.175 |
| rs6565910 | Imputed | G | DOM | 383 | 0.6325 | 0.2139 | 0.4159 | 0.9619 | −2.141 | 0.03224 | 0.3965 | 0.23629 | 0.19811 | 0.26339 |
| rs6581985 | Imputed | G | GEN | 383 | | | | | 5.059 | 0.07972 | 0.6393 | 0.32115 | 0.34277 | 0.3058 |
| rs6581985 | Imputed | G | REC | 383 | 2.122 | 0.3548 | 1.058 | 4.253 | 2.12 | 0.03402 | 0.6393 | 0.32115 | 0.34277 | 0.3058 |
| rs6685186 | Imputed | T | ADD | 383 | 1.364 | 0.1533 | 1.01 | 1.842 | 2.026 | 0.04275 | 0.9138 | 0.38251 | 0.42453 | 0.35268 |
| rs6685186 | Imputed | T | GEN | 383 | | | | | 4.244 | 0.1198 | 0.9138 | 0.38251 | 0.42453 | 0.35268 |
| rs670593 | Imputed | A | REC | 383 | 0.6178 | 0.2944 | 0.347 | 1.1 | −1.636 | 0.1018 | 0.6696 | 0.39817 | 0.36478 | 0.42188 |
| rs6722640 | Imputed | T | DOM | 382 | 0.5778 | 0.2162 | 0.3783 | 0.8827 | −2.537 | 0.01117 | 0.5916 | 0.38874 | 0.35849 | 0.41031 |
| rs6746170 | Imputed | A | DOM | 380 | 1.811 | 0.2168 | 1.184 | 2.77 | 2.739 | 0.00616 | 0.7506 | 0.20263 | 0.24367 | 0.17342 |
| rs6757316 | Imputed | A | GEN | 380 | | | | | 5.94 | 0.05131 | 0.535 | 0.44737 | 0.49367 | 0.41441 |
| rs6805139 | Imputed | G | DOM | 376 | 1.64 | 0.2386 | 1.028 | 2.618 | 2.074 | 0.03807 | 0.1787 | 0.47606 | 0.51613 | 0.44796 |
| rs6808571 | Imputed | A | ADD | 378 | 1.439 | 0.2034 | 0.9658 | 2.143 | 1.789 | 0.07364 | 1 | 0.15741 | 0.18671 | 0.13636 |
| rs6816479 | Imputed | A | REC | 383 | 2.214 | 0.2867 | 1.262 | 3.883 | 2.772 | 0.00557 | 0.8315 | 0.40078 | 0.45912 | 0.35938 |
| rs6865976 | Imputed | C | DOM | 305 | 0.5474 | 0.2612 | 0.3281 | 0.9134 | −2.307 | 0.02106 | 0.646 | 0.47377 | 0.42692 | 0.50857 |
| rs687047 | Imputed | C | ADD | 383 | 0.7104 | 0.232 | 0.4509 | 1.119 | −1.474 | 0.1405 | 0.8148 | 0.12272 | 0.10377 | 0.13616 |
| rs6871041 | Imputed | C | DOM | 367 | 0.6093 | 0.2145 | 0.4002 | 0.9278 | −2.31 | 0.02092 | 0.7102 | 0.29837 | 0.26144 | 0.32477 |
| rs688358 | Imputed | A | ADD | 382 | 0.6857 | 0.2311 | 0.4359 | 1.079 | −1.632 | 0.1026 | 0.4845 | 0.12304 | 0.10127 | 0.13839 |
| rs6908481 | Imputed | C | REC | 375 | 1.848 | 0.262 | 1.106 | 3.088 | 2.344 | 0.01908 | 0.7545 | 0.45333 | 0.46452 | 0.44545 |
| rs6917224 | Imputed | A | ADD | 382 | 1.351 | 0.1419 | 1.023 | 1.784 | 2.118 | 0.0342 | 0.02099 | 0.42408 | 0.47152 | 0.39063 |
| rs6917224 | Imputed | A | GEN | 382 | | | | | 6.409 | 0.04058 | 0.02099 | 0.42408 | 0.47152 | 0.39063 |
| rs6920677 | Imputed | A | DOM | 380 | 0.5128 | 0.2138 | 0.3335 | 0.7886 | −3.041 | 0.00235 | 0.5212 | 0.39868 | 0.31847 | 0.45516 |
| rs6994498 | Imputed | G | DOM | 383 | 1.832 | 0.2138 | 1.205 | 2.786 | 2.832 | 0.00463 | 0.4624 | 0.22454 | 0.28302 | 0.18304 |
| rs6998772 | Imputed | G | DOM | 383 | 2.739 | 0.4524 | 1.128 | 6.647 | 2.227 | 0.02596 | 0.00643 | 0.03394 | 0.05031 | 0.02232 |
| rs7022281 | Imputed | T | ADD | 382 | 0.7264 | 0.1589 | 0.532 | 0.9919 | −2.011 | 0.04432 | 0.1999 | 0.39791 | 0.35849 | 0.42601 |
| rs7022281 | Imputed | C | DOM | 382 | 0.6088 | 0.2112 | 0.4024 | 0.9209 | −2.35 | 0.01876 | 0.1999 | 0.39791 | 0.35849 | 0.42601 |
| rs7022281 | Imputed | C | REC | 381 | 0.2657 | 0.5623 | 0.08825 | 0.7997 | 4.073 | 0.1305 | 0.902 | 0.39791 | 0.35849 | 0.42601 |
| rs7043983 | Imputed | C | DOM | 383 | 1.787 | 0.2215 | 1.158 | 2.759 | −1.359 | 0.0184 | 0.5936 | 0.09138 | 0.06289 | 0.11161 |
| rs7077799 | Imputed | C | DOM | 371 | 0.6903 | 0.1578 | 0.5066 | 0.9405 | −2.503 | 0.00874 | 0.0548 | 0.2945 | 0.31761 | 0.27803 |
| rs7089947 | Imputed | A | ADD | 383 | 1.355 | 0.3107 | 0.3565 | 0.8493 | −2.348 | 0.01886 | 0.6497 | 0.34204 | 0.03774 | 0.09152 |
| rs7089661 | Imputed | G | DOM | 382 | 0.3545 | 0.3006 | 0.2614 | 0.8985 | −2.982 | 0.00287 | 0.3841 | 0.06919 | 0.28302 | 0.18304 |
| rs7102072 | Imputed | T | ADD | 383 | 1.351 | 0.2098 | 0.1793 | 0.7009 | 1.45 | 0.1471 | 0.3841 | 0.37728 | 0.03774 | 0.02232 |
| rs710832 | Genotyped | C | DOM | 382 | 0.6088 | 0.3478 | 0.8952 | 2.038 | −2.982 | 0.00287 | 0.6 | 0.29319 | 0.31646 | 0.27679 |
| rs712531 | Imputed | A | REC | 383 | 1.737 | 0.2099 | 0.4024 | 0.9209 | 1.432 | 0.152 | 0.4588 | 0.29265 | 0.25316 | 0.32063 |
| rs7129817 | Imputed | T | ADD | 383 | 1.787 | 0.2112 | 0.08825 | 0.7997 | −2.35 | 0.01876 | 0.902 | 0.25849 | 0.24214 | 0.27009 |
| rs7134262 | Imputed | T | GEN | 383 | | | | | −2.357 | 0.0184 | 0.5936 | 0.35445 | 0.40323 | 0.31944 |
| rs7134262 | Imputed | T | REC | 383 | 1.737 | 0.3064 | 0.9527 | 3.167 | 1.802 | 0.07156 | 0.3841 | 0.37728 | 0.40252 | 0.375 |
| rs7138300 | Imputed | T | REC | 383 | 0.7632 | 0.1542 | 0.5641 | 1.032 | −1.753 | 0.07966 | 0.6 | 0.41775 | 0.40252 | 0.35938 |
| rs7138300 | Imputed | C | ADD | 383 | 0.5772 | 0.2224 | 0.3733 | 0.8926 | −2.471 | 0.01349 | 0.6 | 0.41775 | 0.37736 | 0.44643 |
| rs722927 | Imputed | G | ADD | 383 | 0.4322 | 0.319 | 0.2313 | 0.8077 | −2.63 | 0.00855 | 0.7112 | 0.07572 | 0.04717 | 0.09598 |

TABLE 10-continued

| | | | | | | | | | | | | |
|---|---|---|---|---|---|---|---|---|---|---|---|---|
| rs722927 | Imputed | G | DOM | 383 | 0.433 | 0.3231 | 0.2299 | 0.8157 | -2.59 | 0.00958 | 0.7112 | 0.07572 | 0.04717 | 0.09598 |
| rs726424 | Genotyped | G | ADD | 383 | 0.7473 | 0.1542 | 0.5524 | 1.011 | -1.889 | 0.05889 | 0.9144 | 0.38903 | 0.34906 | 0.41741 |
| rs726424 | Genotyped | G | GEN | 383 | | | | | 4.55 | 0.1028 | 0.9144 | 0.38903 | 0.34906 | 0.41741 |
| rs7295817 | Imputed | C | ADD | 381 | 0.7394 | 0.1533 | 0.5475 | 0.9985 | -1.97 | 0.04885 | 0.9158 | 0.40551 | 0.36306 | 0.43527 |
| rs7295817 | Imputed | C | GEN | 381 | | | | | 4.446 | 0.1083 | 0.9158 | 0.40551 | 0.36306 | 0.43527 |
| rs7297372 | Imputed | A | REC | 338 | 0.747 | 0.2896 | 0.4235 | 1.318 | -1.007 | 0.3139 | 0.9158 | 0.40551 | 0.36306 | 0.43527 |
| rs7297372 | Imputed | A | ADD | 338 | 0.7506 | 0.1757 | 0.532 | 1.059 | -1.633 | 0.1025 | 0.00146 | 0.53846 | 0.50368 | 0.56188 |
| rs7297372 | Imputed | A | GEN | 338 | | | | | 2.895 | 0.2351 | 0.00146 | 0.53846 | 0.50368 | 0.56188 |
| rs7298255 | Imputed | A | ADD | 382 | 0.7489 | 0.1551 | 0.5526 | 1.015 | -1.864 | 0.06235 | 0.5292 | 0.41623 | 0.37342 | 0.44643 |
| rs7298255 | Imputed | C | GEN | 382 | 0.571 | 0.2227 | 0.3691 | 0.8835 | -2.516 | 0.01186 | 0.5292 | 0.41623 | 0.37342 | 0.44643 |
| rs7305832 | Imputed | C | GEN | 383 | | | | | 3.342 | 0.1881 | 0.3841 | 0.37728 | 0.40252 | 0.35938 |
| rs7305832 | Imputed | C | REC | 383 | 1.737 | 0.3064 | 0.5526 | 3.167 | 1.802 | 0.07156 | 0.3841 | 0.37728 | 0.40252 | 0.35938 |
| rs737542 | Imputed | A | REC | 381 | 3.431 | 0.4396 | 1.45 | 8.122 | 2.804 | 0.00504 | 0.6064 | 0.27297 | 0.30063 | 0.25336 |
| rs742827 | Imputed | A | ADD | 361 | 1.416 | 0.1525 | 1.05 | 1.91 | 2.282 | 0.02249 | 0.1122 | 0.36704 | 0.41391 | 0.33333 |
| rs742827 | Imputed | A | GEN | 361 | | | | | 5.995 | 0.0499 | 0.1122 | 0.36704 | 0.41391 | 0.33333 |
| rs7446891 | Imputed | G | DOM | 373 | 0.5964 | 0.2125 | 0.3932 | 0.9046 | -2.432 | 0.01503 | 0.6302 | 0.31099 | 0.27419 | 0.33716 |
| rs7448641 | Imputed | C | ADD | 383 | 0.235 | 0.778 | 0.05116 | 1.08 | -1.861 | 0.0627 | 1 | 0.01697 | 0.00629 | 0.02455 |
| rs7448641 | Imputed | C | DOM | 383 | 0.235 | 0.778 | 0.05116 | 1.08 | -1.861 | 0.0627 | 1 | 0.01697 | 0.00629 | 0.02455 |
| rs7460605 | Imputed | G | DOM | 361 | 1.533 | 0.2243 | 0.4496 | 2.38 | 1.906 | 0.05662 | 0.2254 | 0.39474 | 0.42105 | 0.3756 |
| rs7468898 | Imputed | T | ADD | 379 | 1.539 | 0.1544 | 1.137 | 2.083 | 2.791 | 0.00526 | 0.7518 | 0.42084 | 0.48089 | 0.37838 |
| rs7468898 | Imputed | T | GEN | 379 | | | | | 7.907 | 0.01919 | 0.7518 | 0.42084 | 0.48089 | 0.37838 |
| rs7501186 | Imputed | A | DOM | 383 | 1.277 | 0.2476 | 0.7859 | 2.074 | 0.9866 | 0.3238 | 0.8082 | 0.1201 | 0.13836 | 0.10714 |
| rs755117 | Imputed | A | DOM | 375 | 1.758 | 0.223 | 1.135 | 2.722 | 2.53 | 0.01142 | 0.8628 | 0.18267 | 0.22436 | 0.15297 |
| rs7557560 | Imputed | T | GEN | 383 | | | | | 10.8 | 0.00451 | 0.08079 | 0.20104 | 0.24528 | 0.16964 |
| rs7557560 | Imputed | T | REC | 383 | 6.446 | 0.567 | 2.122 | 19.58 | 3.286 | 0.00102 | 0.08079 | 0.20104 | 0.24528 | 0.16964 |
| rs7562462 | Imputed | T | DOM | 380 | 1.588 | 0.2435 | 0.9851 | 2.559 | 1.898 | 0.05765 | 0.2578 | 0.46974 | 0.50316 | 0.44595 |
| rs757173 | Genotyped | G | ADD | 383 | 0.683 | 0.2133 | 0.4496 | 1.038 | -1.787 | 0.0739 | 0.8284 | 0.3812 | 0.34906 | 0.40402 |
| rs7607447 | Imputed | T | REC | 332 | 1.964 | 0.3733 | 0.9451 | 4.083 | 1.809 | 0.0705 | 0.8998 | 0.31928 | 0.34173 | 0.30311 |
| rs7639053 | Imputed | A | ADD | 383 | 1.6 | 0.1803 | 1.124 | 2.278 | 2.608 | 0.00912 | 0.3899 | 0.22977 | 0.27673 | 0.19643 |
| rs7648163 | Imputed | C | REC | 358 | 2.989 | 0.3458 | 1.518 | 5.886 | 3.166 | 0.00154 | 0.816 | 0.34916 | 0.39333 | 0.31731 |
| rs7651273 | Imputed | A | ADD | 383 | | | | | 3.158 | 0.2061 | 0.4152 | 0.19452 | 0.21384 | 0.1808 |
| rs7653190 | Imputed | C | ADD | 382 | 1.616 | 0.1806 | 1.134 | 2.302 | 2.658 | 0.00786 | 0.3892 | 0.23037 | 0.27848 | 0.19643 |
| rs7684899 | Genotyped | C | DOM | 383 | 2.42 | 0.2725 | 1.419 | 4.128 | 3.244 | 0.00118 | 0.758 | 0.09269 | 0.12893 | 0.06696 |
| rs7701604 | Imputed | G | ADD | 383 | 0.6667 | 0.216 | 0.4366 | 1.018 | -1.877 | 0.06051 | 0.7691 | 0.22324 | 0.20126 | 0.23884 |
| rs7701604 | Imputed | G | DOM | 383 | 0.235 | 0.778 | 0.05116 | 1.08 | -1.861 | 0.0627 | 1 | 0.01697 | 0.00629 | 0.02455 |
| rs7703676 | Imputed | T | DOM | 383 | 0.235 | 0.778 | 0.05116 | 1.08 | -1.861 | 0.0627 | 1 | 0.01697 | 0.00629 | 0.02455 |
| rs7703676 | Imputed | T | GEN | 383 | 0.235 | 0.778 | 0.05116 | 1.08 | -1.861 | 0.0627 | 1 | 0.01697 | 0.00629 | 0.02455 |
| rs7711358 | Imputed | A | ADD | 383 | 0.6113 | 0.2097 | 0.4053 | 0.9221 | -2.347 | 0.01893 | 0.4104 | 0.31723 | 0.28302 | 0.34152 |
| rs7713251 | Imputed | T | REC | 367 | 2.559 | 0.3384 | 1.319 | 4.968 | 2.777 | 0.00548 | 0.7295 | 0.34605 | 0.38816 | 0.31628 |
| rs7337608 | Imputed | G | REC | 382 | 1.5 | 0.2234 | 0.9683 | 2.324 | 1.816 | 0.06938 | 0.6005 | 0.41754 | 0.4462 | 0.39732 |
| rs7755903 | Imputed | G | DOM | 382 | | | | | 9.733 | 0.0077 | 1 | 0.42539 | 0.36478 | 0.46861 |
| rs7762993 | Imputed | A | ADD | 378 | 1.373 | 0.1976 | 0.9323 | 2.023 | 1.605 | 0.1084 | 0.2987 | 0.18122 | 0.20701 | 0.1629 |
| rs7762993 | Imputed | A | DOM | 378 | 1.537 | 0.2206 | 0.9974 | 2.368 | 1.948 | 0.0514 | 0.2987 | 0.18122 | 0.20701 | 0.1629 |
| rs7767265 | Imputed | A | DOM | 382 | 1.53 | 0.2141 | 1.005 | 2.327 | 1.985 | 0.04716 | 0.453 | 0.21859 | 0.24843 | 0.19731 |
| rs7769415 | Imputed | G | GEN | 376 | | | | | 3.721 | 0.1556 | 0.9073 | 0.32846 | 0.34295 | 0.31818 |
| rs7771264 | Imputed | T | DOM | 383 | 0.5507 | 0.2147 | 0.3616 | 0.8388 | -2.779 | 0.00546 | 0.3404 | 0.25065 | 0.21384 | 0.27679 |
| rs7795792 | Imputed | T | REC | 383 | 0.4161 | 0.2795 | 0.2406 | 0.7196 | -3.137 | 0.00171 | 0.6078 | 0.46867 | 0.39937 | 0.51786 |
| rs7806481 | Imputed | G | REC | 383 | 0.628 | 0.2629 | 0.3751 | 1.051 | -1.77 | 0.0768 | 0.47 | 0.4517 | 0.43082 | 0.46652 |
| rs7808536 | Imputed | G | DOM | 383 | 1.952 | 0.2193 | 1.27 | 3 | 3.05 | 0.00229 | 1 | 0.19191 | 0.23899 | 0.15848 |
| rs7814819 | Imputed | G | ADD | 225 | 1.743 | 0.3691 | 0.8454 | 3.593 | 1.505 | 0.1324 | 1 | 0.07333 | 0.09551 | 0.05882 |
| rs7814819 | Imputed | G | DOM | 225 | 1.939 | 0.386 | 0.9098 | 4.131 | 1.715 | 0.08632 | 1 | 0.07333 | 0.09551 | 0.05882 |
| rs7815952 | Imputed | T | DOM | 383 | 2.739 | 0.45524 | 1.128 | 6.647 | 2.227 | 0.02596 | 0.00643 | 0.03394 | 0.05031 | 0.02232 |

TABLE 10-continued

| | | | | | | | | | | |
|---|---|---|---|---|---|---|---|---|---|---|
| rs7834090 | Imputed | T | DOM | 383 | 2.739 | 0.4524 | 1.128 | 6.647 | 2.227 | 0.02596 | 0.00643 | 0.03394 | 0.05031 | 0.02232 |
| rs7859250 | Imputed | C | DOM | 383 | 0.4711 | 0.3006 | 0.2614 | 0.8493 | −2.503 | 0.0123 | 0.2271 | 0.09138 | 0.06289 | 0.11161 |
| rs7863577 | Genotyped | A | ADD | 383 | 0.5916 | 0.2865 | 0.3374 | 1.037 | −1.832 | 0.06689 | 0.7318 | 0.08225 | 0.05975 | 0.09821 |
| rs7863577 | Genotyped | A | DOM | 383 | 0.5571 | 0.3041 | 0.307 | 1.011 | −1.924 | 0.0544 | 0.7318 | 0.08225 | 0.05975 | 0.09821 |
| rs7902140 | Imputed | C | ADD | 378 | 0.622 | 0.2115 | 0.4109 | 0.9414 | −2.245 | 0.02475 | 0.5866 | 0.16931 | 0.13226 | 0.19507 |
| rs7921834 | Imputed | C | DOM | 382 | 1.351 | 0.2099 | 0.8952 | 2.038 | 1.432 | 0.152 | 0.4588 | 0.29319 | 0.31646 | 0.27679 |
| rs7939893 | Imputed | C | ADD | 382 | 0.8314 | 0.1592 | 0.6085 | 1.136 | −1.16 | 0.2462 | 0.4351 | 0.3534 | 0.33333 | 0.36771 |
| rs7939893 | Imputed | C | DOM | 382 | 0.6782 | 0.2127 | 0.447 | 1.029 | −1.826 | 0.0679 | 0.4351 | 0.3534 | 0.33333 | 0.36771 |
| rs7955901 | Imputed | C | ADD | 383 | 0.7632 | 0.1542 | 0.5641 | 1.032 | −1.753 | 0.07966 | 0.6 | 0.41775 | 0.37736 | 0.44643 |
| rs7955901 | Imputed | C | DOM | 383 | 0.5772 | 0.2224 | 0.3733 | 0.8926 | −2.471 | 0.01349 | 0.6 | 0.41775 | 0.37736 | 0.44643 |
| rs7956274 | Imputed | T | ADD | 382 | 0.7489 | 0.1551 | 0.5526 | 1.015 | −1.864 | 0.06235 | 0.5292 | 0.41623 | 0.37342 | 0.44643 |
| rs7956274 | Imputed | T | DOM | 382 | 0.571 | 0.2227 | 0.3691 | 0.8835 | −2.516 | 0.01186 | 0.5292 | 0.41623 | 0.37342 | 0.44643 |
| rs7957932 | Imputed | G | ADD | 380 | 0.7622 | 0.1541 | 0.5635 | 1.031 | −1.762 | 0.07806 | 0.6008 | 0.42895 | 0.38854 | 0.4574 |
| rs7957932 | Imputed | G | DOM | 380 | 0.5724 | 0.2251 | 0.3682 | 0.8898 | −2.479 | 0.01319 | 0.6008 | 0.42895 | 0.38854 | 0.4574 |
| rs7984294 | Imputed | A | DOM | 341 | 1.992 | 0.4122 | 0.888 | 4.468 | 1.672 | 0.09458 | 1 | 0.03959 | 0.05594 | 0.02778 |
| rs7994286 | Imputed | A | ADD | 377 | 0.5714 | 0.2665 | 0.3389 | 0.9633 | −2.1 | 0.03571 | 0.7705 | 0.09814 | 0.07006 | 0.11818 |
| rs7994286 | Imputed | A | DOM | 377 | 0.5491 | 0.2859 | 0.3135 | 0.9616 | −2.097 | 0.03601 | 0.7705 | 0.09814 | 0.07006 | 0.11818 |
| rs8038229 | Genotyped | A | ADD | 383 | 0.6055 | 0.165 | 0.4381 | 0.8367 | −3.04 | 0.00237 | 0.3986 | 0.30418 | 0.24528 | 0.34598 |
| rs8038229 | Genotyped | A | DOM | 383 | 0.534 | 0.2122 | 0.3523 | 0.8093 | −2.957 | 0.0031 | 0.3986 | 0.30418 | 0.24528 | 0.34598 |
| rs8043336 | Imputed | C | GEN | 370 | | | | | 8.202 | 0.01656 | 0.3028 | 0.34865 | 0.2987 | 0.38426 |
| rs8043336 | Imputed | C | REC | 370 | 0.3477 | 0.3977 | 0.1595 | 0.758 | −2.657 | 0.00789 | 0.3028 | 0.34865 | 0.2987 | 0.38426 |
| rs8054431 | Imputed | T | DOM | 372 | 2.022 | 0.2234 | 1.305 | 3.133 | 3.153 | 0.00162 | 0.3127 | 0.3629 | 0.42308 | 0.31944 |
| rs8066502 | Imputed | T | DOM | 383 | 0.6823 | 0.229 | 0.4356 | 1.069 | −1.669 | 0.09506 | 0.8575 | 0.17232 | 0.15094 | 0.1875 |
| rs8068714 | Imputed | T | DOM | 383 | 0.7037 | 0.2279 | 0.4502 | 1.1 | −1.542 | 0.1231 | 0.8589 | 0.17363 | 0.15409 | 0.1875 |
| rs892575 | Imputed | T | ADD | 383 | 1.417 | 0.1666 | 1.022 | 1.964 | 2.092 | 0.03642 | 0.4618 | 0.29634 | 0.33333 | 0.27009 |
| rs892583 | Imputed | C | ADD | 383 | 1.437 | 0.1677 | 1.034 | 1.996 | 2.162 | 0.03065 | 0.3893 | 0.29243 | 0.33019 | 0.26563 |
| rs915494 | Imputed | A | DOM | 374 | 1.204 | 0.1605 | 0.8791 | 1.649 | 1.157 | 0.2474 | 0.3776 | 0.28877 | 0.31046 | 0.27376 |
| rs915494 | Imputed | A | ADD | 374 | 1.279 | 0.2121 | 0.8439 | 1.938 | 1.16 | 0.2462 | 0.3776 | 0.28877 | 0.31046 | 0.27376 |
| rs917295 | Imputed | G | DOM | 383 | 0.6021 | 0.2099 | 0.3991 | 0.9085 | −2.417 | 0.01564 | 0.7244 | 0.31984 | 0.28302 | 0.34598 |
| rs922594 | Imputed | T | DOM | 375 | 0.5825 | 0.2147 | 0.3824 | 0.8872 | −2.518 | 0.01181 | 0.4237 | 0.34133 | 0.3 | 0.37045 |
| rs9301653 | Imputed | T | ADD | 383 | 0.5758 | 0.2661 | 0.3418 | 0.97 | −2.074 | 0.03805 | 0.7681 | 0.09661 | 0.06918 | 0.11607 |
| rs9301653 | Imputed | T | DOM | 383 | 0.554 | 0.2856 | 0.3166 | 0.9696 | −2.068 | 0.03864 | 0.7681 | 0.09661 | 0.06918 | 0.11607 |
| rs9309988 | Imputed | G | DOM | 383 | 2.42 | 0.2725 | 1.419 | 4.128 | 3.244 | 0.00118 | 0.758 | 0.09269 | 0.12893 | 0.06696 |
| rs9309989 | Genotyped | C | DOM | 383 | 2.42 | 0.2725 | 1.419 | 4.128 | 3.244 | 0.00118 | 0.758 | 0.09269 | 0.12893 | 0.06696 |
| rs9310221 | Imputed | A | ADD | 352 | 1.531 | 0.2314 | 0.9727 | 2.41 | 1.84 | 0.06574 | 0.7387 | 0.39915 | 0.40972 | 0.39183 |
| rs9327555 | Imputed | T | DOM | 383 | 0.6021 | 0.2099 | 0.3991 | 0.9085 | −2.417 | 0.01564 | 0.7244 | 0.31984 | 0.28302 | 0.34598 |
| rs937890 | Imputed | G | DOM | 383 | 0.7037 | 0.2279 | 0.4502 | 1.1 | −1.542 | 0.1231 | 0.8589 | 0.17363 | 0.15409 | 0.1875 |
| rs9454967 | Imputed | G | ADD | 382 | 2.387 | 0.3056 | 1.311 | 4.345 | 2.847 | 0.00442 | 0.1765 | 0.06283 | 0.09494 | 0.04018 |
| rs9454967 | Imputed | G | DOM | 382 | 2.904 | 0.3322 | 1.514 | 5.569 | 3.209 | 0.00133 | 0.1765 | 0.06283 | 0.09494 | 0.04018 |
| rs9471295 | Imputed | T | DOM | 383 | 1.488 | 0.2326 | 0.9435 | 2.348 | 1.71 | 0.08731 | 0.5442 | 0.14883 | 0.16667 | 0.13616 |
| rs9477007 | Imputed | A | ADD | 380 | 1.357 | 0.1432 | 1.025 | 1.797 | 2.132 | 0.03298 | 0.04681 | 0.42763 | 0.47484 | 0.39367 |
| rs9477007 | Imputed | A | GEN | 380 | | | | | 5.531 | 0.06295 | 0.04681 | 0.42763 | 0.47484 | 0.39367 |
| rs9487279 | Imputed | T | DOM | 366 | 0.5667 | 0.2254 | 0.3643 | 0.8814 | −2.52 | 0.01173 | 0.1024 | 0.40164 | 0.33882 | 0.44626 |
| rs949016 | Imputed | C | ADD | 383 | 1.437 | 0.1677 | 1.034 | 1.996 | 2.162 | 0.03065 | 0.3893 | 0.29243 | 0.33019 | 0.26563 |
| rs9555973 | Imputed | G | ADD | 379 | 0.5702 | 0.2704 | 0.3356 | 0.9686 | −2.078 | 0.03773 | 0.7618 | 0.09499 | 0.06731 | 0.11435 |
| rs9555973 | Imputed | G | DOM | 379 | 0.5463 | 0.2905 | 0.3091 | 0.9655 | −2.081 | 0.03744 | 0.7618 | 0.09499 | 0.06731 | 0.11435 |
| rs9557510 | Imputed | G | ADD | 383 | 1.582 | 0.1986 | 1.072 | 2.334 | 2.308 | 0.02098 | 0.2295 | 0.15144 | 0.18868 | 0.125 |
| rs9557510 | Imputed | G | DOM | 383 | 1.775 | 0.2327 | 1.125 | 2.801 | 2.466 | 0.01365 | 0.2295 | 0.15144 | 0.18868 | 0.125 |
| rs9560584 | Imputed | T | DOM | 382 | 0.5572 | 0.2856 | 0.3184 | 0.9752 | −2.048 | 0.04058 | 0.7684 | 0.09686 | 0.06962 | 0.11659 |
| rs9588770 | Imputed | T | DOM | 381 | 0.497 | 0.2943 | 0.2792 | 0.8849 | −2.376 | 0.01752 | 0.7612 | 0.09449 | 0.06329 | 0.11607 |
| rs9588848 | Imputed | C | ADD | 383 | 0.5758 | 0.2661 | 0.3418 | 0.97 | −2.074 | 0.03805 | 0.7681 | 0.09661 | 0.06918 | 0.11607 |
| rs9588848 | Imputed | C | DOM | 383 | 0.554 | 0.2856 | 0.3166 | 0.9696 | −2.068 | 0.03864 | 0.7681 | 0.09661 | 0.06918 | 0.11607 |
| rs966583 | Imputed | A | ADD | 382 | 0.7239 | 0.1599 | 0.5291 | 0.9903 | −2.021 | 0.04332 | 0.1993 | 0.39398 | 0.34906 | 0.42601 |

TABLE 10-continued

| SNP rs # | SOURCE | ALLELE (A1) | MODEL | NMISS | PRAVA_A1_HZ_COUNT | PRAVA_HET_COUNT | PRAVA_A2_HZ_COUNT | PRAVA | PLACEBO_A1_HZ_COUNT | PLACEBO_HET_COUNT | PLACEBO_A2_HZ_COUNT |
|---|---|---|---|---|---|---|---|---|---|---|---|
| rs966583 | Imputed | A | DOM | 382 | 0.6175 | 0.2202 | 0.4011 | 0.9507 | −2.189 | 0.02856 | 0.1993 | | | | 0.34906 | | | 0.39398 | | | 0.42601 |
| rs974130 | Genotyped | A | REC | 383 | 2.214 | 0.2867 | 1.262 | 3.883 | 2.772 | 0.000557 | 0.8315 | | | | 0.45912 | | | 0.40078 | | | 0.35938 |
| rs977160 | Imputed | T | ADD | 382 | 1.378 | 0.1666 | 0.9945 | 1.911 | 1.927 | 0.05403 | 0.7069 | | | | 0.31761 | | | 0.28403 | | | 0.26009 |
| rs9812206 | Imputed | G | DOM | 383 | 0.3883 | 0.2849 | 0.2221 | 0.6787 | −3.321 | 0.0009 | 0.7825 | | | | 0.05975 | | | 0.10183 | | | 0.1317 |
| rs9812206 | Imputed | G | ADD | 383 | 0.3876 | 0.2917 | 0.2188 | 0.6867 | −3.248 | 0.00116 | 0.7825 | | | | 0.05975 | | | 0.10183 | | | 0.1317 |
| rs9813552 | Imputed | G | ADD | 379 | 0.3826 | 0.2913 | 0.2162 | 0.6772 | −3.298 | 0.00097 | 1 | | | | 0.05732 | | | 0.09894 | | | 0.12838 |
| rs9813552 | Imputed | G | DOM | 379 | 0.3816 | 0.2983 | 0.2127 | 0.6847 | −3.23 | 0.00124 | 1 | | | | 0.05732 | | | 0.09894 | | | 0.12838 |
| rs9815037 | Imputed | T | ADD | 382 | 0.3819 | 0.2906 | 0.2161 | 0.675 | −3.313 | 0.00092 | 1 | | | | 0.0566 | | | 0.09817 | | | 0.1278 |
| rs9815037 | Imputed | T | DOM | 382 | 0.3819 | 0.2976 | 0.2125 | 0.6825 | −3.243 | 0.00118 | 1 | | | | 0.0566 | | | 0.09817 | | | 0.1278 |
| rs9825349 | Imputed | A | ADD | 382 | 0.3819 | 0.2906 | 0.2161 | 0.675 | −3.313 | 0.00092 | 1 | | | | 0.0566 | | | 0.09817 | | | 0.1278 |
| rs9825349 | Imputed | A | DOM | 382 | 0.3819 | 0.2976 | 0.2125 | 0.6825 | −3.243 | 0.00118 | 1 | | | | 0.0566 | | | 0.09817 | | | 0.1278 |
| rs9834217 | Imputed | T | ADD | 382 | 0.3819 | 0.2906 | 0.2161 | 0.675 | −3.313 | 0.00092 | 1 | | | | 0.0566 | | | 0.09817 | | | 0.1278 |
| rs9834217 | Imputed | T | DOM | 382 | 0.3819 | 0.2976 | 0.2125 | 0.6825 | −3.243 | 0.00118 | 1 | | | | 0.0566 | | | 0.09817 | | | 0.1278 |
| rs9840460 | Imputed | T | ADD | 382 | 0.3819 | 0.2906 | 0.2125 | 0.6825 | −3.243 | 0.00118 | 1 | | | | 0.0566 | | | 0.09817 | | | 0.1278 |
| rs9840460 | Imputed | T | DOM | 382 | 0.3809 | 0.2976 | 0.2125 | 0.6825 | −3.243 | 0.00118 | 1 | | | | 0.0566 | | | 0.09817 | | | 0.1278 |
| rs9840756 | Imputed | A | ADD | 380 | 0.3808 | 0.291 | 0.2153 | 0.6737 | −3.317 | 0.00091 | 1 | | | | 0.05696 | | | 0.09868 | | | 0.12838 |
| rs9840756 | Imputed | A | DOM | 380 | 0.3798 | 0.298 | 0.2118 | 0.681 | −3.249 | 0.00116 | 1 | | | | 0.05696 | | | 0.09868 | | | 0.12838 |
| rs9844801 | Imputed | C | GEN | 383 | 2.42 | 0.2725 | 1.419 | 4.128 | 5.977 | 0.05036 | 0.3464 | | | | 0.30844 | | | 0.26471 | | | 0.06473 |
| rs985375 | Imputed | A | ADD | 374 | | | | | | | 0.5979 | | | | 0.12893 | | | 0.09138 | | | 0.23409 |
| rs9869187 | Imputed | C | ADD | 383 | 0.4258 | 0.2859 | 0.2431 | 0.7458 | −2.986 | 0.00283 | 1 | | | | 0.05975 | | | 0.09661 | | | 0.12277 |
| rs9869187 | Imputed | C | DOM | 383 | 0.4271 | 0.294 | 0.24 | 0.7599 | −2.894 | 0.0038 | 1 | | | | 0.05975 | | | 0.09661 | | | 0.12277 |
| rs9872327 | Imputed | C | GEN | 383 | 2.42 | 0.2725 | 1.419 | 4.128 | −3.244 | 0.00118 | 0.3464 | | | | 0.12893 | | | 0.09138 | | | 0.06473 |
| rs9881685 | Imputed | A | ADD | 379 | 0.377 | 0.2935 | 0.2125 | 0.6701 | −3.324 | 0.00089 | 0.5599 | | | | 0.05769 | | | 0.09894 | | | 0.1278 |
| rs9881685 | Imputed | A | DOM | 379 | 0.3761 | 0.298 | 0.2121 | 0.6745 | −3.282 | 0.00103 | 0.5599 | | | | 0.05769 | | | 0.09894 | | | 0.1278 |
| rs9909499 | Imputed | C | DOM | 362 | 1.559 | 0.2159 | 1.021 | 2.381 | 2.058 | 0.03962 | 0.08453 | | | | 0.29801 | | | 0.2721 | | | 0.25355 |
| rs9911847 | Imputed | C | ADD | 382 | 0.6877 | 0.2291 | 0.4389 | 1.078 | −1.634 | 0.1023 | 0.8576 | | | | 0.1519 | | | 0.17277 | | | 0.1875 |
| rs9946886 | Imputed | G | REC | 156 | 0.3262 | 0.5121 | 0.1196 | 0.8902 | −2.187 | 0.02873 | 0.3882 | | | | 0.29452 | | | 0.36218 | | | 0.42169 |
| rs9958823 | Imputed | A | ADD | 377 | 1.444 | 0.1687 | 1.038 | 2.01 | 2.179 | 0.02933 | 0.3868 | | | | 0.33439 | | | 0.29576 | | | 0.26818 |
| rs9965248 | Imputed | T | ADD | 379 | 1.399 | 0.167 | 1.009 | 1.941 | 2.011 | 0.04433 | 0.537 | | | | 0.33121 | | | 0.29551 | | | 0.27027 |

| SNP rs # | SOURCE | ALLELE (A1) | MODEL | NMISS | PRAVA_A1_HZ_COUNT | PRAVA_HET_COUNT | PRAVA_A2_HZ_COUNT | PLACEBO_A1_HZ_COUNT | PLACEBO_HET_COUNT | PLACEBO_A2_HZ_COUNT |
|---|---|---|---|---|---|---|---|---|---|---|
| rs198460 | Genotyped | G | REC | 383 | 50 | 69 | 40 | 41 | 122 | 61 |
| rs603940 | Genotyped | G | REC | 383 | 19 | 77 | 63 | 43 | 103 | 78 |
| rs10021016 | Genotyped | G | GEN | 383 | 14 | 64 | 81 | 11 | 79 | 134 |
| rs1003148 | Imputed | C | ADD | 383 | 22 | 71 | 66 | 40 | 115 | 69 |
| rs1003148 | Imputed | C | GEN | 383 | 22 | 71 | 66 | 40 | 115 | 69 |
| rs1003148 | Imputed | C | REC | 383 | 22 | 71 | 66 | 40 | 115 | 69 |
| rs10046799 | Imputed | C | ADD | 381 | 44 | 82 | 32 | 92 | 104 | 27 |
| rs10046799 | Imputed | C | DOM | 381 | 44 | 82 | 32 | 92 | 104 | 27 |
| rs10051148 | Imputed | T | GEN | 383 | 16 | 55 | 88 | 23 | 105 | 96 |
| rs10054055 | Imputed | T | DOM | 383 | 17 | 55 | 87 | 24 | 105 | 95 |
| rs10067895 | Imputed | A | DOM | 379 | 17 | 55 | 84 | 24 | 107 | 92 |
| rs1008705 | Imputed | C | DOM | 276 | 13 | 60 | 44 | 14 | 71 | 74 |
| rs10105871 | Imputed | C | DOM | 355 | 23 | 73 | 52 | 32 | 86 | 89 |
| rs10116807 | Imputed | A | GEN | 376 | 10 | 52 | 94 | 5 | 71 | 144 |
| rs10121941 | Imputed | A | REC | 383 | 10 | 52 | 94 | 5 | 71 | 144 |
| rs10128638 | Genotyped | C | DOM | 383 | 2 | 16 | 141 | 3 | 44 | 177 |
| rs1012924 | Imputed | G | DOM | 383 | 39 | 72 | 48 | 64 | 111 | 49 |
| rs1012924 | Imputed | G | ADD | 383 | 1 | 20 | 138 | 3 | 46 | 175 |
| rs1016030 | Genotyped | G | ADD | 382 | 29 | 89 | 40 | 24 | 118 | 82 |

TABLE 10-continued

| SNP | Status | Allele | Model | | | | | | |
|---|---|---|---|---|---|---|---|---|---|
| rs1016030 | Genotyped | G | GEN | 382 | 29 | 89 | 40 | 24 | 118 | 82 |
| rs1017558 | Imputed | A | REC | 382 | 35 | 76 | 48 | 25 | 110 | 88 |
| rs10183431 | Imputed | T | DOM | 383 | 6 | 67 | 86 | 9 | 65 | 150 |
| rs10195401 | Imputed | C | DOM | 377 | 14 | 95 | 48 | 22 | 101 | 97 |
| rs10239416 | Imputed | A | DOM | 381 | 16 | 61 | 82 | 33 | 105 | 84 |
| rs1032188 | Imputed | G | GEN | 381 | 6 | 62 | 91 | 28 | 84 | 110 |
| rs1032188 | Imputed | G | REC | 381 | 6 | 62 | 91 | 28 | 84 | 110 |
| rs10468988 | Imputed | G | ADD | 380 | 17 | 71 | 70 | 12 | 94 | 116 |
| rs10478919 | Imputed | G | DOM | 383 | 18 | 54 | 87 | 24 | 105 | 95 |
| rs10506623 | Imputed | C | DOM | 383 | 18 | 74 | 67 | 33 | 123 | 68 |
| rs10506626 | Imputed | A | DOM | 371 | 18 | 72 | 62 | 33 | 125 | 61 |
| rs10509477 | Imputed | T | DOM | 383 | 16 | 69 | 74 | 20 | 84 | 120 |
| rs10511071 | Imputed | C | DOM | 383 | 0 | 41 | 118 | 1 | 27 | 196 |
| rs10511072 | Imputed | G | DOM | 383 | 0 | 41 | 118 | 1 | 27 | 196 |
| rs10511199 | Imputed | C | ADD | 379 | 10 | 65 | 82 | 6 | 74 | 142 |
| rs10513283 | Imputed | G | GEN | 383 | 11 | 46 | 102 | 6 | 69 | 149 |
| rs10520072 | Imputed | T | DOM | 383 | 17 | 56 | 86 | 24 | 107 | 93 |
| rs1065639 | Imputed | C | DOM | 364 | 19 | 86 | 48 | 20 | 97 | 94 |
| rs10733846 | Imputed | G | ADD | 381 | 3 | 41 | 113 | 6 | 80 | 138 |
| rs10733846 | Imputed | G | DOM | 381 | 3 | 41 | 113 | 6 | 80 | 138 |
| rs10737390 | Imputed | T | DOM | 367 | 22 | 69 | 65 | 33 | 110 | 68 |
| rs10749293 | Imputed | G | DOM | 382 | 16 | 69 | 74 | 19 | 84 | 120 |
| rs10752159 | Imputed | G | DOM | 382 | 5 | 64 | 90 | 8 | 57 | 158 |
| rs10753760 | Imputed | T | ADD | 374 | 31 | 72 | 51 | 27 | 96 | 97 |
| rs10753760 | Imputed | T | GEN | 374 | 31 | 72 | 51 | 27 | 96 | 97 |
| rs10757887 | Imputed | C | DOM | 383 | 9 | 44 | 106 | 18 | 86 | 120 |
| rs10758326 | Imputed | A | ADD | 382 | 19 | 77 | 63 | 36 | 118 | 69 |
| rs10758326 | Imputed | A | GEN | 382 | 19 | 77 | 63 | 36 | 118 | 69 |
| rs10758326 | Imputed | A | REC | 382 | 19 | 77 | 63 | 36 | 118 | 69 |
| rs10762236 | Genotyped | G | ADD | 383 | 3 | 42 | 114 | 6 | 80 | 138 |
| rs10765769 | Imputed | C | ADD | 378 | 31 | 89 | 37 | 26 | 120 | 75 |
| rs10765769 | Imputed | C | GEN | 378 | 31 | 89 | 37 | 26 | 120 | 75 |
| rs10784891 | Imputed | C | ADD | 372 | 22 | 68 | 65 | 32 | 123 | 62 |
| rs10784891 | Imputed | C | DOM | 372 | 22 | 68 | 65 | 32 | 123 | 62 |
| rs10787923 | Imputed | G | DOM | 383 | 16 | 69 | 74 | 19 | 84 | 121 |
| rs10787949 | Imputed | A | ADD | 382 | 17 | 68 | 74 | 19 | 86 | 118 |
| rs10787951 | Imputed | G | GEN | 382 | 17 | 68 | 74 | 19 | 86 | 118 |
| rs10787983 | Imputed | C | GEN | 382 | 16 | 68 | 74 | 20 | 84 | 120 |
| rs10788380 | Imputed | C | ADD | 377 | 51 | 79 | 27 | 60 | 103 | 57 |
| rs10788380 | Imputed | C | DOM | 377 | 51 | 79 | 27 | 60 | 103 | 57 |
| rs10788380 | Imputed | C | GEN | 377 | 51 | 79 | 27 | 60 | 103 | 57 |
| rs10814418 | Imputed | A | DOM | 383 | 2 | 16 | 141 | 3 | 44 | 177 |
| rs10831417 | Imputed | A | ADD | 383 | 30 | 89 | 40 | 23 | 118 | 83 |
| rs10831417 | Imputed | A | GEN | 383 | 30 | 89 | 40 | 23 | 118 | 83 |
| rs10831422 | Imputed | C | ADD | 378 | 29 | 86 | 43 | 22 | 116 | 82 |
| rs10831422 | Imputed | G | GEN | 378 | 29 | 86 | 43 | 22 | 116 | 82 |
| rs10862931 | Imputed | C | GEN | 377 | 15 | 65 | 75 | 34 | 99 | 89 |
| rs10865197 | Imputed | C | DOM | 383 | 6 | 67 | 86 | 9 | 65 | 150 |
| rs10871302 | Imputed | A | DOM | 382 | 4 | 36 | 119 | 2 | 44 | 177 |
| rs10877463 | Imputed | C | DOM | 381 | 15 | 65 | 78 | 25 | 114 | 84 |
| rs10877468 | Imputed | C | DOM | 375 | 15 | 63 | 77 | 25 | 113 | 82 |
| rs10879240 | Imputed | C | ADD | 383 | 26 | 68 | 65 | 38 | 124 | 62 |
| rs10879242 | Imputed | A | DOM | 383 | 19 | 74 | 66 | 34 | 122 | 68 |

TABLE 10-continued

| | | | | | | | | |
|---|---|---|---|---|---|---|---|---|
| rs10879245 | Imputed | G | DOM | 383 | 19 | 74 | 66 | 34 | 122 | 68 |
| rs10879249 | Imputed | T | DOM | 383 | 18 | 74 | 67 | 33 | 122 | 69 |
| rs10886452 | Imputed | A | DOM | 382 | 17 | 68 | 74 | 19 | 86 | 118 |
| rs10886463 | Imputed | C | DOM | 381 | 17 | 68 | 74 | 20 | 84 | 118 |
| rs10886465 | Imputed | A | DOM | 383 | 17 | 68 | 74 | 20 | 85 | 119 |
| rs10886526 | Imputed | C | DOM | 381 | 16 | 68 | 74 | 20 | 83 | 120 |
| rs10902437 | Imputed | G | ADD | 355 | 20 | 91 | 37 | 35 | 97 | 75 |
| rs10941126 | Imputed | G | DOM | 383 | 0 | 2 | 157 | 0 | 11 | 213 |
| rs10941126 | Imputed | G | ADD | 383 | 0 | 2 | 157 | 0 | 11 | 213 |
| rs10947871 | Imputed | A | DOM | 383 | 2 | 49 | 108 | 8 | 45 | 171 |
| rs10972978 | Imputed | G | DOM | 383 | 2 | 16 | 141 | 3 | 44 | 177 |
| rs10973012 | Imputed | A | DOM | 383 | 2 | 16 | 141 | 3 | 44 | 177 |
| rs10974028 | Genotyped | G | ADD | 383 | 4 | 31 | 124 | 7 | 67 | 150 |
| rs10974028 | Genotyped | G | DOM | 383 | 4 | 31 | 124 | 7 | 67 | 150 |
| rs11021302 | Imputed | A | ADD | 378 | 29 | 86 | 43 | 22 | 116 | 82 |
| rs11021302 | Imputed | A | GEN | 378 | 29 | 86 | 43 | 22 | 116 | 82 |
| rs11099644 | Imputed | G | REC | 382 | 27 | 76 | 48 | 25 | 110 | 87 |
| rs11138315 | Imputed | G | ADD | 364 | 35 | 23 | 129 | 6 | 44 | 88 |
| rs11149802 | Imputed | T | DOM | 382 | 0 | 36 | 119 | 2 | 44 | 162 |
| rs11116596 | Imputed | T | DOM | 383 | 4 | 54 | 87 | 24 | 105 | 177 |
| rs11178531 | Imputed | A | ADD | 381 | 18 | 69 | 61 | 40 | 124 | 95 |
| rs11178531 | Imputed | A | DOM | 381 | 27 | 69 | 61 | 40 | 124 | 60 |
| rs11178575 | Imputed | C | GEN | 382 | 27 | 73 | 59 | 25 | 111 | 87 |
| rs11178575 | Imputed | C | REC | 382 | 27 | 73 | 59 | 25 | 111 | 87 |
| rs11178577 | Imputed | T | GEN | 383 | 27 | 73 | 59 | 25 | 112 | 87 |
| rs11178577 | Imputed | T | REC | 383 | 27 | 73 | 59 | 25 | 112 | 87 |
| rs11178583 | Imputed | A | DOM | 383 | 18 | 74 | 67 | 33 | 122 | 69 |
| rs11178589 | Imputed | T | DOM | 382 | 18 | 74 | 67 | 33 | 121 | 69 |
| rs11178594 | Imputed | C | DOM | 383 | 18 | 74 | 67 | 33 | 123 | 68 |
| rs11178602 | Imputed | T | DOM | 383 | 18 | 71 | 69 | 33 | 122 | 69 |
| rs11178648 | Imputed | T | DOM | 382 | 17 | 68 | 74 | 19 | 122 | 118 |
| rs11198877 | Imputed | T | DOM | 383 | 16 | 69 | 74 | 20 | 86 | 120 |
| rs11198942 | Imputed | A | ADD | 378 | 2 | 29 | 126 | 4 | 84 | 164 |
| rs11221075 | Imputed | T | DOM | 382 | 18 | 53 | 87 | 24 | 53 | 95 |
| rs11242020 | Imputed | T | DOM | 381 | 17 | 56 | 85 | 24 | 105 | 92 |
| rs11242021 | Imputed | A | DOM | 380 | 16 | 57 | 86 | 21 | 107 | 93 |
| rs11242022 | Imputed | T | DOM | 379 | 17 | 56 | 85 | 23 | 106 | 92 |
| rs11242023 | Imputed | T | ADD | 382 | 8 | 55 | 96 | 10 | 45 | 168 |
| rs11149350 | Imputed | A | GEN | 382 | 24 | 72 | 61 | 23 | 81 | 118 |
| rs11150143 | Imputed | G | DOM | 383 | 6 | 43 | 110 | 5 | 46 | 173 |
| rs11576627 | Imputed | G | DOM | 383 | 6 | 43 | 110 | 5 | 46 | 173 |
| rs11576627 | Imputed | C | ADD | 380 | 12 | 59 | 82 | 26 | 103 | 92 |
| rs11602189 | Imputed | T | DOM | 374 | 0 | 27 | 129 | 0 | 20 | 200 |
| rs11605163 | Imputed | A | DOM | 376 | 21 | 69 | 68 | 37 | 112 | 75 |
| rs11615214 | Imputed | T | ADD | 382 | 21 | 69 | 68 | 37 | 112 | 75 |
| rs11615214 | Imputed | T | DOM | 382 | 4 | 36 | 119 | 2 | 45 | 178 |
| rs11642394 | Imputed | G | GEN | 383 | 9 | 73 | 77 | 11 | 81 | 142 |
| rs11644943 | Imputed | G | DOM | 380 | 6 | 37 | 116 | 6 | 68 | 146 |
| rs11656608 | Imputed | T | DOM | 383 | 4 | 34 | 121 | 12 | 72 | 144 |
| rs11661309 | Imputed | A | ADD | 383 | 4 | 34 | 121 | 12 | 68 | 144 |
| rs11661309 | Imputed | A | DOM | 382 | 11 | 61 | 86 | 10 | 61 | 153 |
| rs11666131 | Imputed | A | ADD | 379 | 0 | 2 | 157 | 0 | 11 | 209 |
| rs11743355 | Imputed | C | ADD | | | | | | | |

TABLE 10-continued

| SNP | Source | Allele | Model | N | | | | | |
|---|---|---|---|---|---|---|---|---|---|
| rs11743355 | Imputed | C | DOM | 379 | 0 | 2 | 157 | 11 | 209 |
| rs11746806 | Imputed | T | ADD | 383 | 0 | 2 | 157 | 11 | 213 |
| rs11746806 | Imputed | T | DOM | 383 | 0 | 2 | 157 | 11 | 213 |
| rs11746959 | Imputed | T | ADD | 383 | 0 | 2 | 157 | 11 | 213 |
| rs11746959 | Imputed | T | DOM | 383 | 0 | 2 | 157 | 11 | 213 |
| rs11749272 | Imputed | T | DOM | 383 | 18 | 54 | 87 | 105 | 95 |
| rs11901899 | Imputed | A | DOM | 378 | 18 | 68 | 87 | 73 | 133 |
| rs11901899 | Imputed | G | ADD | 380 | 0 | 17 | 70 | 52 | 168 |
| rs11926319 | Imputed | G | DOM | 380 | 0 | 17 | 140 | 52 | 168 |
| rs11926319 | Imputed | C | DOM | 378 | 17 | 46 | 140 | 94 | 112 |
| rs11956952 | Imputed | G | DOM | 377 | 24 | 77 | 56 | 87 | 94 |
| rs12025826 | Imputed | C | GEN | 378 | 14 | 75 | 69 | 105 | 82 |
| rs1204522 | Imputed | A | GEN | 378 | 14 | 75 | 68 | 106 | 82 |
| rs1204524 | Imputed | T | DOM | 379 | 17 | 55 | 84 | 107 | 92 |
| rs12153185 | Imputed | T | ADD | 382 | 1 | 28 | 129 | 14 | 208 |
| rs12182651 | Imputed | T | DOM | 382 | 1 | 28 | 129 | 14 | 208 |
| rs12182651 | Imputed | G | DOM | 237 | 1 | 34 | 62 | 27 | 112 |
| rs12193568 | Imputed | C | DOM | 204 | 5 | 32 | 43 | 55 | 58 |
| rs12264914 | Imputed | C | DOM | 352 | 13 | 55 | 77 | 105 | 82 |
| rs12307767 | Imputed | G | REC | 372 | 29 | 59 | 67 | 94 | 107 |
| rs1232298 | Imputed | C | ADD | 383 | 6 | 43 | 110 | 46 | 173 |
| rs12407412 | Imputed | C | DOM | 383 | 6 | 43 | 110 | 46 | 173 |
| rs12407412 | Imputed | G | DOM | 382 | 2 | 34 | 123 | 61 | 150 |
| rs12420184 | Imputed | A | DOM | 383 | 13 | 65 | 81 | 115 | 87 |
| rs12422750 | Imputed | A | ADD | 266 | 3 | 18 | 84 | 12 | 149 |
| rs12446951 | Imputed | A | DOM | 266 | 3 | 18 | 84 | 12 | 149 |
| rs12446951 | Imputed | G | DOM | 383 | 1 | 25 | 133 | 49 | 173 |
| rs12457400 | Imputed | C | DOM | 383 | 8 | 55 | 96 | 46 | 169 |
| rs1247340 | Imputed | C | DOM | 382 | 8 | 55 | 96 | 45 | 169 |
| rs1247341 | Imputed | G | ADD | 380 | 19 | 60 | 78 | 111 | 80 |
| rs12521291 | Imputed | T | ADD | 380 | 42 | 67 | 50 | 100 | 84 |
| rs12526849 | Imputed | C | ADD | 380 | 42 | 67 | 50 | 100 | 84 |
| rs12526849 | Imputed | T | GEN | 383 | 14 | 62 | 83 | 66 | 150 |
| rs12543110 | Imputed | G | DOM | 381 | 14 | 63 | 82 | 108 | 87 |
| rs12678600 | Imputed | A | DOM | 383 | 17 | 56 | 86 | 107 | 93 |
| rs12719415 | Imputed | T | DOM | 382 | 18 | 74 | 67 | 121 | 69 |
| rs12831292 | Imputed | G | DOM | 380 | 4 | 36 | 119 | 44 | 178 |
| rs12923993 | Imputed | C | DOM | 383 | 19 | 91 | 48 | 98 | 91 |
| rs12936964 | Imputed | G | ADD | 383 | 4 | 34 | 121 | 68 | 144 |
| rs12960663 | Imputed | C | ADD | 383 | 27 | 75 | 57 | 87 | 108 |
| rs13038146 | Imputed | C | GEN | 382 | 27 | 75 | 57 | 87 | 108 |
| rs13134222 | Imputed | A | GEN | 379 | 5 | 49 | 105 | 77 | 126 |
| rs13172910 | Imputed | A | DOM | 383 | 17 | 46 | 94 | 95 | 112 |
| rs13194907 | Imputed | A | DOM | 383 | 0 | 27 | 132 | 15 | 208 |
| rs13195745 | Imputed | A | ADD | 383 | 0 | 27 | 132 | 15 | 208 |
| rs13195745 | Imputed | A | DOM | 383 | 0 | 27 | 132 | 15 | 208 |
| rs1321432 | Imputed | A | REC | 383 | 26 | 73 | 60 | 116 | 86 |
| rs1321457 | Imputed | G | REC | 383 | 26 | 71 | 62 | 112 | 89 |
| rs13265054 | Imputed | T | DOM | 381 | 14 | 63 | 82 | 108 | 87 |
| rs13282131 | Imputed | C | GEN | 383 | 44 | 77 | 38 | 105 | 72 |
| rs13353526 | Imputed | C | DOM | 383 | 0 | 42 | 117 | 29 | 194 |
| rs1336382 | Imputed | T | DOM | 383 | 16 | 69 | 74 | 84 | 120 |

TABLE 10-continued

| SNP | Status | Allele | Model | N1 | N2 | N3 | N4 | N5 |
|---|---|---|---|---|---|---|---|---|
| rs1336383 | Imputed | T | DOM | 383 | 16 | 69 | 74 | 20 | 84 | 120 |
| rs1336407 | Imputed | T | DOM | 383 | 16 | 69 | 74 | 20 | 84 | 120 |
| rs1336409 | Imputed | T | DOM | 382 | 16 | 69 | 74 | 20 | 84 | 119 |
| rs1336596 | Imputed | A | DOM | 380 | 18 | 67 | 73 | 25 | 118 | 79 |
| rs1343560 | Imputed | T | ADD | 383 | 1 | 20 | 138 | 3 | 46 | 175 |
| rs1361987 | Imputed | T | DOM | 383 | 1 | 20 | 138 | 3 | 46 | 175 |
| rs1386153 | Imputed | T | GEN | 383 | 14 | 75 | 70 | 31 | 109 | 84 |
| rs1386153 | Imputed | T | ADD | 379 | 12 | 60 | 85 | 27 | 102 | 93 |
| rs1394015 | Imputed | T | DOM | 379 | 12 | 60 | 85 | 27 | 102 | 93 |
| rs1407038 | Imputed | C | DOM | 356 | 27 | 83 | 34 | 27 | 107 | 78 |
| rs1407039 | Imputed | A | REC | 382 | 26 | 70 | 62 | 23 | 112 | 89 |
| rs1412802 | Imputed | A | REC | 379 | 26 | 70 | 61 | 23 | 113 | 86 |
| rs1414865 | Imputed | T | GEN | 381 | 8 | 58 | 93 | 24 | 87 | 111 |
| rs1414873 | Imputed | T | DOM | 382 | 17 | 68 | 74 | 19 | 86 | 118 |
| rs1414876 | Imputed | A | DOM | 383 | 16 | 69 | 74 | 20 | 84 | 120 |
| rs1418671 | Imputed | C | DOM | 383 | 16 | 69 | 74 | 20 | 84 | 120 |
| rs1419490 | Genotyped | C | REC | 377 | 39 | 66 | 53 | 30 | 122 | 67 |
| rs1434507 | Imputed | T | GEN | 383 | 14 | 75 | 70 | 31 | 108 | 85 |
| rs1434508 | Imputed | A | ADD | 381 | 17 | 71 | 71 | 13 | 93 | 116 |
| rs1435205 | Imputed | T | ADD | 382 | 17 | 71 | 71 | 13 | 94 | 116 |
| rs1443928 | Imputed | A | ADD | 379 | 10 | 65 | 82 | 6 | 74 | 142 |
| rs1452235 | Imputed | C | REC | 380 | 31 | 76 | 51 | 73 | 108 | 41 |
| rs1452236 | Imputed | G | GEN | 383 | 16 | 67 | 76 | 36 | 99 | 89 |
| rs1452237 | Imputed | G | GEN | 383 | 16 | 67 | 76 | 36 | 99 | 89 |
| rs1452243 | Genotyped | T | GEN | 383 | 16 | 67 | 76 | 36 | 99 | 89 |
| rs1463768 | Genotyped | G | REC | 383 | 36 | 59 | 64 | 22 | 118 | 84 |
| rs1463769 | Imputed | G | REC | 383 | 36 | 59 | 64 | 22 | 118 | 84 |
| rs1472435 | Imputed | A | ADD | 374 | 0 | 13 | 144 | 0 | 42 | 175 |
| rs1472435 | Imputed | A | DOM | 374 | 0 | 13 | 144 | 0 | 42 | 175 |
| rs1476714 | Imputed | G | DOM | 381 | 17 | 55 | 86 | 24 | 106 | 93 |
| rs1495159 | Imputed | G | ADD | 377 | 11 | 46 | 98 | 27 | 85 | 110 |
| rs1495159 | Imputed | G | GEN | 377 | 11 | 46 | 98 | 27 | 85 | 110 |
| rs1495375 | Imputed | A | DOM | 383 | 19 | 74 | 66 | 34 | 122 | 68 |
| rs1495376 | Imputed | T | DOM | 371 | 35 | 63 | 56 | 48 | 126 | 43 |
| rs1495377 | Imputed | G | DOM | 370 | 35 | 63 | 56 | 48 | 125 | 43 |
| rs1495381 | Imputed | G | GEN | 383 | 40 | 68 | 51 | 34 | 117 | 73 |
| rs1495381 | Imputed | T | REC | 383 | 40 | 68 | 51 | 34 | 117 | 73 |
| rs1498992 | Imputed | G | DOM | 383 | 14 | 59 | 86 | 16 | 106 | 102 |
| rs1499001 | Imputed | T | DOM | 378 | 11 | 55 | 93 | 11 | 99 | 109 |
| rs1512988 | Imputed | A | DOM | 380 | 18 | 73 | 67 | 33 | 122 | 67 |
| rs1512989 | Imputed | T | DOM | 380 | 18 | 73 | 67 | 33 | 122 | 67 |
| rs1512991 | Imputed | T | ADD | 382 | 25 | 68 | 65 | 38 | 124 | 62 |
| rs1512991 | Imputed | T | DOM | 382 | 25 | 68 | 63 | 38 | 124 | 62 |
| rs1516855 | Imputed | G | REC | 382 | 27 | 69 | 69 | 17 | 117 | 89 |
| rs1527450 | Imputed | A | ADD | 383 | 30 | 89 | 40 | 23 | 118 | 83 |
| rs1527450 | Imputed | T | GEN | 383 | 30 | 89 | 40 | 23 | 118 | 83 |
| rs1567740 | Imputed | T | DOM | 381 | 18 | 74 | 67 | 33 | 122 | 67 |
| rs1572573 | Imputed | A | ADD | 362 | 3 | 58 | 87 | 6 | 59 | 149 |
| rs1572573 | Imputed | A | DOM | 362 | 3 | 58 | 87 | 6 | 59 | 149 |
| rs1584003 | Imputed | C | DOM | 380 | 38 | 89 | 30 | 50 | 112 | 61 |
| rs1584005 | Imputed | C | DOM | 380 | 38 | 89 | 30 | 50 | 112 | 61 |
| rs1585771 | Imputed | G | ADD | 382 | 15 | 70 | 73 | 10 | 88 | 126 |

TABLE 10-continued

| | | | | | | | | |
|---|---|---|---|---|---|---|---|---|
| rs1592015 | Imputed | G | DOM | 383 | 4 | 32 | 123 | 7 | 61 | 156 |
| rs1594885 | Imputed | A | ADD | 380 | 17 | 72 | 69 | 13 | 94 | 115 |
| rs1603232 | Imputed | A | DOM | 370 | 35 | 62 | 56 | 47 | 125 | 45 |
| rs1614565 | Imputed | C | DOM | 372 | 36 | 64 | 54 | 48 | 127 | 43 |
| rs1648200 | Imputed | G | ADD | 363 | 9 | 70 | 71 | 6 | 83 | 124 |
| rs16877387 | Imputed | C | GEN | 382 | 30 | 68 | 60 | 22 | 113 | 89 |
| rs16877387 | Imputed | C | REC | 382 | 30 | 68 | 60 | 22 | 113 | 89 |
| rs16938626 | Imputed | G | DOM | 382 | 9 | 55 | 94 | 17 | 104 | 103 |
| rs1694334 | Imputed | G | ADD | 351 | 6 | 37 | 106 | 11 | 78 | 113 |
| rs16998821 | Imputed | C | DOM | 383 | 4 | 32 | 123 | 7 | 61 | 156 |
| rs1700400 | Imputed | T | ADD | 362 | 6 | 47 | 101 | 25 | 76 | 107 |
| rs17007620 | Imputed | G | ADD | 363 | 13 | 64 | 73 | 9 | 71 | 133 |
| rs17007620 | Imputed | G | DOM | 363 | 13 | 64 | 73 | 9 | 71 | 133 |
| rs17023290 | Imputed | C | DOM | 383 | 0 | 41 | 118 | 1 | 27 | 196 |
| rs17047957 | Imputed | C | DOM | 383 | 5 | 42 | 112 | 3 | 41 | 180 |
| rs1705237 | Imputed | A | DOM | 369 | 36 | 62 | 54 | 48 | 126 | 43 |
| rs1705261 | Imputed | A | GEN | 383 | 40 | 68 | 51 | 34 | 117 | 73 |
| rs1705261 | Imputed | A | REC | 383 | 40 | 68 | 51 | 34 | 117 | 73 |
| rs17076972 | Imputed | C | ADD | 383 | 44 | 77 | 38 | 38 | 117 | 69 |
| rs17076972 | Imputed | C | GEN | 383 | 44 | 77 | 38 | 38 | 117 | 69 |
| rs17076972 | Imputed | C | REC | 383 | 44 | 77 | 38 | 38 | 117 | 69 |
| rs17189710 | Imputed | T | ADD | 383 | 27 | 75 | 57 | 29 | 87 | 108 |
| rs17189710 | Imputed | T | GEN | 383 | 27 | 75 | 57 | 29 | 87 | 108 |
| rs17196143 | Imputed | A | ADD | 383 | 10 | 53 | 96 | 4 | 64 | 156 |
| rs17353809 | Imputed | G | ADD | 382 | 11 | 66 | 81 | 6 | 76 | 142 |
| rs17368986 | Imputed | A | GEN | 381 | 11 | 46 | 102 | 6 | 68 | 148 |
| rs17369097 | Imputed | A | GEN | 383 | 12 | 45 | 102 | 6 | 70 | 148 |
| rs17434511 | Imputed | C | GEN | 383 | 11 | 46 | 102 | 6 | 69 | 149 |
| rs17434589 | Imputed | C | GEN | 376 | 11 | 44 | 100 | 6 | 69 | 146 |
| rs17434603 | Imputed | C | GEN | 383 | 11 | 46 | 102 | 6 | 69 | 149 |
| rs17434840 | Imputed | G | GEN | 383 | 12 | 45 | 102 | 6 | 70 | 148 |
| rs17446418 | Imputed | T | DOM | 382 | 22 | 67 | 70 | 35 | 110 | 78 |
| rs17530747 | Imputed | C | DOM | 382 | 22 | 67 | 70 | 35 | 110 | 78 |
| rs17604285 | Imputed | C | ADD | 383 | 0 | 20 | 139 | 2 | 54 | 168 |
| rs17604285 | Imputed | C | DOM | 383 | 0 | 20 | 139 | 2 | 54 | 168 |
| rs17662322 | Imputed | T | DOM | 383 | 5 | 45 | 109 | 8 | 82 | 134 |
| rs17769826 | Imputed | C | ADD | 382 | 11 | 66 | 81 | 6 | 76 | 142 |
| rs17821641 | Imputed | T | ADD | 379 | 10 | 65 | 82 | 6 | 74 | 142 |
| rs1782328 | Imputed | A | ADD | 356 | 3 | 35 | 112 | 6 | 75 | 125 |
| rs1796337 | Imputed | T | DOM | 379 | 37 | 68 | 53 | 56 | 119 | 46 |
| rs1798083 | Imputed | C | DOM | 370 | 35 | 64 | 54 | 48 | 126 | 43 |
| rs1798085 | Imputed | C | DOM | 372 | 36 | 64 | 54 | 48 | 127 | 43 |
| rs1798086 | Imputed | T | DOM | 383 | 36 | 63 | 109 | 48 | 126 | 43 |
| rs1798089 | Imputed | T | ADD | 371 | 46 | 64 | 42 | 41 | 82 | 68 |
| rs1798089 | Imputed | T | REC | 371 | 46 | 64 | 42 | 41 | 76 | 68 |
| rs1798090 | Imputed | A | ADD | 371 | 46 | 65 | 41 | 41 | 74 | 68 |
| rs1798090 | Imputed | A | GEN | 371 | 46 | 65 | 41 | 41 | 75 | 68 |
| rs1798090 | Imputed | A | REC | 371 | 46 | 65 | 41 | 41 | 110 | 68 |
| rs1832222 | Imputed | C | DOM | 382 | 16 | 68 | 74 | 20 | 84 | 120 |
| rs1838104 | Imputed | G | ADD | 370 | 38 | 66 | 50 | 69 | 109 | 38 |
| rs1838104 | Imputed | G | GEN | 370 | 38 | 66 | 50 | 69 | 109 | 38 |
| rs1868616 | Imputed | A | ADD | 372 | 4 | 46 | 105 | 8 | 82 | 127 |
| rs1874313 | Imputed | A | DOM | 382 | 18 | 74 | 67 | 33 | 123 | 67 |
| rs1884902 | Imputed | C | REC | 379 | 26 | 70 | 61 | 22 | 114 | 86 |

TABLE 10-continued

| | | | | | | | | | |
|---|---|---|---|---|---|---|---|---|---|
| rs1913201 | Imputed | G | ADD | 383 | 26 | 68 | 65 | 38 | 124 | 62 |
| rs1913201 | Imputed | G | DOM | 383 | 26 | 68 | 65 | 38 | 124 | 62 |
| rs1913201 | Imputed | G | GEN | 383 | 26 | 68 | 65 | 38 | 124 | 62 |
| rs1944279 | Imputed | A | ADD | 377 | 17 | 71 | 69 | 12 | 94 | 114 |
| rs198461 | Imputed | C | DOM | 382 | 40 | 69 | 50 | 61 | 121 | 41 |
| rs1987179 | Imputed | T | DOM | 383 | 10 | 44 | 105 | 10 | 87 | 127 |
| rs1990023 | Imputed | T | DOM | 382 | 18 | 53 | 87 | 24 | 105 | 95 |
| rs2016194 | Imputed | G | DOM | 381 | 17 | 56 | 85 | 24 | 107 | 92 |
| rs2024789 | Imputed | C | DOM | 381 | 31 | 80 | 47 | 60 | 112 | 51 |
| rs2024789 | Imputed | C | GEN | 381 | 31 | 80 | 47 | 60 | 112 | 51 |
| rs2024902 | Imputed | A | ADD | 382 | 0 | 27 | 131 | 1 | 15 | 208 |
| rs2024902 | Imputed | A | DOM | 382 | 0 | 27 | 131 | 1 | 15 | 208 |
| rs2025107 | Imputed | A | ADD | 382 | 1 | 28 | 129 | 2 | 14 | 208 |
| rs2025107 | Imputed | A | DOM | 382 | 1 | 28 | 129 | 2 | 14 | 208 |
| rs2025108 | Imputed | T | ADD | 382 | 1 | 28 | 129 | 2 | 14 | 208 |
| rs2025108 | Imputed | T | DOM | 382 | 1 | 28 | 129 | 2 | 14 | 208 |
| rs2062448 | Imputed | T | ADD | 383 | 0 | 20 | 139 | 2 | 54 | 168 |
| rs2062448 | Imputed | T | DOM | 383 | 0 | 20 | 139 | 2 | 54 | 168 |
| rs2063591 | Imputed | C | ADD | 382 | 27 | 69 | 62 | 40 | 124 | 60 |
| rs2063591 | Imputed | C | DOM | 382 | 27 | 69 | 62 | 40 | 124 | 60 |
| rs2065604 | Imputed | C | DOM | 383 | 2 | 16 | 141 | 3 | 44 | 177 |
| rs2066238 | Imputed | T | DOM | 383 | 4 | 32 | 123 | 7 | 61 | 156 |
| rs2068051 | Imputed | G | ADD | 264 | 20 | 60 | 31 | 38 | 88 | 27 |
| rs2068051 | Imputed | G | GEN | 264 | 20 | 60 | 31 | 38 | 88 | 27 |
| rs2077702 | Genotyped | G | GEN | 383 | 27 | 73 | 59 | 25 | 112 | 87 |
| rs208757 | Imputed | G | ADD | 345 | 5 | 48 | 91 | 6 | 51 | 144 |
| rs208757 | Imputed | G | DOM | 345 | 5 | 48 | 91 | 6 | 51 | 144 |
| rs2095586 | Imputed | A | DOM | 382 | 16 | 68 | 74 | 20 | 84 | 120 |
| rs2108426 | Imputed | C | DOM | 381 | 17 | 55 | 86 | 24 | 106 | 93 |
| rs2110664 | Imputed | A | DOM | 349 | 18 | 62 | 64 | 16 | 71 | 118 |
| rs2132242 | Imputed | A | DOM | 382 | 18 | 74 | 67 | 33 | 122 | 68 |
| rs2151644 | Imputed | T | DOM | 383 | 2 | 16 | 141 | 3 | 44 | 177 |
| rs2157752 | Genotyped | A | GEN | 383 | 11 | 74 | 74 | 27 | 105 | 92 |
| rs2158958 | Imputed | A | DOM | 383 | 17 | 56 | 86 | 24 | 107 | 93 |
| rs2158961 | Imputed | G | DOM | 383 | 17 | 55 | 87 | 24 | 105 | 95 |
| rs2164099 | Imputed | G | ADD | 382 | 17 | 72 | 70 | 13 | 94 | 116 |
| rs2173254 | Imputed | G | GEN | 381 | 7 | 81 | 70 | 25 | 103 | 95 |
| rs2173254 | Imputed | T | REC | 381 | 7 | 81 | 70 | 25 | 103 | 95 |
| rs2188079 | Imputed | C | ADD | 383 | 32 | 82 | 45 | 28 | 107 | 89 |
| rs2188079 | Imputed | C | GEN | 383 | 32 | 82 | 45 | 28 | 107 | 89 |
| rs2190304 | Imputed | G | REC | 383 | 27 | 83 | 49 | 55 | 99 | 70 |
| rs2190597 | Imputed | T | DOM | 381 | 29 | 73 | 55 | 40 | 117 | 67 |
| rs2190598 | Imputed | T | DOM | 383 | 17 | 56 | 86 | 24 | 107 | 93 |
| rs2190600 | Imputed | A | DOM | 382 | 17 | 55 | 84 | 13 | 107 | 92 |
| rs2218084 | Imputed | T | GEN | 383 | 7 | 81 | 98 | 2 | 59 | 163 |
| rs2218084 | Imputed | T | REC | 383 | 7 | 81 | 98 | 2 | 59 | 163 |
| rs2236290 | Genotyped | C | GEN | 381 | 6 | 82 | 68 | 37 | 106 | 80 |
| rs2243860 | Imputed | A | GEN | 306 | 17 | 82 | 47 | 17 | 84 | 82 |
| rs2243860 | Imputed | A | REC | 306 | 17 | 82 | 47 | 17 | 84 | 82 |
| rs2246564 | Imputed | T | DOM | 383 | 2 | 16 | 141 | 3 | 44 | 177 |
| rs2248236 | Imputed | C | DOM | 383 | 10 | 44 | 105 | 10 | 87 | 127 |
| rs2250340 | Imputed | T | DOM | 333 | 2 | 16 | 119 | 3 | 44 | 149 |
| rs2257192 | Imputed | G | DOM | 383 | 2 | 16 | 141 | 3 | 44 | 177 |

TABLE 10-continued

| SNP | | Allele | Model | | | | | |
|---|---|---|---|---|---|---|---|---|
| rs2270584 | Imputed | A | DOM | 382 | 18 | 71 | 69 | 33 | 122 | 69 |
| rs2270586 | Imputed | A | DOM | 371 | 18 | 72 | 62 | 33 | 125 | 61 |
| rs2270589 | Imputed | A | ADD | 308 | 25 | 58 | 45 | 37 | 109 | 34 |
| rs2270589 | Imputed | A | DOM | 308 | 25 | 58 | 45 | 37 | 109 | 34 |
| rs2270589 | Imputed | A | GEN | 308 | 25 | 58 | 45 | 37 | 109 | 34 |
| rs2296889 | Imputed | C | DOM | 381 | 7 | 49 | 103 | 3 | 47 | 172 |
| rs2301346 | Imputed | C | ADD | 343 | 12 | 78 | 56 | 13 | 73 | 111 |
| rs2301346 | Imputed | C | DOM | 343 | 12 | 78 | 56 | 13 | 73 | 111 |
| rs2327929 | Imputed | G | REC | 383 | 42 | 68 | 49 | 38 | 120 | 66 |
| rs2357486 | Imputed | C | REC | 379 | 14 | 77 | 67 | 12 | 116 | 93 |
| rs2373793 | Imputed | G | DOM | 374 | 4 | 61 | 88 | 8 | 59 | 154 |
| rs2377622 | Imputed | T | GEN | 283 | 9 | 48 | 60 | 23 | 73 | 70 |
| rs2377622 | Imputed | T | REC | 283 | 9 | 48 | 60 | 23 | 73 | 70 |
| rs2383903 | Imputed | G | DOM | 381 | 9 | 56 | 93 | 17 | 104 | 102 |
| rs2389866 | Imputed | C | DOM | 383 | 10 | 44 | 105 | 10 | 87 | 127 |
| rs2389869 | Imputed | C | DOM | 383 | 10 | 44 | 105 | 10 | 87 | 127 |
| rs2418541 | Imputed | A | DOM | 383 | 18 | 54 | 87 | 24 | 105 | 95 |
| rs2418542 | Imputed | A | DOM | 383 | 18 | 54 | 87 | 24 | 105 | 95 |
| rs2418548 | Imputed | C | DOM | 378 | 19 | 55 | 83 | 25 | 104 | 92 |
| rs2476976 | Imputed | C | DOM | 382 | 16 | 68 | 74 | 20 | 84 | 120 |
| rs2483639 | Imputed | A | DOM | 383 | 2 | 16 | 141 | 3 | 44 | 177 |
| rs2483640 | Imputed | A | DOM | 383 | 2 | 16 | 141 | 3 | 44 | 177 |
| rs2544780 | Imputed | T | REC | 381 | 20 | 61 | 76 | 17 | 108 | 99 |
| rs2586458 | Imputed | T | DOM | 323 | 2 | 24 | 115 | 3 | 59 | 120 |
| rs2593272 | Imputed | G | ADD | 383 | 7 | 51 | 101 | 28 | 84 | 112 |
| rs2593273 | Imputed | T | ADD | 383 | 7 | 51 | 101 | 28 | 84 | 112 |
| rs2622499 | Imputed | G | DOM | 383 | 10 | 44 | 105 | 10 | 87 | 127 |
| rs264126 | Imputed | G | DOM | 381 | 30 | 71 | 56 | 40 | 115 | 69 |
| rs264129 | Imputed | T | DOM | 383 | 17 | 55 | 87 | 24 | 105 | 95 |
| rs2656822 | Imputed | T | ADD | 383 | 7 | 51 | 101 | 28 | 84 | 112 |
| rs2656823 | Imputed | G | ADD | 383 | 7 | 51 | 101 | 28 | 84 | 112 |
| rs2656825 | Imputed | T | ADD | 362 | 3 | 48 | 101 | 20 | 79 | 111 |
| rs2764766 | Imputed | C | REC | 383 | 21 | 62 | 76 | 17 | 108 | 99 |
| rs2793101 | Imputed | T | ADD | 383 | 1 | 25 | 133 | 1 | 53 | 170 |
| rs2793101 | Imputed | T | DOM | 383 | 1 | 25 | 133 | 1 | 53 | 170 |
| rs2795871 | Imputed | A | ADD | 382 | 0 | 12 | 147 | 0 | 40 | 183 |
| rs2795886 | Imputed | A | ADD | 383 | 0 | 10 | 149 | 0 | 36 | 188 |
| rs2795886 | Imputed | A | DOM | 383 | 0 | 10 | 149 | 0 | 36 | 188 |
| rs2859994 | Imputed | G | GEN | 378 | 33 | 81 | 42 | 28 | 114 | 80 |
| rs2870464 | Imputed | G | DOM | 383 | 2 | 31 | 126 | 2 | 33 | 189 |
| rs2875528 | Imputed | T | DOM | 383 | 0 | 41 | 118 | 1 | 27 | 196 |
| rs2876227 | Imputed | C | ADD | 380 | 27 | 74 | 55 | 30 | 90 | 104 |
| rs2876227 | Imputed | C | GEN | 380 | 27 | 74 | 55 | 30 | 90 | 104 |
| rs2882097 | Imputed | A | DOM | 383 | 16 | 69 | 74 | 20 | 84 | 120 |
| rs2921983 | Imputed | C | ADD | 375 | 6 | 48 | 101 | 27 | 81 | 112 |
| rs2987537 | Imputed | C | DOM | 383 | 2 | 25 | 132 | 4 | 54 | 166 |
| rs2996416 | Imputed | C | ADD | 382 | 1 | 20 | 137 | 3 | 46 | 175 |
| rs3015527 | Imputed | C | DOM | 377 | 1 | 20 | 135 | 3 | 46 | 173 |
| rs3015527 | Imputed | C | ADD | 377 | 1 | 20 | 135 | 3 | 45 | 173 |
| rs3015530 | Imputed | C | DOM | 383 | 1 | 20 | 138 | 3 | 46 | 175 |
| rs3015530 | Imputed | C | ADD | 383 | 1 | 20 | 138 | 3 | 46 | 175 |
| rs3015531 | Imputed | T | ADD | 383 | 1 | 20 | 138 | 3 | 46 | 175 |

TABLE 10-continued

| SNP | Type | Allele | Model | N | | | | | |
|---|---|---|---|---|---|---|---|---|---|
| rs3015531 | Imputed | T | DOM | 383 | 1 | 20 | 138 | 3 | 46 | 175 |
| rs3015535 | Imputed | C | ADD | 383 | 1 | 20 | 138 | 3 | 46 | 175 |
| rs3015535 | Imputed | C | DOM | 383 | 1 | 20 | 138 | 3 | 46 | 175 |
| rs3019407 | Imputed | A | GEN | 381 | 7 | 81 | 70 | 26 | 101 | 96 |
| rs3019407 | Imputed | A | REC | 381 | 7 | 81 | 70 | 26 | 101 | 96 |
| rs36071725 | Genotyped | C | GEN | 383 | 24 | 78 | 57 | 24 | 96 | 104 |
| rs373983 | Imputed | G | DOM | 380 | 24 | 84 | 49 | 38 | 104 | 81 |
| rs3756154 | Imputed | C | DOM | 383 | 10 | 44 | 105 | 10 | 87 | 127 |
| rs3793044 | Imputed | C | ADD | 383 | 0 | 27 | 132 | 1 | 15 | 208 |
| rs3793044 | Imputed | C | DOM | 383 | 0 | 27 | 132 | 1 | 15 | 208 |
| rs3793053 | Imputed | C | ADD | 380 | 1 | 27 | 130 | 2 | 14 | 206 |
| rs3793053 | Imputed | C | DOM | 380 | 1 | 27 | 130 | 2 | 14 | 206 |
| rs3796246 | Imputed | G | ADD | 383 | 0 | 17 | 142 | 3 | 52 | 169 |
| rs3796246 | Imputed | G | DOM | 383 | 0 | 17 | 142 | 3 | 52 | 169 |
| rs3805996 | Imputed | G | ADD | 382 | 0 | 27 | 131 | 1 | 15 | 208 |
| rs3805996 | Imputed | G | DOM | 382 | 0 | 27 | 131 | 1 | 15 | 208 |
| rs3806003 | Imputed | A | ADD | 383 | 0 | 27 | 132 | 1 | 15 | 208 |
| rs3806003 | Imputed | A | DOM | 383 | 0 | 27 | 132 | 1 | 15 | 208 |
| rs3806004 | Imputed | T | ADD | 382 | 1 | 29 | 128 | 2 | 14 | 208 |
| rs3806004 | Imputed | T | DOM | 382 | 1 | 29 | 128 | 2 | 14 | 208 |
| rs3806010 | Imputed | T | ADD | 382 | 1 | 28 | 129 | 2 | 14 | 208 |
| rs3806010 | Imputed | T | DOM | 382 | 1 | 28 | 129 | 2 | 14 | 208 |
| rs3806014 | Imputed | A | ADD | 382 | 1 | 28 | 129 | 2 | 14 | 208 |
| rs3806014 | Imputed | A | DOM | 382 | 1 | 28 | 129 | 2 | 14 | 208 |
| rs3806015 | Imputed | A | ADD | 382 | 1 | 28 | 129 | 2 | 14 | 208 |
| rs3806015 | Imputed | A | DOM | 382 | 1 | 28 | 129 | 2 | 14 | 208 |
| rs3806018 | Imputed | A | ADD | 382 | 1 | 28 | 129 | 2 | 14 | 208 |
| rs3806018 | Imputed | A | DOM | 382 | 1 | 28 | 129 | 2 | 14 | 208 |
| rs3806019 | Imputed | A | ADD | 382 | 1 | 28 | 129 | 2 | 14 | 208 |
| rs3806019 | Imputed | A | DOM | 382 | 1 | 28 | 131 | 2 | 14 | 208 |
| rs3806024 | Imputed | T | ADD | 382 | 1 | 27 | 131 | 2 | 14 | 207 |
| rs3806024 | Imputed | T | DOM | 382 | 1 | 27 | 131 | 2 | 14 | 207 |
| rs3847825 | Imputed | G | ADD | 382 | 21 | 69 | 68 | 36 | 115 | 73 |
| rs3847825 | Imputed | G | GEN | 382 | 21 | 69 | 68 | 36 | 115 | 73 |
| rs3852001 | Genotyped | C | REC | 383 | 12 | 45 | 102 | 6 | 70 | 148 |
| rs3852001 | Genotyped | C | GEN | 383 | 12 | 45 | 102 | 6 | 70 | 148 |
| rs3852002 | Imputed | G | GEN | 383 | 12 | 45 | 102 | 6 | 70 | 148 |
| rs3852002 | Imputed | G | REC | 383 | 12 | 45 | 102 | 6 | 70 | 148 |
| rs3852003 | Imputed | A | GEN | 383 | 12 | 45 | 102 | 6 | 70 | 148 |
| rs3852003 | Imputed | A | REC | 383 | 12 | 45 | 102 | 6 | 70 | 148 |
| rs3942254 | Imputed | T | DOM | 351 | 18 | 61 | 64 | 33 | 109 | 66 |
| rs3945085 | Imputed | A | DOM | 383 | 16 | 69 | 74 | 19 | 84 | 121 |
| rs399485 | Imputed | A | DOM | 382 | 15 | 77 | 67 | 20 | 92 | 111 |
| rs4029119 | Imputed | G | ADD | 382 | 0 | 1 | 157 | 0 | 11 | 213 |
| rs4029119 | Imputed | G | DOM | 382 | 0 | 1 | 157 | 0 | 11 | 213 |
| rs412791 | Imputed | C | GEN | 367 | 13 | 73 | 70 | 28 | 99 | 84 |
| rs4146972 | Genotyped | T | DOM | 383 | 5 | 42 | 112 | 3 | 42 | 179 |
| rs4259369 | Imputed | C | REC | 383 | 21 | 85 | 53 | 60 | 112 | 52 |
| rs4273613 | Imputed | T | ADD | 383 | 0 | 2 | 157 | 0 | 11 | 213 |
| rs4273613 | Imputed | T | DOM | 383 | 0 | 2 | 157 | 0 | 11 | 213 |
| rs4294022 | Imputed | C | DOM | 383 | 9 | 50 | 100 | 11 | 102 | 111 |
| rs4310554 | Genotyped | C | DOM | 383 | 51 | 81 | 27 | 62 | 105 | 57 |
| rs4315598 | Imputed | T | ADD | 382 | 27 | 75 | 57 | 29 | 87 | 107 |

TABLE 10-continued

| SNP | Status | Allele | Model | N | c1 | c2 | c3 | c4 | c5 |
|---|---|---|---|---|---|---|---|---|---|
| rs4315598 | Imputed | T | GEN | 382 | 27 | 75 | 57 | 29 | 87 | 107 |
| rs4370878 | Imputed | G | DOM | 383 | 16 | 69 | 74 | 19 | 84 | 121 |
| rs4436200 | Imputed | C | ADD | 383 | 0 | 30 | 129 | 7 | 54 | 163 |
| rs4444612 | Imputed | G | ADD | 383 | 27 | 75 | 57 | 29 | 87 | 108 |
| rs4444612 | Imputed | G | GEN | 383 | 27 | 75 | 57 | 29 | 87 | 108 |
| rs4450660 | Imputed | C | DOM | 383 | 6 | 67 | 86 | 9 | 65 | 150 |
| rs4463950 | Imputed | C | DOM | 379 | 27 | 64 | 67 | 53 | 104 | 64 |
| rs4509702 | Imputed | G | DOM | 383 | 16 | 69 | 74 | 19 | 84 | 121 |
| rs4533379 | Imputed | G | ADD | 380 | 17 | 72 | 69 | 13 | 94 | 115 |
| rs4569984 | Imputed | A | DOM | 374 | 9 | 49 | 98 | 10 | 103 | 105 |
| rs4570530 | Imputed | C | DOM | 383 | 16 | 69 | 74 | 19 | 84 | 121 |
| rs4571583 | Imputed | T | DOM | 383 | 9 | 49 | 101 | 10 | 103 | 111 |
| rs4586678 | Imputed | A | DOM | 383 | 6 | 67 | 86 | 9 | 65 | 150 |
| rs4615971 | Imputed | C | DOM | 382 | 16 | 68 | 74 | 20 | 84 | 120 |
| rs4629229 | Imputed | G | DOM | 383 | 4 | 32 | 123 | 7 | 61 | 156 |
| rs4632512 | Imputed | G | DOM | 383 | 12 | 45 | 102 | 6 | 70 | 148 |
| rs4641552 | Imputed | T | GEN | 377 | 1 | 19 | 136 | 2 | 48 | 171 |
| rs4682527 | Imputed | A | ADD | 364 | 19 | 86 | 48 | 20 | 97 | 94 |
| rs4688632 | Imputed | C | DOM | 373 | 37 | 77 | 40 | 72 | 94 | 53 |
| rs4702720 | Imputed | G | REC | 320 | 3 | 38 | 92 | 11 | 62 | 114 |
| rs4702720 | Imputed | A | ADD | 320 | 3 | 38 | 92 | 11 | 62 | 114 |
| rs4714484 | Imputed | A | DOM | 383 | 6 | 32 | 121 | 12 | 74 | 138 |
| rs4714484 | Imputed | A | ADD | 383 | 6 | 32 | 121 | 12 | 74 | 138 |
| rs4725142 | Genotyped | G | DOM | 383 | 10 | 83 | 66 | 34 | 91 | 99 |
| rs4725144 | Imputed | G | REC | 383 | 10 | 83 | 66 | 34 | 91 | 99 |
| rs4760785 | Imputed | A | REC | 383 | 26 | 68 | 65 | 38 | 124 | 62 |
| rs4760785 | Imputed | A | ADD | 383 | 26 | 68 | 65 | 38 | 124 | 62 |
| rs4760894 | Imputed | T | ADD | 383 | 26 | 68 | 65 | 38 | 124 | 62 |
| rs4760894 | Imputed | T | DOM | 383 | 26 | 68 | 65 | 38 | 124 | 62 |
| rs4760895 | Imputed | A | ADD | 383 | 26 | 68 | 65 | 38 | 124 | 62 |
| rs4760895 | Imputed | A | DOM | 383 | 26 | 68 | 65 | 38 | 124 | 62 |
| rs4767184 | Imputed | A | ADD | 375 | 21 | 66 | 67 | 36 | 114 | 71 |
| rs4767184 | Imputed | C | ADD | 375 | 21 | 66 | 67 | 36 | 114 | 71 |
| rs4773487 | Imputed | C | GEN | 380 | 1 | 20 | 136 | 3 | 48 | 172 |
| rs4780547 | Imputed | T | ADD | 382 | 5 | 58 | 95 | 14 | 77 | 133 |
| rs4780547 | Imputed | G | REC | 382 | 5 | 58 | 95 | 14 | 77 | 133 |
| rs483159 | Imputed | T | DOM | 369 | 5 | 56 | 91 | 9 | 67 | 141 |
| rs4836502 | Imputed | C | DOM | 383 | 17 | 86 | 56 | 24 | 107 | 93 |
| rs4836507 | Imputed | T | ADD | 376 | 17 | 84 | 54 | 24 | 105 | 92 |
| rs4851531 | Imputed | T | DOM | 380 | 24 | 71 | 63 | 30 | 122 | 70 |
| rs4879931 | Imputed | G | ADD | 382 | 12 | 79 | 68 | 22 | 110 | 91 |
| rs489441 | Imputed | A | ADD | 357 | 16 | 62 | 69 | 12 | 86 | 112 |
| rs489441 | Imputed | A | GEN | 357 | 16 | 62 | 69 | 12 | 86 | 112 |
| rs4976276 | Imputed | G | DOM | 382 | 24 | 83 | 51 | 23 | 98 | 103 |
| rs4977681 | Imputed | T | ADD | 380 | 23 | 73 | 61 | 17 | 112 | 94 |
| rs4986197 | Imputed | G | REC | 379 | 17 | 71 | 69 | 13 | 94 | 115 |
| rs4986220 | Imputed | G | ADD | 383 | 17 | 82 | 71 | 12 | 95 | 117 |
| rs525462 | Imputed | T | ADD | 382 | 45 | 32 | 82 | 93 | 103 | 27 |
| rs552006 | Imputed | A | GEN | 380 | 16 | 75 | 68 | 8 | 91 | 122 |
| rs5756669 | Imputed | G | GEN | 383 | 27 | 88 | 44 | 43 | 97 | 84 |
| rs581905 | Imputed | C | DOM | 357 | 1 | 27 | 131 | 2 | 29 | 193 |
| rs6033138 | Imputed | T | ADD | 383 | 27 | 75 | 57 | 29 | 87 | 108 |
| rs6033138 | Imputed | C | GEN | 383 | 27 | 75 | 57 | 29 | 87 | 108 |

TABLE 10-continued

| SNP | Status | Allele | Model | | | | | |
|---|---|---|---|---|---|---|---|---|
| rs6040619 | Imputed | C | ADD | 374 | 27 | 74 | 55 | 28 | 87 | 103 |
| rs6040619 | Imputed | C | GEN | 374 | 27 | 74 | 55 | 28 | 87 | 103 |
| rs6040625 | Imputed | T | ADD | 380 | 27 | 73 | 56 | 28 | 88 | 108 |
| rs6040625 | Imputed | T | GEN | 380 | 27 | 73 | 56 | 28 | 88 | 108 |
| rs6040630 | Imputed | A | ADD | 383 | 27 | 75 | 57 | 28 | 88 | 108 |
| rs6040630 | Imputed | A | GEN | 383 | 27 | 75 | 57 | 29 | 88 | 108 |
| rs6040633 | Imputed | A | ADD | 383 | 27 | 75 | 57 | 29 | 87 | 108 |
| rs6040633 | Imputed | A | GEN | 383 | 27 | 75 | 57 | 29 | 87 | 108 |
| rs6040634 | Imputed | T | ADD | 383 | 27 | 75 | 57 | 29 | 87 | 108 |
| rs6040634 | Imputed | T | GEN | 383 | 27 | 75 | 57 | 29 | 87 | 108 |
| rs6040636 | Imputed | T | ADD | 383 | 27 | 75 | 57 | 29 | 87 | 108 |
| rs6040636 | Imputed | T | GEN | 383 | 27 | 75 | 57 | 29 | 87 | 108 |
| rs6040638 | Imputed | C | ADD | 383 | 27 | 75 | 57 | 29 | 87 | 108 |
| rs6040638 | Imputed | C | GEN | 383 | 27 | 75 | 57 | 29 | 87 | 108 |
| rs6040644 | Imputed | A | ADD | 383 | 27 | 75 | 57 | 29 | 87 | 108 |
| rs6040644 | Imputed | A | GEN | 383 | 27 | 75 | 57 | 29 | 87 | 108 |
| rs6040667 | Imputed | T | ADD | 381 | 27 | 73 | 57 | 29 | 87 | 108 |
| rs6040667 | Imputed | T | GEN | 381 | 27 | 73 | 57 | 29 | 87 | 108 |
| rs6040668 | Imputed | C | ADD | 381 | 27 | 73 | 57 | 29 | 87 | 108 |
| rs6040668 | Imputed | C | GEN | 381 | 27 | 73 | 57 | 29 | 87 | 108 |
| rs6053005 | Imputed | C | DOM | 283 | 37 | 50 | 31 | 68 | 78 | 19 |
| rs6054405 | Imputed | A | REC | 379 | 26 | 70 | 61 | 22 | 114 | 86 |
| rs6075186 | Genotyped | G | GEN | 383 | 28 | 81 | 50 | 25 | 117 | 82 |
| rs608278 | Imputed | G | DOM | 383 | 4 | 32 | 123 | 7 | 61 | 156 |
| rs6111540 | Imputed | A | ADD | 345 | 24 | 75 | 46 | 55 | 99 | 46 |
| rs6131206 | Imputed | A | ADD | 347 | 30 | 69 | 47 | 48 | 110 | 43 |
| rs6131208 | Imputed | C | ADD | 380 | 22 | 70 | 65 | 21 | 83 | 119 |
| rs6131208 | Imputed | T | ADD | 381 | 27 | 73 | 57 | 29 | 87 | 108 |
| rs6131919 | Imputed | T | GEN | 381 | 27 | 73 | 57 | 29 | 87 | 108 |
| rs6134243 | Imputed | G | DOM | 383 | 4 | 32 | 123 | 7 | 61 | 156 |
| rs6134243 | Imputed | C | ADD | 383 | 27 | 75 | 57 | 29 | 87 | 108 |
| rs6136020 | Imputed | C | GEN | 383 | 27 | 75 | 57 | 29 | 87 | 108 |
| rs613799 | Imputed | A | DOM | 383 | 4 | 32 | 123 | 7 | 61 | 156 |
| rs644041 | Imputed | C | DOM | 373 | 16 | 67 | 69 | 20 | 83 | 118 |
| rs644041 | Imputed | G | ADD | 349 | 16 | 66 | 58 | 12 | 86 | 111 |
| rs6464377 | Imputed | G | DOM | 349 | 16 | 66 | 58 | 12 | 86 | 111 |
| rs6474230 | Imputed | C | DOM | 383 | 0 | 28 | 131 | 2 | 23 | 199 |
| rs6476565 | Imputed | T | DOM | 383 | 14 | 62 | 83 | 8 | 66 | 150 |
| rs6511286 | Imputed | A | ADD | 382 | 2 | 16 | 141 | 3 | 44 | 177 |
| rs6541829 | Genotyped | T | ADD | 383 | 22 | 74 | 63 | 14 | 91 | 118 |
| rs6544721 | Imputed | C | REC | 383 | 18 | 59 | 82 | 9 | 97 | 142 |
| rs6544728 | Imputed | G | DOM | 383 | 12 | 69 | 78 | 12 | 70 | 151 |
| rs6565910 | Imputed | T | DOM | 377 | 6 | 65 | 86 | 8 | 61 | 151 |
| rs6581985 | Imputed | G | DOM | 383 | 5 | 53 | 101 | 13 | 92 | 119 |
| rs6581985 | Imputed | G | GEN | 383 | 22 | 65 | 72 | 15 | 107 | 102 |
| rs6685186 | Imputed | C | REC | 383 | 22 | 65 | 72 | 15 | 107 | 102 |
| rs6685186 | Imputed | T | ADD | 383 | 27 | 81 | 51 | 28 | 102 | 94 |
| rs670593 | Imputed | A | GEN | 383 | 27 | 81 | 51 | 28 | 102 | 94 |
| rs6722640 | Imputed | A | REC | 382 | 20 | 76 | 63 | 43 | 103 | 78 |
| rs6746170 | Imputed | T | DOM | 380 | 25 | 64 | 70 | 30 | 123 | 70 |
| rs6757316 | Imputed | A | GEN | 380 | 6 | 65 | 87 | 8 | 61 | 153 |
| rs6805139 | Imputed | G | DOM | 376 | 37 | 82 | 39 | 42 | 100 | 80 |
| | | | | | 41 | 78 | 36 | 51 | 96 | 74 |

TABLE 10-continued

| SNP | Status | Allele | Model | N | col1 | col2 | col3 | col4 |
|---|---|---|---|---|---|---|---|---|
| rs6808571 | Imputed | G | ADD | 378 | 6 | 47 | 105 | 3 | 163 |
| rs6816479 | Imputed | A | REC | 383 | 35 | 76 | 48 | 25 | 88 |
| rs6865976 | Imputed | C | DOM | 305 | 25 | 61 | 44 | 41 | 38 |
| rs687047 | Imputed | C | ADD | 383 | 2 | 29 | 128 | 4 | 167 |
| rs6871041 | Imputed | G | DOM | 367 | 14 | 52 | 87 | 20 | 95 |
| rs688358 | Imputed | A | ADD | 382 | 2 | 28 | 128 | 5 | 167 |
| rs6908481 | Imputed | C | REC | 375 | 40 | 64 | 51 | 35 | 59 |
| rs6917224 | Imputed | A | ADD | 382 | 43 | 63 | 52 | 37 | 86 |
| rs6917224 | Imputed | A | GEN | 382 | 43 | 63 | 52 | 37 | 86 |
| rs6920677 | Imputed | G | DOM | 380 | 12 | 76 | 69 | 45 | 65 |
| rs6994498 | Imputed | G | DOM | 383 | 14 | 62 | 83 | 8 | 150 |
| rs6998772 | Imputed | T | DOM | 383 | 1 | 14 | 144 | 2 | 216 |
| rs7022281 | Imputed | C | ADD | 382 | 18 | 78 | 63 | 36 | 69 |
| rs7022281 | Imputed | C | GEN | 382 | 18 | 78 | 63 | 36 | 69 |
| rs7022281 | Imputed | C | REC | 382 | 18 | 78 | 63 | 36 | 69 |
| rs7043983 | Imputed | T | DOM | 383 | 2 | 16 | 141 | 3 | 177 |
| rs7077799 | Imputed | A | DOM | 382 | 16 | 69 | 74 | 20 | 119 |
| rs7088947 | Imputed | A | ADD | 383 | 0 | 12 | 147 | 0 | 183 |
| rs7089661 | Imputed | C | DOM | 382 | 16 | 68 | 74 | 20 | 120 |
| rs7102072 | Imputed | A | DOM | 381 | 12 | 56 | 90 | 21 | 101 |
| rs710832 | Genotyped | A | REC | 383 | 4 | 69 | 86 | 19 | 122 |
| rs712531 | Imputed | A | DOM | 371 | 19 | 87 | 49 | 19 | 97 |
| rs7129817 | Imputed | T | ADD | 383 | 15 | 64 | 80 | 32 | 88 |
| rs7134262 | Imputed | T | GEN | 383 | 27 | 74 | 58 | 23 | 86 |
| rs7134262 | Imputed | T | REC | 383 | 27 | 74 | 58 | 23 | 86 |
| rs7138300 | Imputed | C | ADD | 383 | 26 | 68 | 65 | 38 | 62 |
| rs7138300 | Imputed | C | DOM | 383 | 26 | 68 | 65 | 38 | 62 |
| rs722927 | Imputed | G | ADD | 383 | 0 | 15 | 144 | 1 | 182 |
| rs722927 | Imputed | G | DOM | 383 | 0 | 15 | 144 | 1 | 182 |
| rs726424 | Genotyped | G | ADD | 383 | 21 | 69 | 69 | 36 | 73 |
| rs726424 | Genotyped | G | GEN | 383 | 21 | 69 | 69 | 36 | 73 |
| rs7295817 | Imputed | C | ADD | 381 | 22 | 70 | 65 | 40 | 69 |
| rs7295817 | Imputed | C | GEN | 381 | 22 | 70 | 65 | 40 | 69 |
| rs7295817 | Imputed | C | REC | 381 | 22 | 70 | 65 | 40 | 69 |
| rs7297372 | Imputed | A | ADD | 338 | 29 | 79 | 28 | 54 | 29 |
| rs7297372 | Imputed | A | GEN | 338 | 29 | 79 | 28 | 54 | 29 |
| rs7298255 | Imputed | A | ADD | 382 | 25 | 68 | 65 | 38 | 62 |
| rs7298255 | Imputed | A | DOM | 382 | 25 | 68 | 65 | 38 | 62 |
| rs7305832 | Imputed | C | GEN | 383 | 27 | 74 | 58 | 23 | 86 |
| rs7305832 | Imputed | C | REC | 383 | 27 | 74 | 58 | 23 | 86 |
| rs737542 | Imputed | A | REC | 381 | 18 | 59 | 81 | 8 | 118 |
| rs742827 | Imputed | A | ADD | 361 | 27 | 71 | 53 | 29 | 99 |
| rs742827 | Imputed | A | GEN | 361 | 27 | 71 | 53 | 29 | 99 |
| rs7446891 | Imputed | G | DOM | 373 | 16 | 53 | 86 | 22 | 93 |
| rs7448641 | Imputed | C | ADD | 383 | 0 | 2 | 157 | 0 | 213 |
| rs7448641 | Imputed | C | DOM | 383 | 0 | 2 | 157 | 0 | 213 |
| rs7460605 | Imputed | A | GEN | 361 | 26 | 76 | 50 | 36 | 88 |
| rs7468898 | Imputed | T | ADD | 379 | 34 | 83 | 40 | 31 | 85 |
| rs7468898 | Imputed | T | DOM | 379 | 34 | 83 | 40 | 31 | 85 |
| rs7501186 | Imputed | A | GEN | 383 | 4 | 36 | 119 | 2 | 178 |
| rs755117 | Imputed | A | DOM | 375 | 7 | 56 | 93 | 6 | 158 |
| rs7557560 | Imputed | T | GEN | 383 | 17 | 44 | 98 | 4 | 152 |
| rs7557560 | Imputed | T | REC | 383 | 17 | 44 | 98 | 4 | 152 |

TABLE 10-continued

| rsID | Status | Allele | Model | N | n1 | n2 | n3 | n4 |
|---|---|---|---|---|---|---|---|---|
| rs7562462 | Imputed | T | DOM | 380 | 35 | 89 | 34 | 43 | 112 |
| rs757173 | Genotyped | G | DOM | 383 | 22 | 67 | 70 | 35 | 111 |
| rs7607447 | Imputed | T | REC | 332 | 19 | 57 | 63 | 14 | 89 |
| rs7639053 | Imputed | A | ADD | 383 | 11 | 66 | 82 | 6 | 76 |
| rs7648163 | Imputed | C | REC | 358 | 27 | 64 | 59 | 15 | 102 |
| rs7651273 | Imputed | A | GEN | 383 | 11 | 46 | 102 | 6 | 91 |
| rs7653190 | Imputed | C | ADD | 382 | 11 | 66 | 81 | 6 | 149 |
| rs7653685 | Genotyped | C | DOM | 383 | 0 | 41 | 118 | 2 | 142 |
| rs7684899 | Imputed | C | DOM | 383 | 10 | 44 | 105 | 10 | 196 |
| rs7701604 | Imputed | G | ADD | 383 | 0 | 2 | 157 | 0 | 127 |
| rs7701604 | Imputed | G | DOM | 383 | 0 | 2 | 157 | 0 | 213 |
| rs7703676 | Imputed | C | ADD | 383 | 0 | 2 | 157 | 0 | 213 |
| rs7703676 | Imputed | C | DOM | 383 | 0 | 2 | 157 | 0 | 213 |
| rs7711358 | Imputed | A | DOM | 383 | 18 | 54 | 87 | 24 | 95 |
| rs7713251 | Imputed | C | REC | 367 | 26 | 66 | 60 | 16 | 95 |
| rs7737608 | Imputed | G | DOM | 382 | 29 | 83 | 46 | 40 | 86 |
| rs7755903 | Imputed | A | GEN | 382 | 17 | 82 | 60 | 52 | 66 |
| rs7762993 | Imputed | A | ADD | 378 | 3 | 59 | 95 | 6 | 155 |
| rs7762993 | Imputed | A | DOM | 378 | 3 | 59 | 95 | 6 | 155 |
| rs7767265 | Imputed | G | DOM | 382 | 9 | 61 | 89 | 12 | 147 |
| rs7769415 | Imputed | C | GEN | 376 | 22 | 63 | 71 | 19 | 99 |
| rs7771264 | Imputed | T | DOM | 383 | 9 | 50 | 100 | 11 | 111 |
| rs7795792 | Imputed | T | REC | 383 | 21 | 85 | 53 | 60 | 52 |
| rs7806481 | Imputed | G | REC | 383 | 27 | 83 | 49 | 55 | 70 |
| rs7808536 | Imputed | G | DOM | 383 | 7 | 62 | 90 | 7 | 160 |
| rs7814819 | Imputed | G | ADD | 225 | 0 | 17 | 72 | 1 | 121 |
| rs7814819 | Imputed | G | DOM | 225 | 0 | 17 | 72 | 1 | 121 |
| rs7815952 | Imputed | T | DOM | 383 | 1 | 14 | 144 | 2 | 216 |
| rs7834090 | Imputed | T | DOM | 383 | 2 | 14 | 144 | 2 | 216 |
| rs7859250 | Imputed | C | DOM | 383 | 2 | 16 | 141 | 3 | 177 |
| rs7863577 | Genotyped | A | ADD | 383 | 1 | 17 | 141 | 2 | 182 |
| rs7863577 | Genotyped | A | DOM | 383 | 1 | 17 | 141 | 2 | 182 |
| rs7902140 | Imputed | C | ADD | 378 | 3 | 35 | 117 | 6 | 142 |
| rs7921834 | Imputed | C | DOM | 382 | 16 | 68 | 74 | 20 | 120 |
| rs7939893 | Imputed | C | ADD | 382 | 20 | 66 | 73 | 24 | 83 |
| rs7939893 | Imputed | C | DOM | 382 | 20 | 66 | 73 | 24 | 83 |
| rs7955901 | Imputed | C | ADD | 383 | 26 | 68 | 65 | 38 | 62 |
| rs7955901 | Imputed | C | DOM | 383 | 26 | 68 | 65 | 38 | 62 |
| rs7956274 | Imputed | T | DOM | 382 | 25 | 68 | 65 | 38 | 62 |
| rs7956274 | Imputed | T | DOM | 382 | 25 | 68 | 65 | 38 | 62 |
| rs7957932 | Imputed | G | ADD | 380 | 27 | 68 | 62 | 40 | 59 |
| rs7957932 | Imputed | G | DOM | 380 | 27 | 68 | 62 | 40 | 59 |
| rs7984294 | Imputed | A | DOM | 341 | 0 | 16 | 127 | 0 | 187 |
| rs7994286 | Imputed | A | ADD | 377 | 1 | 20 | 136 | 3 | 171 |
| rs7994286 | Imputed | A | DOM | 377 | 1 | 20 | 136 | 3 | 171 |
| rs8038229 | Genotyped | A | ADD | 383 | 11 | 56 | 92 | 28 | 97 |
| rs8038229 | Genotyped | A | DOM | 383 | 11 | 56 | 92 | 28 | 97 |
| rs8043336 | Imputed | C | GEN | 370 | 9 | 74 | 71 | 31 | 81 |
| rs8054431 | Imputed | C | REC | 370 | 9 | 74 | 71 | 31 | 81 |
| rs8054431 | Imputed | T | DOM | 372 | 22 | 88 | 46 | 22 | 100 |
| rs8066502 | Imputed | T | DOM | 383 | 6 | 36 | 117 | 6 | 146 |
| rs8068714 | Imputed | T | DOM | 383 | 6 | 37 | 116 | 6 | 146 |
| rs892575 | Imputed | T | ADD | 383 | 17 | 72 | 70 | 13 | 116 |

TABLE 10-continued

| | | | | | | | | | |
|---|---|---|---|---|---|---|---|---|---|
| rs892583 | Imputed | G | ADD | 383 | 17 | 71 | 71 | 12 | 95 | 117 |
| rs915494 | Imputed | A | ADD | 374 | 16 | 63 | 74 | 19 | 83 | 119 |
| rs915494 | Imputed | A | DOM | 374 | 16 | 63 | 74 | 19 | 83 | 119 |
| rs917295 | Imputed | G | DOM | 383 | 17 | 56 | 86 | 24 | 107 | 93 |
| rs922594 | Imputed | T | DOM | 375 | 15 | 63 | 77 | 25 | 113 | 82 |
| rs9301653 | Imputed | T | ADD | 383 | 1 | 20 | 138 | 3 | 46 | 175 |
| rs9301653 | Imputed | T | DOM | 383 | 1 | 20 | 138 | 3 | 46 | 175 |
| rs9309988 | Imputed | G | DOM | 383 | 0 | 41 | 118 | 2 | 26 | 196 |
| rs9309989 | Genotyped | C | DOM | 383 | 0 | 41 | 118 | 2 | 26 | 196 |
| rs9310221 | Imputed | A | DOM | 352 | 17 | 84 | 43 | 37 | 89 | 82 |
| rs9327555 | Imputed | T | DOM | 383 | 17 | 56 | 86 | 24 | 107 | 93 |
| rs937890 | Imputed | G | DOM | 383 | 6 | 37 | 116 | 6 | 72 | 146 |
| rs9454967 | Imputed | G | ADD | 382 | 1 | 28 | 129 | 2 | 14 | 208 |
| rs9454967 | Imputed | G | DOM | 382 | 1 | 28 | 129 | 2 | 14 | 208 |
| rs9471295 | Imputed | T | DOM | 383 | 2 | 49 | 108 | 8 | 45 | 171 |
| rs9477007 | Imputed | A | ADD | 380 | 42 | 67 | 50 | 37 | 100 | 84 |
| rs9477007 | Imputed | A | GEN | 380 | 42 | 67 | 50 | 37 | 100 | 84 |
| rs9487279 | Imputed | T | DOM | 366 | 13 | 77 | 62 | 38 | 115 | 61 |
| rs949016 | Imputed | C | ADD | 383 | 17 | 71 | 71 | 12 | 95 | 117 |
| rs9555973 | Imputed | G | ADD | 379 | 1 | 19 | 136 | 3 | 45 | 175 |
| rs9555973 | Imputed | G | DOM | 379 | 1 | 19 | 136 | 3 | 45 | 175 |
| rs9557510 | Imputed | G | ADD | 383 | 6 | 48 | 105 | 6 | 44 | 174 |
| rs9557510 | Imputed | G | DOM | 383 | 6 | 48 | 105 | 6 | 44 | 174 |
| rs9560584 | Imputed | T | DOM | 382 | 1 | 20 | 137 | 3 | 46 | 175 |
| rs9588770 | Imputed | T | DOM | 381 | 1 | 18 | 139 | 3 | 46 | 174 |
| rs9588848 | Imputed | C | ADD | 383 | 1 | 20 | 138 | 3 | 46 | 175 |
| rs9588848 | Imputed | C | DOM | 383 | 1 | 20 | 138 | 3 | 46 | 175 |
| rs966583 | Imputed | A | ADD | 382 | 19 | 73 | 67 | 34 | 122 | 67 |
| rs966583 | Imputed | A | DOM | 382 | 19 | 73 | 67 | 34 | 122 | 67 |
| rs974130 | Genotyped | A | REC | 383 | 35 | 76 | 48 | 25 | 111 | 88 |
| rs977160 | Imputed | T | ADD | 382 | 17 | 67 | 75 | 12 | 92 | 119 |
| rs9812206 | Imputed | G | ADD | 383 | 0 | 19 | 140 | 3 | 53 | 168 |
| rs9812206 | Imputed | G | DOM | 383 | 0 | 19 | 140 | 3 | 53 | 168 |
| rs9813552 | Imputed | G | ADD | 379 | 0 | 18 | 139 | 3 | 51 | 168 |
| rs9813552 | Imputed | G | DOM | 379 | 0 | 18 | 139 | 3 | 51 | 168 |
| rs9815037 | Imputed | T | ADD | 382 | 0 | 18 | 141 | 3 | 51 | 169 |

TABLE 10-continued

| | | | | | | | | | |
|---|---|---|---|---|---|---|---|---|---|
| rs9815037 | Imputed | T | DOM | 382 | 0 | 18 | 141 | 3 | 51 | 169 |
| rs9825349 | Imputed | A | ADD | 382 | 0 | 18 | 141 | 3 | 51 | 169 |
| rs9825349 | Imputed | A | DOM | 382 | 0 | 18 | 141 | 3 | 51 | 169 |
| rs9834217 | Imputed | T | ADD | 382 | 0 | 18 | 141 | 3 | 51 | 169 |
| rs9834217 | Imputed | T | DOM | 382 | 0 | 18 | 141 | 3 | 51 | 169 |
| rs9840460 | Imputed | T | ADD | 382 | 0 | 18 | 141 | 3 | 51 | 169 |
| rs9840460 | Imputed | T | DOM | 382 | 0 | 18 | 141 | 3 | 51 | 169 |
| rs9840756 | Imputed | A | ADD | 380 | 0 | 18 | 140 | 3 | 51 | 168 |
| rs9840756 | Imputed | A | DOM | 380 | 0 | 18 | 140 | 3 | 51 | 168 |
| rs9844801 | Imputed | C | DOM | 383 | 0 | 41 | 118 | 1 | 27 | 196 |
| rs985375 | Imputed | A | GEN | 374 | 15 | 65 | 74 | 9 | 85 | 126 |
| rs9869187 | Imputed | C | ADD | 383 | 0 | 19 | 140 | 3 | 49 | 172 |
| rs9869187 | Imputed | C | DOM | 383 | 0 | 19 | 140 | 3 | 49 | 172 |
| rs9872327 | Imputed | T | DOM | 383 | 0 | 41 | 118 | 1 | 27 | 196 |
| rs9881685 | Imputed | A | ADD | 379 | 0 | 18 | 138 | 2 | 53 | 168 |
| rs9881685 | Imputed | A | DOM | 379 | 0 | 18 | 138 | 2 | 53 | 168 |
| rs9909499 | Imputed | C | DOM | 362 | 7 | 76 | 68 | 13 | 81 | 117 |
| rs9911847 | Imputed | G | DOM | 382 | 6 | 36 | 116 | 6 | 72 | 146 |
| rs9946886 | Imputed | G | REC | 156 | 6 | 31 | 36 | 17 | 36 | 30 |
| rs9958823 | Imputed | A | ADD | 377 | 17 | 71 | 69 | 12 | 94 | 114 |
| rs9965248 | Imputed | T | ADD | 379 | 17 | 70 | 70 | 13 | 94 | 115 |

TABLE 11

| SNP rs # | SOURCE | ALLELE (A1) | MODEL | NMISS | OR | SE | L95 | U95 | STAT | P | HW_PVALUE | ALLELE_FREQ | ATORVA_ALLELE_FREQ | PRAVA_ALLELE_FREQ |
|---|---|---|---|---|---|---|---|---|---|---|---|---|---|---|
| rs198460 | Genotyped | G | REC | 443 | 1.956 | 0.2218 | 1.267 | 3.021 | 3.026 | 0.00248 | 1 | 0.51129 | 0.56021 | 0.47421 |
| rs603940 | Genotyped | G | REC | 443 | 0.3862 | 0.3119 | 0.2095 | 0.7117 | -3.05 | 0.00229 | 0.9214 | 0.39955 | 0.37958 | 0.41468 |
| rs10021016 | Genotyped | G | GEN | 443 | | | | | 6.477 | 0.03922 | 0.7144 | 0.26298 | 0.29843 | 0.23611 |
| rs1003148 | Imputed | C | ADD | 427 | 0.7405 | 0.1452 | 0.5572 | 0.9843 | -2.069 | 0.03853 | 0.9214 | 0.42974 | 0.38798 | 0.46107 |
| rs1003148 | Imputed | C | GEN | 427 | | | | | 6.652 | 0.03594 | 0.9214 | 0.42974 | 0.38798 | 0.46107 |
| rs1003148 | Imputed | C | REC | 427 | 0.4879 | 0.2786 | 0.2826 | 0.8423 | -2.576 | 0.01 | 0.9214 | 0.42974 | 0.38798 | 0.46107 |
| rs10046799 | Imputed | C | ADD | 440 | 0.7946 | 0.1374 | 0.607 | 1.04 | -1.672 | 0.09444 | 0.4976 | 0.5625 | 0.5291 | 0.58765 |
| rs10046799 | Imputed | C | GEN | 440 | | | | | 9.736 | 0.00769 | 0.4976 | 0.5625 | 0.5291 | 0.58765 |
| rs10051148 | Imputed | C | DOM | 443 | 0.6399 | 0.1948 | 0.4368 | 0.9373 | -2.293 | 0.02187 | 0.8242 | 0.30813 | 0.2801 | 0.32937 |
| rs10054055 | Imputed | T | DOM | 440 | 0.5872 | 0.2006 | 0.3963 | 0.8702 | -2.653 | 0.00797 | 0.3313 | 0.32841 | 0.29365 | 0.35458 |
| rs10067895 | Imputed | A | DOM | 440 | 0.577 | 0.2025 | 0.388 | 0.8581 | -2.716 | 0.00661 | 0.07522 | 0.34886 | 0.31316 | 0.376 |
| rs1008705 | Imputed | C | DOM | 353 | 2.01 | 0.2249 | 1.294 | 3.124 | 3.106 | 0.0019 | 0.6981 | 0.28895 | 0.32667 | 0.26108 |
| rs10105871 | Imputed | C | DOM | 382 | 1.492 | 0.219 | 0.9712 | 2.291 | 1.827 | 0.06776 | 0.1311 | 0.38351 | 0.41212 | 0.36175 |
| rs10116807 | Imputed | A | GEN | 436 | | | | | 7.758 | 0.02068 | 0.8866 | 0.21216 | 0.25263 | 0.18089 |
| rs10116807 | Imputed | A | REC | 436 | 2.869 | 0.4949 | 1.087 | 7.568 | 2.129 | 0.03322 | 0.8866 | 0.21216 | 0.25263 | 0.18089 |
| rs10121941 | Imputed | C | DOM | 443 | 1.177 | 0.2597 | 0.7077 | 1.959 | 6.29E-01 | 0.5296 | 0.5598 | 0.08691 | 0.09424 | 0.08135 |
| rs10128638 | Genotyped | G | DOM | 443 | 0.6667 | 0.2297 | 0.425 | 1.046 | -1.765 | 0.07748 | 1 | 0.52483 | 0.49738 | 0.54563 |
| rs1012924 | Imputed | G | ADD | 438 | 1.725 | 0.2225 | 1.115 | 2.668 | 2.451 | 0.01426 | 0.1759 | 0.11872 | 0.14894 | 0.096 |
| rs1012924 | Imputed | G | DOM | 438 | 1.754 | 0.2318 | 1.113 | 2.762 | 2.423 | 0.01539 | 0.1759 | 0.11872 | 0.14894 | 0.096 |
| rs1016030 | Genotyped | A | ADD | 442 | 1.159 | 0.1474 | 0.8678 | 1.547 | 0.9985 | 0.318 | 1 | 0.36425 | 0.3822 | 0.3506 |
| rs1016030 | Genotyped | A | GEN | 442 | | | | | 1.088 | 0.5805 | 1 | 0.36425 | 0.3822 | 0.3506 |
| rs10017558 | Imputed | A | REC | 430 | 0.7905 | 0.293 | 0.4452 | 1.404 | -0.8024 | 0.4223 | 0.3984 | 0.35349 | 0.32787 | 0.37247 |
| rs10183431 | Imputed | T | DOM | 438 | 1.231 | 0.1969 | 0.8366 | 1.81 | 1.054 | 0.292 | 0.4508 | 0.25342 | 0.26064 | 0.248 |
| rs10195401 | Imputed | C | DOM | 440 | 1.047 | 0.206 | 0.6991 | 1.568 | 0.2228 | 0.8237 | 0.112 | 0.4 | 0.40263 | 0.398 |
| rs10239416 | Imputed | A | DOM | 431 | 1.361 | 0.2052 | 0.9105 | 2.035 | 1.503 | 0.1328 | 0.8386 | 0.38399 | 0.41444 | 0.36066 |
| rs1032188 | Imputed | G | GEN | 443 | | | | | 6.472 | 0.03932 | 0.5638 | 0.29007 | 0.27225 | 0.30357 |
| rs1032188 | Imputed | G | REC | 443 | 0.3936 | 0.3872 | 0.1843 | 0.8406 | -2.408 | 0.01603 | 0.5638 | 0.29007 | 0.27225 | 0.30357 |
| rs10468988 | Imputed | G | ADD | 438 | 1.083 | 0.1637 | 0.7858 | 1.493 | 0.4879 | 0.6256 | 0.7885 | 0.23117 | 0.23947 | 0.22581 |
| rs10478919 | Imputed | C | DOM | 443 | 0.593 | 0.2016 | 0.3994 | 0.8804 | -2.592 | 0.00954 | 0.1134 | 0.34312 | 0.3089 | 0.36905 |
| rs10506623 | Imputed | C | DOM | 442 | 0.7185 | 0.204 | 0.4817 | 1.072 | -1.621 | 0.1051 | 0.6908 | 0.3948 | 0.36316 | 0.41865 |
| rs10506626 | Imputed | A | DOM | 443 | 0.6807 | 0.2015 | 0.4586 | 1.01 | -1.909 | 0.05621 | 0.5504 | 0.39391 | 0.35602 | 0.42262 |
| rs10509477 | Imputed | T | DOM | 443 | 1.364 | 0.1959 | 0.9291 | 2.003 | 1.584 | 0.1131 | 0.1655 | 0.33409 | 0.36911 | 0.30754 |
| rs10511071 | Imputed | C | DOM | 443 | 0.8286 | 0.2404 | 0.5173 | 1.327 | -0.7821 | 0.4342 | 0.8039 | 0.10722 | 0.09686 | 0.11508 |
| rs10511072 | Imputed | C | DOM | 443 | 0.8286 | 0.2404 | 0.5173 | 1.327 | -0.7821 | 0.4342 | 0.8039 | 0.10722 | 0.09686 | 0.11508 |
| rs10511199 | Imputed | G | ADD | 442 | 1.021 | 0.1625 | 0.7424 | 1.404 | 0.1273 | 0.8987 | 0.8924 | 0.22624 | 0.22895 | 0.22421 |
| rs10512283 | Imputed | G | DOM | 442 | | | | | 1.393 | 0.4984 | 0.6226 | 0.17534 | 0.19211 | 0.1627 |
| rs10520072 | Imputed | T | DOM | 443 | 0.5934 | 0.2016 | 0.3997 | 0.881 | -2.589 | 0.00964 | 0.1134 | 0.34312 | 0.31152 | 0.36706 |
| rs1065639 | Imputed | C | DOM | 209 | 2.955 | 1.237 | 0.2613 | 33.41 | 0.8755 | 0.3813 | 1 | 0.00718 | 0.01111 | 0.0042 |
| rs10733846 | Imputed | G | ADD | 435 | 0.8325 | 0.1945 | 0.5686 | 1.219 | -0.9428 | 0.3458 | 0.4814 | 0.16207 | 0.14706 | 0.17339 |
| rs10733846 | Imputed | G | DOM | 435 | 0.7557 | 0.2153 | 0.4955 | 1.152 | -1.301 | 0.1933 | 0.4814 | 0.16207 | 0.14706 | 0.17339 |
| rs10737390 | Imputed | T | DOM | 418 | 1.128 | 0.213 | 0.7431 | 1.712 | 0.5659 | 0.5715 | 0.3626 | 0.40909 | 0.41899 | 0.40167 |
| rs10749293 | Imputed | G | DOM | 441 | 1.442 | 0.1947 | 0.9847 | 2.113 | 1.881 | 0.05998 | 0.1901 | 0.322 | 0.35789 | 0.29482 |
| rs10752159 | Imputed | G | DOM | 442 | 1.434 | 0.2005 | 0.968 | 2.124 | 1.798 | 0.07223 | 0.5658 | 0.20814 | 0.22513 | 0.19522 |
| rs10753760 | Imputed | T | ADD | 423 | 0.9252 | 0.1361 | 0.7085 | 1.208 | -0.5713 | 0.5678 | 0.01675 | 0.41844 | 0.41081 | 0.42437 |
| rs10753760 | Imputed | T | GEN | 423 | | | | | 0.3766 | 0.8284 | 0.01675 | 0.41844 | 0.41081 | 0.42437 |
| rs10757887 | Imputed | C | DOM | 443 | 1.073 | 0.1955 | 0.7315 | 1.574 | 0.3608 | 0.7182 | 0.05609 | 0.2754 | 0.28272 | 0.26984 |
| rs10758326 | Imputed | A | ADD | 440 | 0.6884 | 0.1481 | 0.515 | 0.9203 | -2.521 | 0.01172 | 0.5467 | 0.38523 | 0.34211 | 0.418 |
| rs10758326 | Imputed | A | GEN | 440 | | | | | 9.42 | 0.009 | 0.5467 | 0.38523 | 0.34211 | 0.418 |

TABLE 11-continued

| | | | | | | | | | | |
|---|---|---|---|---|---|---|---|---|---|---|
| rs10758326 | Imputed | A | REC | 440 | 0.3854 | 0.3129 | 0.2087 | 0.7116 | -3.047 | 0.00231 | 0.5467 | 0.38523 | 0.34211 | 0.418 |
| rs10762236 | Genotyped | G | ADD | 443 | 0.93 | 0.1858 | 0.6461 | 1.339 | -0.3906 | 0.6961 | 0.5219 | 0.18172 | 0.17539 | 0.18651 |
| rs10765769 | Imputed | C | ADD | 441 | 1.226 | 0.1457 | 0.9215 | 1.631 | 1.399 | 0.1618 | 0.8413 | 0.38776 | 0.4127 | 0.36905 |
| rs10765769 | Imputed | C | GEN | 441 | | | | | 2.026 | 0.3632 | | 0.38776 | 0.4127 | 0.36905 |
| rs10784891 | Imputed | C | ADD | 422 | 0.7472 | 0.1404 | 0.5675 | 0.9839 | -2.076 | 0.03794 | 0.4305 | 0.4455 | 0.40489 | 0.47689 |
| rs10784891 | Imputed | C | DOM | 422 | 0.7374 | 0.2125 | 0.4862 | 1.118 | -1.433 | 0.1518 | 0.4305 | 0.4455 | 0.40489 | 0.47689 |
| rs10787923 | Imputed | G | DOM | 439 | 1.448 | 0.1952 | 0.9878 | 2.123 | 1.897 | 0.05785 | 0.1572 | 0.32232 | 0.35904 | 0.29482 |
| rs10787949 | Imputed | A | DOM | 442 | 1.352 | 0.1976 | 0.9177 | 1.991 | 1.525 | 0.1272 | 0.1377 | 0.33937 | 0.37173 | 0.31474 |
| rs10787951 | Imputed | G | DOM | 441 | 1.349 | 0.1976 | 0.9157 | 1.987 | 1.514 | 0.1299 | 0.1364 | 0.339 | 0.37105 | 0.31474 |
| rs10787983 | Imputed | C | DOM | 441 | 1.351 | 0.1964 | 0.9194 | 1.986 | 1.532 | 0.1255 | 0.1642 | 0.33447 | 0.36911 | 0.308 |
| rs10788380 | Imputed | C | ADD | 438 | 1.318 | 0.1398 | 1.002 | 1.733 | 1.973 | 0.04851 | 0.9239 | 0.49658 | 0.53723 | 0.466 |
| rs10788380 | Imputed | C | DOM | 438 | 1.663 | 0.2322 | 1.055 | 2.621 | 2.191 | 0.02847 | 0.9239 | 0.49658 | 0.53723 | 0.466 |
| rs10788380 | Imputed | G | GEN | 438 | | | | | 4.897 | 0.08641 | | 0.49658 | 0.53723 | 0.466 |
| rs10814418 | Imputed | G | DOM | 442 | 1.184 | 0.2598 | 0.7118 | 1.97 | 0.6512 | 0.5149 | 0.7613 | 0.0871 | 0.09474 | 0.08135 |
| rs10831417 | Imputed | A | ADD | 443 | 1.151 | 0.1492 | 0.8595 | 1.543 | 0.9453 | 0.3445 | 0.6065 | 0.35779 | 0.37435 | 0.34524 |
| rs10831417 | Imputed | A | GEN | 443 | | | | | 0.969 | 0.616 | 0.6065 | 0.35779 | 0.37435 | 0.34524 |
| rs10831422 | Imputed | C | ADD | 441 | 1.164 | 0.1481 | 0.871 | 1.557 | 1.028 | 0.304 | 0.918 | 0.36281 | 0.38095 | 0.34921 |
| rs10831422 | Imputed | C | GEN | 441 | | | | | 1.057 | 0.5895 | 0.918 | 0.36281 | 0.38095 | 0.34921 |
| rs10862931 | Imputed | C | DOM | 439 | | | | | 6.025 | 0.04917 | 0.8337 | 0.34966 | 0.38158 | 0.3253 |
| rs10865197 | Imputed | A | DOM | 438 | 1.231 | 0.1969 | 0.8366 | 1.81 | 1.054 | 0.292 | 0.4508 | 0.25342 | 0.26064 | 0.248 |
| rs10871302 | Imputed | C | DOM | 443 | 2.011 | 0.2218 | 1.302 | 3.107 | 3.15 | 0.00163 | 0.4471 | 0.14447 | 0.17801 | 0.11905 |
| rs10877463 | Imputed | C | DOM | 443 | 0.5826 | 0.1985 | 0.3948 | 0.8597 | -2.722 | 0.0065 | 0.6802 | 0.36005 | 0.31675 | 0.39286 |
| rs10877468 | Imputed | C | DOM | 442 | 0.5848 | 0.1985 | 0.3963 | 0.8629 | -2.703 | 0.00688 | 0.6808 | 0.35973 | 0.31675 | 0.39243 |
| rs10879240 | Imputed | C | ADD | 428 | 0.7296 | 0.1403 | 0.5542 | 0.9605 | -2.247 | 0.02462 | 0.434 | 0.44743 | 0.40426 | 0.48125 |
| rs10879242 | Imputed | A | DOM | 421 | 0.7102 | 0.2081 | 0.4724 | 1.068 | -1.644 | 0.1001 | 0.9197 | 0.40855 | 0.37297 | 0.43644 |
| rs10879245 | Imputed | A | DOM | 421 | 0.7102 | 0.2081 | 0.4724 | 1.068 | -1.644 | 0.1001 | 0.9197 | 0.40855 | 0.37297 | 0.43644 |
| rs10879249 | Imputed | T | DOM | 439 | 0.7247 | 0.2038 | 0.486 | 1.081 | -1.58 | 0.1141 | 0.7662 | 0.39773 | 0.36579 | 0.422 |
| rs10886452 | Imputed | A | DOM | 440 | 1.376 | 0.1972 | 0.9349 | 2.025 | 1.619 | 0.1055 | 0.1648 | 0.33523 | 0.37368 | 0.306 |
| rs10886463 | Imputed | C | DOM | 442 | 1.352 | 0.1976 | 0.9177 | 1.991 | 1.525 | 0.1272 | 0.1118 | 0.3405 | 0.37435 | 0.31474 |
| rs10886465 | Imputed | C | DOM | 441 | 1.355 | 0.1976 | 0.9197 | 1.995 | 1.536 | 0.1245 | 0.1364 | 0.339 | 0.37435 | 0.312 |
| rs10886526 | Imputed | G | DOM | 439 | 1.364 | 0.197 | 0.9275 | 2.007 | 1.578 | 0.1146 | 0.2383 | 0.33257 | 0.36772 | 0.306 |
| rs10902437 | Imputed | G | ADD | 393 | 1.494 | 0.1583 | 1.095 | 2.037 | 2.534 | 0.01127 | 0.6725 | 0.39186 | 0.43558 | 0.36087 |
| rs10941126 | Imputed | G | DOM | 443 | 0.9741 | 0.2886 | 0.5532 | 1.715 | -0.09096 | 0.9275 | 2.36E-05 | 0.07336 | 0.0733 | 0.07341 |
| rs10941126 | Imputed | G | GEN | 443 | | | | | 0.3732 | 0.709 | 2.36E-05 | 0.07336 | 0.0733 | 0.07341 |
| rs10947871 | Imputed | A | DOM | 391 | 2.143 | 0.3415 | 0.5817 | 2.218 | 3.065 | 0.00218 | 1 | 0.11893 | 0.15805 | 0.08756 |
| rs10972978 | Imputed | G | DOM | 437 | 1.24 | 0.2487 | 1.316 | 3.49 | 0.8222 | 0.4109 | 0.5546 | 0.08696 | 0.09626 | 0.08 |
| rs10973012 | Imputed | A | DOM | 443 | 1.177 | 0.2619 | 0.7423 | 2.072 | 0.6286 | 0.5296 | 0.5598 | 0.08691 | 0.09424 | 0.08135 |
| rs10974028 | Genotyped | G | ADD | 443 | 1.203 | 0.2597 | 0.7077 | 1.959 | 0.9728 | 0.3306 | 0.726 | 0.16027 | 0.17277 | 0.15079 |
| rs10974028 | Genotyped | G | DOM | 443 | 1.224 | 0.1904 | 0.8287 | 1.748 | 0.9516 | 0.3413 | 0.726 | 0.16027 | 0.17277 | 0.15079 |
| rs11021302 | Imputed | A | ADD | 441 | 1.164 | 0.2126 | 0.807 | 1.857 | 1.028 | 0.304 | 0.918 | 0.36281 | 0.38095 | 0.34921 |
| rs11021302 | Imputed | A | GEN | 441 | 1.164 | 0.1481 | 0.871 | 1.557 | 1.057 | 0.5895 | 0.918 | 0.36281 | 0.38095 | 0.34921 |
| rs11099644 | Imputed | G | REC | 430 | 0.7905 | 0.293 | 0.4452 | 1.404 | -0.8024 | 0.4223 | 0.3984 | 0.35349 | 0.32787 | 0.37247 |
| rs11138315 | Imputed | A | ADD | 443 | 0.5453 | 0.2248 | 0.351 | 0.8473 | -2.697 | 0.00699 | 0.2265 | 0.13344 | 0.10209 | 0.16071 |
| rs11149802 | Imputed | T | DOM | 443 | 2.011 | 0.2218 | 1.302 | 3.107 | 3.15 | 0.00163 | 0.4471 | 0.14447 | 0.17801 | 0.11905 |
| rs11116596 | Imputed | T | DOM | 443 | 0.593 | 0.2016 | 0.3994 | 0.8804 | -2.592 | 0.00954 | 0.1134 | 0.34312 | 0.3089 | 0.36905 |
| rs11178531 | Imputed | A | ADD | 439 | 0.7197 | 0.1371 | 0.5501 | 0.9416 | -2.399 | 0.01643 | 0.3881 | 0.46811 | 0.42105 | 0.50402 |
| rs11178531 | Imputed | A | DOM | 439 | 0.6936 | 0.2116 | 0.4581 | 1.05 | -1.729 | 0.08386 | 0.3881 | 0.46811 | 0.42105 | 0.50402 |
| rs11178575 | Imputed | C | GEN | 441 | | | | | 8.684 | 0.01301 | 0.3129 | 0.30385 | 0.3534 | 0.266 |
| rs11178575 | Imputed | C | REC | 441 | 2.252 | 0.3587 | 1.115 | 4.549 | 2.263 | 0.02362 | 0.3129 | 0.30385 | 0.3534 | 0.266 |
| rs11178577 | Imputed | T | GEN | 439 | | | | | 8.67 | 0.0131 | 0.2621 | 0.30752 | 0.35789 | 0.26908 |
| rs11178577 | Imputed | T | REC | 439 | 2.243 | 0.3588 | 1.11 | 4.532 | 2.252 | 0.02435 | 0.2621 | 0.30752 | 0.35789 | 0.26908 |
| rs11178583 | Imputed | A | DOM | 443 | 0.7338 | 0.2032 | 0.4927 | 1.093 | -1.523 | 0.1277 | 0.6922 | 0.39503 | 0.36387 | 0.41865 |
| rs11178589 | Imputed | T | DOM | 437 | 0.7215 | 0.2047 | 0.4831 | 1.078 | -1.595 | 0.1108 | 0.8419 | 0.39931 | 0.36579 | 0.4251 |

TABLE 11-continued

| rsID | | allele | model | N | | | | | | | | | | |
|---|---|---|---|---|---|---|---|---|---|---|---|---|---|---|
| rs11178594 | Imputed | C | DOM | 441 | 0.7044 | 0.202 | 0.4741 | 1.046 | -1.735 | 0.08274 | | 0.40249 | 0.36842 | 0.42829 |
| rs11178602 | Imputed | T | DOM | 439 | 0.7005 | 0.2027 | 0.4709 | 1.042 | -1.757 | 0.079 | | 0.40205 | 0.36772 | 0.428 |
| rs11178648 | Imputed | T | DOM | 440 | 0.6786 | 0.2027 | 0.4561 | 1.01 | -1.912 | 0.05581 | | 0.39432 | 0.35714 | 0.42231 |
| rs11198877 | Imputed | T | DOM | 441 | 1.369 | 0.1971 | 0.9302 | 2.014 | 1.593 | 0.1113 | | 0.3356 | 0.37368 | 0.30677 |
| rs11198942 | Imputed | T | DOM | 443 | 1.364 | 0.1959 | 0.9291 | 2.003 | 1.584 | 0.1131 | | 0.33409 | 0.36911 | 0.30754 |
| rs11221075 | Imputed | A | ADD | 417 | 0.4912 | 0.2448 | 0.304 | 0.7936 | -2.904 | 0.00369 | | 0.11391 | 0.07542 | 0.14286 |
| rs11242020 | Imputed | T | DOM | 443 | 0.593 | 0.2016 | 0.3994 | 0.8804 | -2.592 | 0.00954 | | 0.34312 | 0.3089 | 0.36905 |
| rs11242021 | Imputed | T | DOM | 443 | 0.5934 | 0.2016 | 0.3997 | 0.881 | -2.589 | 0.00964 | 0.1134 | 0.34312 | 0.31152 | 0.36706 |
| rs11242022 | Imputed | T | DOM | 443 | 0.5934 | 0.2016 | 0.3997 | 0.881 | -2.589 | 0.00964 | 0.1134 | 0.34312 | 0.31152 | 0.36706 |
| rs11242023 | Imputed | T | DOM | 443 | 0.5934 | 0.2016 | 0.3997 | 0.881 | -2.589 | 0.00964 | 0.1134 | 0.34312 | 0.31152 | 0.36706 |
| rs1149350 | Imputed | A | DOM | 443 | 0.8901 | 0.2092 | 0.5906 | 1.341 | -0.5566 | 0.5778 | 0.01047 | 0.21445 | 0.18848 | 0.23413 |
| rs1150143 | Imputed | G | DOM | 435 | 1.007 | 0.2015 | 0.6785 | 1.495 | 0.03498 | 0.9721 | 0.1573 | 0.38851 | 0.38978 | 0.38755 |
| rs1576627 | Imputed | T | ADD | 441 | 1.439 | 0.1975 | 0.977 | 2.119 | 1.842 | 0.06547 | 0.01289 | 0.12358 | 0.15 | 0.10359 |
| rs1576627 | Imputed | T | DOM | 441 | 1.57 | 0.2354 | 0.9899 | 2.491 | 1.917 | 0.05525 | 0.01289 | 0.12358 | 0.15 | 0.10359 |
| rs1602189 | Imputed | A | DOM | 440 | 0.8739 | 0.1947 | 0.5967 | 1.28 | -0.6923 | 0.4888 | 0.3294 | 0.32727 | 0.31579 | 0.336 |
| rs1605163 | Imputed | A | DOM | 440 | 1.075 | 0.249 | 0.6597 | 1.751 | 0.2893 | 0.7723 | 0.4443 | 0.10341 | 0.11111 | 0.09761 |
| rs11615214 | Imputed | G | ADD | 437 | 0.7544 | 0.1432 | 0.5697 | 0.9989 | -1.968 | 0.04908 | 0.9205 | 0.39359 | 0.35526 | 0.42308 |
| rs11615214 | Imputed | G | GEN | 437 | | | | | 8.718 | 0.01279 | 0.9205 | 0.39359 | 0.35526 | 0.42308 |
| rs11642394 | Imputed | C | DOM | 443 | 2.011 | 0.2218 | 1.302 | 3.107 | 3.15 | 0.00163 | 0.4471 | 0.14447 | 0.17801 | 0.11905 |
| rs1644943 | Imputed | A | DOM | 421 | 1.464 | 0.1665 | 1.056 | 2.029 | 2.29 | 0.02202 | 0.7836 | 0.22922 | 0.26776 | 0.19958 |
| rs1656608 | Imputed | A | ADD | 442 | 0.5127 | 0.2187 | 0.334 | 0.7871 | -3.055 | 0.00225 | 0.8632 | 0.16403 | 0.11842 | 0.19841 |
| rs1661309 | Imputed | A | DOM | 439 | 0.8005 | 0.1812 | 0.5612 | 1.142 | -1.228 | 0.2194 | 0.872 | 0.18109 | 0.16138 | 0.196 |
| rs1661309 | Imputed | A | DOM | 440 | 0.8571 | 0.2089 | 0.5691 | 1.291 | -0.7383 | 0.4603 | 0.872 | 0.18109 | 0.16138 | 0.196 |
| rs1666131 | Imputed | A | ADD | 441 | 1.074 | 0.1682 | 0.772 | 1.493 | 0.4219 | 0.6731 | 0.2245 | 0.22676 | 0.23158 | 0.22311 |
| rs11743355 | Imputed | C | ADD | 443 | 0.9741 | 0.2886 | 0.5532 | 1.715 | -0.09096 | 0.9275 | 2.36E-05 | 0.07336 | 0.0733 | 0.07341 |
| rs11743355 | Imputed | C | DOM | 443 | 1.136 | 0.3415 | 0.5817 | 2.218 | 0.3732 | 0.709 | 2.36E-05 | 0.07336 | 0.0733 | 0.07341 |
| rs11746806 | Imputed | T | ADD | 443 | 0.9741 | 0.2886 | 0.5532 | 1.715 | -0.09096 | 0.9275 | 2.36E-05 | 0.07336 | 0.0733 | 0.07341 |
| rs11746806 | Imputed | T | DOM | 443 | 1.136 | 0.3415 | 0.5817 | 2.218 | 0.3732 | 0.709 | 2.36E-05 | 0.07336 | 0.0733 | 0.07341 |
| rs11746959 | Imputed | T | ADD | 443 | 0.9741 | 0.2886 | 0.5532 | 1.715 | -0.09096 | 0.9275 | 2.36E-05 | 0.07336 | 0.0733 | 0.07341 |
| rs11746959 | Imputed | T | DOM | 443 | 1.136 | 0.3415 | 0.5817 | 2.218 | 0.3732 | 0.709 | 2.36E-05 | 0.07336 | 0.0733 | 0.07341 |
| rs11749272 | Imputed | T | DOM | 443 | 0.593 | 0.2016 | 0.3994 | 0.8804 | -2.592 | 0.00954 | 0.1134 | 0.34312 | 0.3089 | 0.36905 |
| rs11901899 | Imputed | A | DOM | 426 | 1.452 | 0.1995 | 0.9821 | 2.147 | 1.869 | 0.06157 | 0.3322 | 0.27582 | 0.30707 | 0.25207 |
| rs11926319 | Imputed | G | ADD | 443 | 0.9777 | 0.2632 | 0.5837 | 1.638 | -0.08556 | 0.9318 | 0.4982 | 0.07675 | 0.07592 | 0.07738 |
| rs11926319 | Imputed | G | DOM | 443 | 1.007 | 0.269 | 0.5945 | 1.706 | 0.02639 | 0.9789 | 0.4982 | 0.07675 | 0.07592 | 0.07738 |
| rs11956952 | Imputed | C | DOM | 418 | 0.6491 | 0.2055 | 0.4339 | 0.971 | -2.103 | 0.03544 | | 0.24282 | 0.21858 | 0.2617 |
| rs12025826 | Imputed | G | DOM | 434 | 1.459 | 0.2095 | 0.9676 | 2.199 | 1.803 | 0.07141 | | 0.41705 | 0.4328 | 0.40524 |
| rs1204522 | Imputed | C | GEN | 422 | | | | | 0.09565 | 0.9533 | 0.9146 | 0.34834 | 0.35326 | 0.34454 |
| rs1204524 | Imputed | A | GEN | 422 | | | | | 0.09565 | 0.9533 | 0.9146 | 0.34834 | 0.35326 | 0.34454 |
| rs12153185 | Imputed | T | DOM | 441 | 0.5728 | 0.2023 | 0.3853 | 0.8516 | -2.754 | 0.00589 | 0.07489 | 0.35034 | 0.31316 | 0.37849 |
| rs12182651 | Imputed | T | ADD | 441 | 0.982 | 0.2314 | 0.624 | 1.545 | -0.07863 | 0.9373 | 0.07328 | 0.0907 | 0.08947 | 0.09163 |
| rs12182651 | Imputed | T | DOM | 441 | 0.9744 | 0.2621 | 0.583 | 1.629 | -0.09893 | 0.9212 | 0.07328 | 0.0907 | 0.08947 | 0.09163 |
| rs12193568 | Imputed | G | DOM | 361 | 1.618 | 0.2464 | 0.9984 | 2.623 | 1.953 | 0.05077 | 0.1009 | 0.14958 | 0.17296 | 0.13119 |
| rs12264914 | Imputed | C | DOM | 311 | 0.4742 | 0.2385 | 0.2971 | 0.7568 | -3.128 | 0.00176 | | 0.25723 | 0.20652 | 0.29769 |
| rs12307767 | Imputed | C | DOM | 419 | 0.6033 | 0.203 | 0.4053 | 0.8981 | -2.489 | 0.0128 | | 0.3568 | 0.31564 | 0.3875 |
| rs1232298 | Imputed | A | REC | 408 | 1.995 | 0.3003 | 1.107 | 3.593 | 2.299 | 0.0215 | 0.8317 | 0.34681 | 0.38483 | 0.31739 |
| rs12407412 | Imputed | C | ADD | 441 | 1.439 | 0.1975 | 0.977 | 2.119 | 1.842 | 0.06547 | 0.08143 | 0.12358 | 0.15 | 0.10359 |
| rs12407412 | Imputed | C | DOM | 441 | 1.57 | 0.2354 | 0.9899 | 2.491 | 1.917 | 0.05525 | 0.01289 | 0.12358 | 0.15 | 0.10359 |
| rs12420184 | Imputed | G | DOM | 438 | 1.429 | 0.2168 | 0.9343 | 2.185 | 1.647 | 0.09966 | 0.01289 | 0.14954 | 0.16931 | 0.13454 |
| rs12422750 | Imputed | A | DOM | 442 | 0.5888 | 0.1966 | 0.4005 | 0.8656 | -2.694 | 0.00706 | 0.2411 | 0.33597 | 0.29474 | 0.36706 |
| rs12446951 | Imputed | A | ADD | 310 | 1.549 | 0.2897 | 0.8777 | 2.732 | 1.51 | 0.1312 | 0.7534 | 0.10161 | 0.12411 | 0.08284 |
| rs12446951 | Imputed | A | DOM | 310 | 1.63 | 0.2998 | 0.9057 | 2.933 | 1.63 | 0.1032 | 0.7534 | 0.10161 | 0.12411 | 0.08284 |
| rs12457400 | Imputed | A | DOM | 443 | 0.578 | 0.2524 | 0.3525 | 0.948 | -2.172 | 0.02987 | 0.8041 | 0.10497 | 0.08115 | 0.12302 |
| rs12473340 | Imputed | C | DOM | 441 | 0.9041 | 0.2098 | 0.5993 | 1.364 | -0.4802 | 0.6311 | 0.0397 | 0.20522 | 0.17895 | 0.2251 |

TABLE 11-continued

| | | | | | | | | | | |
|---|---|---|---|---|---|---|---|---|---|---|
| rs1247341 | Imputed | C | DOM | 441 | 0.919 | 0.2102 | 0.6087 | 1.387 | −0.4021 | 0.6876 | 0.05636 | 0.20408 | 0.18063 | 0.222 |
| rs12521291 | Imputed | G | ADD | 435 | 1.07 | 0.1477 | 0.8008 | 1.429 | 0.4556 | 0.6486 | 0.9172 | 0.35747 | 0.36559 | 0.35141 |
| rs12526849 | Imputed | T | ADD | 436 | 1.012 | 0.1389 | 0.7712 | 1.329 | 0.08887 | 0.9292 | 0.4209 | 0.39106 | 0.39362 | 0.38911 |
| rs12526849 | Imputed | T | GEN | 436 | | | | | | 0.394 | 0.4209 | 0.39106 | 0.39362 | 0.38911 |
| rs12543110 | Imputed | G | DOM | 443 | 1.32 | 0.1941 | 0.9026 | 1.931 | 1.863 | 0.1521 | 0.6236 | 0.26298 | 0.27487 | 0.25397 |
| rs12678600 | Imputed | A | DOM | 439 | 0.7992 | 0.198 | 0.5421 | 1.178 | 1.432 | 0.2575 | | 0.31663 | 0.29894 | 0.33 |
| rs12719415 | Imputed | T | DOM | 443 | 0.5934 | 0.2016 | 0.3997 | 0.881 | −1.132 | 0.00964 | 0.1134 | 0.34312 | 0.31152 | 0.36706 |
| rs12831292 | Imputed | G | DOM | 436 | 0.7047 | 0.2039 | 0.4725 | 1.051 | −2.589 | 0.08609 | 1 | 0.40367 | 0.37097 | 0.428 |
| rs12923993 | Imputed | C | DOM | 443 | 2.011 | 0.2218 | 1.302 | 3.107 | −1.716 | 0.00163 | 1 | 0.14447 | 0.17801 | 0.11905 |
| rs12936964 | Imputed | T | DOM | 431 | 1.123 | 0.2052 | 0.7508 | 1.678 | 3.15 | 0.5732 | 0.4471 | 0.38167 | 0.37097 | 0.3898 |
| rs12960663 | Imputed | G | ADD | 435 | 0.797 | 0.1843 | 0.5553 | 1.144 | −1.231 | 0.2182 | 0.2205 | 0.17701 | 0.15775 | 0.19153 |
| rs13038146 | Imputed | C | ADD | 443 | 1.389 | 0.1433 | 1.049 | 1.839 | 2.291 | 0.02197 | 0.8698 | 0.34424 | 0.38743 | 0.31151 |
| rs13038146 | Imputed | C | GEN | 443 | | | | | | 0.03523 | 0.2479 | 0.34424 | 0.38743 | 0.31151 |
| rs13134222 | Imputed | A | DOM | 442 | | | | | 6.692 | 0.1048 | 0.2479 | 0.24887 | 0.28158 | 0.22421 |
| rs13172910 | Imputed | A | DOM | 417 | 0.6398 | 0.2054 | 0.4278 | 0.9571 | 4.511 | 0.02974 | 0.6117 | 0.2446 | 0.21858 | 0.26496 |
| rs13194907 | Imputed | A | ADD | 443 | 1.091 | 0.2583 | 0.6574 | 1.81 | −2.174 | 0.7367 | 1 | 0.07336 | 0.07592 | 0.07143 |
| rs13194907 | Imputed | A | DOM | 443 | 1.162 | 0.2804 | 0.6707 | 2.013 | 0.3362 | 0.5923 | 0.279 | 0.07336 | 0.07592 | 0.07143 |
| rs13195745 | Imputed | A | ADD | 443 | 1.091 | 0.2583 | 0.6574 | 1.81 | 0.5355 | 0.7367 | 0.279 | 0.07336 | 0.07592 | 0.07143 |
| rs13195745 | Imputed | A | DOM | 443 | 1.162 | 0.2804 | 0.6707 | 2.013 | 0.3362 | 0.5923 | 0.279 | 0.07336 | 0.07592 | 0.07143 |
| rs1321432 | Imputed | A | REC | 443 | 0.9755 | 0.2643 | 0.5811 | 1.638 | 0.5355 | 0.9252 | 0.108 | 0.38036 | 0.37696 | 0.38294 |
| rs1321457 | Imputed | G | REC | 435 | 0.9425 | 0.2789 | 0.5456 | 1.628 | −0.09385 | 0.8319 | 0.3005 | 0.36207 | 0.3617 | 0.36235 |
| rs13265054 | Imputed | T | DOM | 434 | 0.7541 | 0.1998 | 0.5098 | 1.116 | −0.2122 | 0.1577 | 0.8248 | 0.31567 | 0.29412 | 0.33198 |
| rs13282131 | Imputed | C | GEN | 440 | | | | | −1.413 | 0.03614 | 0.8464 | 0.43864 | 0.47105 | 0.414 |
| rs13353526 | Imputed | C | DOM | 438 | 0.8239 | 0.2338 | 0.521 | 1.303 | 6.641 | 0.4073 | 1 | 0.11842 | 0.11842 | 0.13508 |
| rs1336382 | Imputed | T | DOM | 443 | 1.364 | 0.1959 | 0.9291 | 2.003 | −0.8286 | 0.1131 | 0.1655 | 0.33409 | 0.36911 | 0.30754 |
| rs1336383 | Imputed | T | DOM | 443 | 1.364 | 0.1959 | 0.9291 | 2.003 | 1.584 | 0.1131 | 0.1655 | 0.33409 | 0.36911 | 0.30754 |
| rs1336407 | Imputed | C | DOM | 442 | 1.347 | 0.1964 | 0.9168 | 1.98 | 1.584 | 0.129 | 0.1663 | 0.33484 | 0.36911 | 0.30876 |
| rs1336409 | Imputed | T | DOM | 442 | 1.347 | 0.1964 | 0.9168 | 1.98 | 1.518 | 0.129 | 0.1663 | 0.33484 | 0.36911 | 0.30876 |
| rs1336596 | Imputed | A | DOM | 440 | 0.9849 | 0.205 | 0.659 | 1.472 | 1.518 | 0.9407 | 0.4737 | 0.36932 | 0.37632 | 0.364 |
| rs1343560 | Imputed | A | ADD | 437 | 1.717 | 0.2225 | 1.11 | 2.656 | −0.07439 | 0.01509 | 0.1757 | 0.11899 | 0.14894 | 0.09639 |
| rs1343560 | Imputed | T | DOM | 437 | 1.745 | 0.2319 | 1.108 | 2.75 | 2.43 | 0.0163 | 0.1757 | 0.11899 | 0.14894 | 0.09639 |
| rs1361987 | Imputed | C | GEN | 443 | | | | | 2.402 | 0.8142 | 0.8328 | 0.34199 | 0.34817 | 0.3373 |
| rs1386153 | Imputed | T | ADD | 441 | 0.8596 | 0.1501 | 0.6405 | 1.154 | 0.4112 | 0.3137 | 0.3322 | 0.32993 | 0.31316 | 0.34263 |
| rs1386153 | Imputed | T | DOM | 441 | 0.8546 | 0.1947 | 0.5835 | 1.252 | −1.008 | 0.4197 | 0.3322 | 0.32993 | 0.31316 | 0.34263 |
| rs1394015 | Imputed | C | DOM | 372 | 2.85 | 1.231 | 0.2552 | 31.84 | −0.8069 | 0.3949 | 1 | 0.00403 | 0.00633 | 0.00234 |
| rs1407038 | Imputed | A | REC | 443 | 0.9523 | 0.2749 | 0.5556 | 1.632 | 0.8507 | 0.8588 | 0.1496 | 0.35892 | 0.35864 | 0.35913 |
| rs1407039 | Imputed | A | REC | 443 | 0.9755 | 0.2643 | 0.5811 | 1.638 | −0.178 | 0.9252 | 0.108 | 0.38036 | 0.37696 | 0.38294 |
| rs1412802 | Imputed | T | GEN | 428 | | | | | −0.09385 | 0.1458 | 0.7178 | 0.27804 | 0.25543 | 0.29508 |
| rs1414865 | Imputed | T | DOM | 442 | 1.352 | 0.1976 | 0.9177 | 1.991 | 3.851 | 0.1272 | 0.1377 | 0.33937 | 0.37173 | 0.31474 |
| rs1414873 | Imputed | A | DOM | 442 | 1.347 | 0.1964 | 0.9168 | 1.98 | 1.525 | 0.129 | 0.1663 | 0.33484 | 0.36911 | 0.30876 |
| rs1414876 | Imputed | C | DOM | 442 | 1.347 | 0.1964 | 0.9168 | 1.98 | 1.518 | 0.129 | 0.1663 | 0.33484 | 0.36911 | 0.30876 |
| rs1418671 | Imputed | C | REC | 424 | 1.095 | 0.2783 | 0.6345 | 1.889 | 0.3255 | 0.7448 | 0.6846 | 0.39623 | 0.4011 | 0.39256 |
| rs1419490 | Genotyped | A | GEN | 443 | | | | | 0.3173 | 0.8533 | 1 | 0.33634 | 0.3377 | 0.33532 |
| rs1434507 | Imputed | A | ADD | 442 | 1.053 | 0.1646 | 0.7624 | 1.453 | 0.3112 | 0.7556 | | 0.22624 | 0.23037 | 0.22311 |
| rs1434508 | Imputed | T | ADD | 442 | 1.053 | 0.1646 | 0.7624 | 1.453 | 0.3112 | 0.7556 | | 0.22624 | 0.23037 | 0.22311 |
| rs1435205 | Imputed | A | ADD | 442 | 1.021 | 0.1625 | 0.7424 | 1.404 | 0.1273 | 0.8987 | 0.8924 | 0.22624 | 0.22895 | 0.22421 |
| rs1443928 | Imputed | C | REC | 435 | 0.9918 | 0.2124 | 0.6541 | 1.504 | −0.03862 | 0.9692 | 0.1711 | 0.57126 | 0.56806 | 0.57377 |
| rs1452235 | Imputed | G | GEN | 443 | | | | | 5.506 | 0.06375 | 0.5227 | 0.33296 | 0.36911 | 0.30556 |
| rs1452236 | Imputed | G | GEN | 443 | | | | | 5.506 | 0.06375 | 0.5227 | 0.33296 | 0.36911 | 0.30556 |
| rs1452237 | Imputed | G | GEN | 443 | | | | | 5.995 | 0.04992 | 0.6732 | 0.33973 | 0.37435 | 0.31349 |
| rs1452243 | Genotyped | T | GEN | 443 | | | | | | | | | | |
| rs1463768 | Genotyped | G | REC | 443 | 1.844 | 0.2673 | 1.092 | 3.114 | 2.29 | 0.02201 | 0.5464 | 0.38262 | 0.42932 | 0.34722 |
| rs1463769 | Imputed | G | REC | 443 | 1.844 | 0.2673 | 1.092 | 3.114 | 2.29 | 0.02201 | 0.5464 | 0.38262 | 0.42932 | 0.34722 |

TABLE 11-continued

| | | | | | | | | | | |
|---|---|---|---|---|---|---|---|---|---|---|
| rs1472435 | Imputed | A | ADD | 437 | 0.5361 | 0.3365 | 0.2772 | 1.037 | -1.853 | 0.0639 | 0.6259 | 0.05378 | 0.03704 | 0.06653 |
| rs1472435 | Imputed | A | DOM | 437 | 0.5361 | 0.3365 | 0.2772 | 1.037 | -1.853 | 0.0639 | 0.6259 | 0.05378 | 0.03704 | 0.06653 |
| rs1476714 | Imputed | A | DOM | 439 | 0.5924 | 0.2025 | 0.3983 | 0.8811 | -2.585 | 0.00974 | 0.1129 | 0.3451 | 0.31316 | 0.36948 |
| rs1495159 | Imputed | G | ADD | 429 | 1.318 | 0.1505 | 0.9813 | 1.77 | 1.835 | 0.06656 | 0.6567 | 0.31935 | 0.35135 | 0.29508 |
| rs1495159 | Imputed | G | GEN | 429 | | | | | 9.642 | 0.00806 | | 0.31935 | 0.35135 | 0.29508 |
| rs1495375 | Imputed | A | DOM | 421 | 0.7102 | 0.2081 | 0.4724 | 1.068 | -1.644 | 0.1001 | 0.9197 | 0.40855 | 0.37297 | 0.43644 |
| rs1495376 | Imputed | T | DOM | 424 | 0.774 | 0.2264 | 0.4966 | 1.206 | -1.132 | 0.2577 | 0.3834 | 0.48231 | 0.45652 | 0.50208 |
| rs1495377 | Imputed | G | DOM | 425 | 0.7814 | 0.2265 | 0.5013 | 1.218 | -1.089 | 0.2762 | 0.4372 | 0.48118 | 0.45652 | 0.5 |
| rs1495381 | Imputed | T | GEN | 442 | | | | | 7.762 | 0.02063 | 0.2705 | 0.38575 | 0.43421 | 0.34921 |
| rs1495381 | Imputed | T | REC | 442 | 2.08 | 0.2834 | 1.194 | 3.626 | 2.584 | 0.00975 | 0.2705 | 0.38575 | 0.43421 | 0.34921 |
| rs1498992 | Imputed | G | DOM | 428 | 0.7274 | 0.1999 | 0.4916 | 1.076 | -1.592 | 0.1114 | 0.4588 | 0.35047 | 0.32337 | 0.3709 |
| rs1499001 | Imputed | T | DOM | 437 | 0.7573 | 0.1974 | 0.5144 | 1.115 | -1.409 | 0.159 | 0.2889 | 0.28375 | 0.26203 | 0.3 |
| rs1512988 | Imputed | A | DOM | 442 | 0.7185 | 0.204 | 0.4817 | 1.072 | -1.621 | 0.1051 | 0.6908 | 0.3948 | 0.36316 | 0.41865 |
| rs1512989 | Imputed | T | DOM | 442 | 0.7185 | 0.204 | 0.4817 | 1.072 | -1.621 | 0.1051 | 0.6908 | 0.3948 | 0.36316 | 0.41865 |
| rs1512991 | Imputed | T | ADD | 425 | 0.7106 | 0.1399 | 0.5401 | 0.9348 | -2.442 | 0.01462 | 0.3804 | 0.45647 | 0.4071 | 0.4938 |
| rs1512991 | Imputed | T | DOM | 425 | 0.6965 | 0.2131 | 0.4587 | 1.057 | -1.698 | 0.08957 | 0.3804 | 0.45647 | 0.4071 | 0.4938 |
| rs1516855 | Imputed | G | REC | 398 | 1.236 | 0.2928 | 0.6964 | 2.195 | 0.7243 | 0.4689 | 0.2364 | 0.36935 | 0.38571 | 0.3565 |
| rs1527450 | Imputed | T | ADD | 441 | 1.146 | 0.1493 | 0.8556 | 1.536 | 0.9151 | 0.3601 | 0.6792 | 0.35714 | 0.37302 | 0.34524 |
| rs1527450 | Imputed | T | GEN | 441 | | | | | 0.8647 | 0.649 | 0.6792 | 0.35714 | 0.37302 | 0.34524 |
| rs1567740 | Imputed | T | DOM | 439 | 0.7204 | 0.2038 | 0.4831 | 1.074 | -1.609 | 0.1076 | 0.8422 | 0.39863 | 0.36579 | 0.42369 |
| rs1572573 | Imputed | A | ADD | 396 | 1.012 | 0.2009 | 0.6826 | 1.501 | 0.05984 | 0.9523 | 0.00264 | 0.18813 | 0.18786 | 0.18834 |
| rs1572573 | Imputed | A | DOM | 396 | 1.019 | 0.2128 | 0.6715 | 1.546 | 0.08849 | 0.9295 | 0.00264 | 0.18813 | 0.18786 | 0.18834 |
| rs1584003 | Imputed | C | DOM | 432 | 0.6043 | 0.2157 | 0.396 | 0.9221 | -2.336 | 0.0195 | 0.2438 | 0.45255 | 0.42063 | 0.47737 |
| rs1584005 | Imputed | C | DOM | 427 | 0.6032 | 0.2163 | 0.3947 | 0.9217 | -2.337 | 0.01944 | 0.2831 | 0.45082 | 0.41979 | 0.475 |
| rs1585771 | Imputed | G | ADD | 433 | 0.9914 | 0.1575 | 0.728 | 1.35 | -0.05515 | 0.956 | 1 | 0.26559 | 0.26486 | 0.26613 |
| rs1592015 | Imputed | G | DOM | 443 | 1.138 | 0.2135 | 0.7487 | 1.729 | 0.6045 | 0.5455 | 0.2352 | 0.16817 | 0.17801 | 0.16071 |
| rs1594885 | Imputed | A | ADD | 440 | 1.083 | 0.1634 | 0.7863 | 1.492 | 0.4891 | 0.6248 | 0.7887 | 0.23182 | 0.23947 | 0.226 |
| rs1603232 | Imputed | A | DOM | 412 | 0.7502 | 0.2319 | 0.4761 | 1.182 | -1.239 | 0.2152 | 0.49 | 0.49029 | 0.46111 | 0.51293 |
| rs1614565 | Imputed | C | DOM | 439 | 0.7578 | 0.2237 | 0.4888 | 1.175 | -1.24 | 0.2151 | 0.6336 | 0.49089 | 0.46296 | 0.512 |
| rs1648200 | Imputed | C | ADD | 411 | 1.299 | 0.1675 | 0.9357 | 1.804 | 1.563 | 0.118 | 1 | 0.24331 | 0.26816 | 0.22414 |
| rs16877387 | Imputed | C | DOM | 436 | 1.186 | 0.3054 | 0.6518 | 2.158 | 2.224 | 0.3289 | 0.5854 | 0.32569 | 0.31649 | 0.33266 |
| rs16877387 | Imputed | C | REC | 436 | 1.186 | 0.3054 | 0.6518 | 2.158 | 0.5586 | 0.5764 | 0.5854 | 0.32569 | 0.31649 | 0.33266 |
| rs16938626 | Imputed | G | DOM | 435 | 0.7689 | 0.1982 | 0.5213 | 1.134 | -1.326 | 0.1849 | 0.3923 | 0.26552 | 0.24866 | 0.27823 |
| rs1694334 | Imputed | A | ADD | 399 | 1.156 | 0.1835 | 0.8068 | 1.657 | 0.7904 | 0.4293 | 0.5371 | 0.20426 | 0.21765 | 0.19432 |
| rs16998821 | Imputed | C | DOM | 443 | 1.138 | 0.2135 | 0.7487 | 1.729 | 0.6045 | 0.5455 | 0.2352 | 0.16817 | 0.17801 | 0.16071 |
| rs1700400 | Imputed | T | ADD | 417 | 0.9427 | 0.1613 | 0.6872 | 1.293 | -0.3659 | 0.7144 | 0.1293 | 0.23141 | 0.22652 | 0.23517 |
| rs17007620 | Imputed | A | ADD | 408 | 1.033 | 0.1717 | 0.7377 | 1.446 | 0.1877 | 0.8511 | 1 | 0.22181 | 0.22599 | 0.21861 |
| rs17007620 | Imputed | A | DOM | 408 | 1.127 | 0.206 | 0.7523 | 1.687 | 0.5784 | 0.563 | 1 | 0.22181 | 0.22599 | 0.21861 |
| rs17023290 | Imputed | C | DOM | 443 | 0.8286 | 0.2404 | 0.5173 | 1.327 | -0.7821 | 0.4342 | 0.8039 | 0.10722 | 0.09686 | 0.11508 |
| rs17047957 | Imputed | C | DOM | 439 | 1.801 | 0.2129 | 1.187 | 2.734 | 2.765 | 0.0057 | 0.6092 | 0.16856 | 0.20635 | 0.14 |
| rs1705237 | Imputed | A | DOM | 439 | 0.7578 | 0.2237 | 0.4888 | 1.175 | -1.24 | 0.2151 | 0.6336 | 0.49089 | 0.46296 | 0.512 |
| rs1705261 | Imputed | C | ADD | 442 | 2.005 | 0.2767 | 1.166 | 3.449 | 7.113 | 0.02854 | 0.5499 | 0.39367 | 0.43947 | 0.35913 |
| rs1705261 | Imputed | C | REC | 442 | 1.031 | 0.1393 | 0.7845 | 1.355 | 2.514 | 0.01192 | 0.5499 | 0.39367 | 0.43947 | 0.35913 |
| rs17076972 | Imputed | G | DOM | 442 | | | | | 0.2183 | 0.8272 | 0.5032 | 0.45814 | 0.46335 | 0.45418 |
| rs17076972 | Imputed | C | GEN | 442 | | | | | 0.2344 | 0.8894 | 0.5032 | 0.45814 | 0.46335 | 0.45418 |
| rs17076972 | Imputed | C | REC | 442 | 0.9776 | 0.2403 | 0.6104 | 1.566 | -0.09436 | 0.9248 | 0.5032 | 0.45814 | 0.46335 | 0.45418 |
| rs17189710 | Imputed | T | ADD | 430 | 1.382 | 0.1457 | 1.039 | 1.839 | 2.22 | 0.02639 | 0.3369 | 0.34535 | 0.38649 | 0.31429 |
| rs17196143 | Imputed | A | ADD | 443 | | | | | 6.752 | 0.03418 | 0.3369 | 0.34535 | 0.38649 | 0.31429 |
| rs17353809 | Imputed | G | ADD | 433 | 0.7066 | 0.186 | 0.4907 | 1.017 | -1.867 | 0.06189 | 1 | 0.17946 | 0.15183 | 0.2004 |
| rs17368986 | Imputed | A | DOM | 442 | 0.9859 | 0.1679 | 0.7095 | 1.37 | -0.0846 | 0.9326 | 0.569 | 0.21478 | 0.21351 | 0.21573 |
| rs17369097 | Imputed | A | GEN | 443 | | | | | 1.393 | 0.4984 | 0.6226 | 0.17534 | 0.19211 | 0.1627 |
| rs17434511 | Imputed | C | GEN | 442 | | | | | 1.248 | 0.5357 | 0.6275 | 0.17946 | 0.19634 | 0.16667 |
| rs17434511 | Imputed | C | GEN | 442 | | | | | 1.393 | 0.4984 | 0.6226 | 0.17534 | 0.19211 | 0.1627 |

TABLE 11-continued

| | | | | | | | | | | |
|---|---|---|---|---|---|---|---|---|---|---|
| rs17434589 | Imputed | C | GEN | 442 | | | | 1.393 | 0.4984 | 0.6226 | 0.17534 | 0.19211 | 0.1627 |
| rs17434603 | Imputed | G | GEN | 442 | | | | 1.393 | 0.4984 | 0.6226 | 0.17534 | 0.19211 | 0.1627 |
| rs17434840 | Imputed | C | GEN | 443 | | | | 1.248 | 0.5357 | 0.6275 | 0.17946 | 0.19634 | 0.16667 |
| rs17446418 | Imputed | G | DOM | 380 | 1.044 | 0.2158 | 0.6838 | 0.1982 | 0.8429 | 0.03708 | 0.32895 | 0.33537 | 0.32407 |
| rs17553074 | Imputed | T | DOM | 374 | 1.033 | 0.2172 | 0.6751 | 0.1511 | 0.8799 | 0.0203 | 0.3369 | 0.34375 | 0.33178 |
| rs17604285 | Imputed | C | ADD | 443 | 0.9476 | 0.2663 | 0.5622 | −0.2023 | 0.8397 | 0.09538 | 0.07788 | 0.07592 | 0.07937 |
| rs17604285 | Imputed | C | DOM | 443 | 0.9476 | 0.2663 | 0.5622 | −0.2023 | 0.8397 | 0.09538 | 0.07788 | 0.07592 | 0.07937 |
| rs17662322 | Imputed | T | DOM | 443 | 0.7561 | 0.2081 | 0.5029 | −1.344 | 0.179 | 0.8723 | 0.18059 | 0.15969 | 0.19643 |
| rs17769826 | Imputed | T | ADD | 433 | 0.9859 | 0.1679 | 0.7095 | −0.0846 | 0.9326 | 0.569 | 0.21478 | 0.21351 | 0.21573 |
| rs17821641 | Imputed | T | ADD | 442 | 1.021 | 0.1625 | 0.7424 | 0.1273 | 0.8987 | 0.8924 | 0.22624 | 0.22895 | 0.22421 |
| rs1782328 | Imputed | A | ADD | 426 | 0.96 | 0.1915 | 0.6595 | −0.213 | 0.8313 | 0.305 | 0.17136 | 0.16758 | 0.17418 |
| rs1796337 | Imputed | T | DOM | 428 | 0.6991 | 0.2365 | 0.4398 | −1.514 | 0.1301 | 0.1753 | 0.51285 | 0.47581 | 0.54132 |
| rs1798083 | Imputed | C | DOM | 441 | 0.7428 | 0.2255 | 0.4774 | −1.318 | 0.1874 | 0.7038 | 0.5 | 0.47105 | 0.52191 |
| rs1798085 | Imputed | T | DOM | 439 | 0.7578 | 0.2237 | 0.4888 | −1.24 | 0.2151 | 0.6336 | 0.49089 | 0.46296 | 0.512 |
| rs1798086 | Imputed | T | DOM | 416 | 0.7565 | 0.2341 | 0.4781 | −1.192 | 0.2332 | 0.6948 | 0.50361 | 0.47826 | 0.52371 |
| rs1798089 | Imputed | C | GEN | 366 | | | | 2.947 | 0.2291 | | 0.29235 | 0.31908 | 0.27336 |
| rs1798089 | Imputed | C | REC | 366 | 2.307 | 0.5861 | 0.7314 | 1.426 | 0.1538 | 2.13E-06 | 0.29235 | 0.31908 | 0.27336 |
| rs1798090 | Imputed | C | GEN | 367 | | | | 3.038 | 0.2189 | 2.13E-06 | 0.29292 | 0.32026 | 0.27336 |
| rs1798090 | Imputed | C | REC | 367 | 2.295 | 0.5861 | 0.7275 | 1.417 | 0.1564 | 1.37E-06 | 0.29292 | 0.32026 | 0.27336 |
| rs1832222 | Imputed | G | DOM | 443 | 1.344 | 0.1965 | 0.9144 | 1.504 | 0.1325 | 0.2005 | 0.33521 | 0.36911 | 0.30952 |
| rs1838104 | Imputed | A | ADD | 440 | 0.9138 | 0.1404 | 0.694 | −0.6418 | 0.521 | 0.5608 | 0.56591 | 0.55526 | 0.574 |
| rs1838104 | Imputed | A | GEN | 440 | | | | 0.6345 | 0.7281 | 0.5608 | 0.56591 | 0.55526 | 0.574 |
| rs1868616 | Imputed | C | ADD | 437 | 0.8179 | 0.1786 | 0.5764 | −1.126 | 0.2602 | 0.8751 | 0.18764 | 0.17021 | 0.2008 |
| rs1874313 | Imputed | G | DOM | 443 | 0.7338 | 0.2032 | 0.4927 | −1.523 | 0.1277 | 0.6922 | 0.39503 | 0.36387 | 0.41865 |
| rs1884902 | Imputed | A | REC | 443 | 0.9755 | 0.2643 | 0.5811 | −0.09385 | 0.9252 | 0.108 | 0.38036 | 0.37696 | 0.38294 |
| rs1913201 | Imputed | C | ADD | 432 | 0.7137 | 0.1396 | 0.5429 | −2.415 | 0.01572 | 0.438 | 0.4537 | 0.4054 | 0.48988 |
| rs1913201 | Imputed | G | DOM | 432 | 0.7026 | 0.2117 | 0.464 | 1.064 | 0.09546 | 0.438 | 0.4537 | 0.4054 | 0.48988 |
| rs1913201 | Imputed | G | GEN | 432 | | | | 6.276 | 0.04338 | | 0.4537 | 0.4054 | 0.48988 |
| rs1944279 | Imputed | A | ADD | 438 | 1.083 | 0.1637 | 0.7858 | 0.4879 | 0.6256 | 0.7885 | 0.23174 | 0.23947 | 0.22581 |
| rs198461 | Imputed | C | DOM | 433 | 0.5222 | 0.221 | 0.3386 | −2.94 | 0.00328 | 0.6307 | 0.48614 | 0.43548 | 0.52429 |
| rs1987179 | Imputed | T | DOM | 417 | 0.5176 | 0.2237 | 0.3339 | −2.944 | 0.00324 | 0.8637 | 0.17266 | 0.13462 | 0.20213 |
| rs1990023 | Imputed | T | DOM | 443 | 0.593 | 0.2016 | 0.3994 | −2.592 | 0.00954 | 0.1134 | 0.34312 | 0.3089 | 0.36905 |
| rs2016194 | Imputed | G | DOM | 443 | 0.5934 | 0.2016 | 0.3997 | −2.589 | 0.00964 | 0.8491 | 0.34312 | 0.31152 | 0.36706 |
| rs2024789 | Imputed | C | ADD | 440 | 0.9942 | 0.1364 | 0.7609 | −0.0427 | 0.9659 | 0.8491 | 0.50682 | 0.50529 | 0.50797 |
| rs2024789 | Imputed | C | GEN | 440 | | | | 0.0158 | 0.9921 | | 0.50682 | 0.50529 | 0.50797 |
| rs2024902 | Imputed | A | ADD | 442 | 1.087 | 0.2583 | 0.655 | 0.3216 | 0.7477 | 0.2797 | 0.07353 | 0.07592 | 0.07171 |
| rs2024902 | Imputed | C | DOM | 442 | 1.157 | 0.2804 | 0.6678 | 0.52 | 0.6031 | 0.2797 | 0.07353 | 0.07592 | 0.07171 |
| rs2025107 | Imputed | T | ADD | 442 | 0.9899 | 0.2312 | 0.6292 | −0.04381 | 0.9651 | 0.0729 | 0.0905 | 0.08947 | 0.09127 |
| rs2025107 | Imputed | A | DOM | 442 | 0.982 | 0.2619 | 0.5877 | −0.06944 | 0.9446 | 0.0729 | 0.0905 | 0.08947 | 0.09127 |
| rs2025108 | Imputed | T | ADD | 442 | 0.9899 | 0.2312 | 0.6292 | −0.04381 | 0.9651 | 0.0729 | 0.0905 | 0.08947 | 0.09127 |
| rs2025108 | Imputed | A | DOM | 442 | 0.982 | 0.2619 | 0.5877 | −0.06944 | 0.9446 | 0.0729 | 0.0905 | 0.08947 | 0.09127 |
| rs2062448 | Imputed | T | ADD | 442 | 0.913 | 0.2688 | 0.5391 | −0.3387 | 0.7348 | 0.09556 | 0.07692 | 0.07368 | 0.07937 |
| rs2062448 | Imputed | T | DOM | 442 | 0.913 | 0.2688 | 0.5391 | −0.3387 | 0.7348 | 0.09556 | 0.07692 | 0.07368 | 0.07937 |
| rs2063591 | Imputed | C | ADD | 441 | 0.7255 | 0.1363 | 0.5554 | −2.353 | 0.01861 | 0.2947 | 0.47506 | 0.42932 | 0.51 |
| rs2063591 | Imputed | C | DOM | 441 | 0.6936 | 0.2125 | 0.4573 | −1.722 | 0.08515 | 0.3089 | 0.47506 | 0.42932 | 0.51 |
| rs2065604 | Imputed | C | DOM | 443 | 1.177 | 0.2597 | 0.7077 | 0.6286 | 0.5296 | 0.5598 | 0.08691 | 0.09424 | 0.08135 |
| rs2066238 | Imputed | C | DOM | 443 | 1.138 | 0.2135 | 0.7487 | 0.6045 | 0.5455 | 0.2352 | 0.16817 | 0.17801 | 0.16071 |
| rs2068051 | Imputed | G | ADD | 269 | 0.9214 | 0.1888 | 0.6364 | −0.4337 | 0.6645 | 0.3082 | 0.60223 | 0.59009 | 0.61076 |
| rs2068051 | Imputed | G | GEN | 269 | | | | 0.367 | 0.8324 | 0.4324 | 0.60223 | 0.59009 | 0.61076 |
| rs2077702 | Genotyped | G | ADD | 443 | | | | 8.422 | 0.01483 | 0.6456 | 0.30361 | 0.3534 | 0.26587 |
| rs208757 | Imputed | G | ADD | 435 | 1.552 | 0.175 | 1.101 | 2.512 | 0.01201 | 0.6456 | 0.19425 | 0.23545 | 0.1626 |
| rs208757 | Imputed | G | DOM | 435 | 1.858 | 0.2057 | 1.241 | 3.011 | 0.0026 | 0.1626 | 0.19425 | 0.23545 | 0.1626 |
| rs2095586 | Imputed | A | DOM | 442 | 1.347 | 0.1964 | 0.9168 | 1.518 | 0.129 | 0.3355 | 0.33145 | 0.36649 | 0.30478 |

TABLE 11-continued

| | | | | | | | | | | | | |
|---|---|---|---|---|---|---|---|---|---|---|---|---|
| rs2108426 | Imputed | C | DOM | 443 | 0.5934 | 0.2016 | 0.3997 | 0.881 | −2.589 | 0.00964 | 0.1134 | 0.34312 | 0.31152 | 0.36706 |
| rs2110664 | Imputed | A | DOM | 399 | 1.47 | 0.2058 | 0.9818 | 2.2 | 1.871 | 0.06136 | 1 | 0.27569 | 0.30523 | 0.2533 |
| rs2132242 | Imputed | A | DOM | 440 | 0.6978 | 0.2022 | 0.4695 | 1.037 | −1.78 | 0.07505 | | 0.40341 | 0.36842 | 0.43 |
| rs2151644 | Imputed | T | DOM | 442 | 1.184 | 0.2598 | 0.7118 | 1.97 | 0.6512 | 0.5149 | 0.7613 | 0.0871 | 0.09474 | 0.08135 |
| rs2157752 | Genotyped | A | GEN | 443 | | | | | 0.5489 | 0.76 | 0.372 | 0.30474 | 0.29843 | 0.30952 |
| rs2158958 | Imputed | A | DOM | 443 | 0.5934 | 0.2016 | 0.3997 | 0.881 | −2.589 | 0.00964 | 0.1134 | 0.34312 | 0.31152 | 0.36706 |
| rs2158961 | Imputed | G | DOM | 443 | 0.6399 | 0.1948 | 0.4368 | 0.9373 | −2.293 | 0.02187 | 0.8242 | 0.30813 | 0.2801 | 0.32937 |
| rs2164099 | Imputed | G | ADD | 441 | 1.075 | 0.1633 | 0.7809 | 1.481 | 0.4457 | 0.6558 | 0.6902 | 0.23243 | 0.23947 | 0.22709 |
| rs2173254 | Imputed | G | GEN | 438 | | | | | 0.524 | 0.7695 | 0.9154 | 0.34132 | 0.35185 | 0.33333 |
| rs2173254 | Imputed | G | REC | 438 | 1.019 | 0.3061 | 0.5595 | 1.857 | 0.06273 | 0.95 | 0.9154 | 0.34132 | 0.35185 | 0.33333 |
| rs2188079 | Imputed | C | ADD | 443 | 1.028 | 0.1399 | 0.7818 | 1.353 | 0.2006 | 0.841 | 0.563 | 0.43905 | 0.44503 | 0.43452 |
| rs2188079 | Imputed | C | GEN | 443 | | | | | 1.2 | 0.5489 | 0.563 | 0.43905 | 0.44503 | 0.43452 |
| rs2190304 | Imputed | T | REC | 443 | 1.465 | 0.2335 | 0.9272 | 2.316 | 1.636 | 0.1017 | 1 | 0.47517 | 0.47906 | 0.47222 |
| rs2190597 | Imputed | T | DOM | 440 | 0.6496 | 0.2095 | 0.4309 | 0.9795 | −2.059 | 0.0395 | 0.1008 | 0.44318 | 0.42021 | 0.46032 |
| rs2190598 | Imputed | T | DOM | 443 | 0.5934 | 0.2016 | 0.3997 | 0.881 | −2.589 | 0.00964 | 0.1134 | 0.34312 | 0.31152 | 0.36706 |
| rs2190600 | Imputed | A | DOM | 440 | 0.577 | 0.2025 | 0.388 | 0.8581 | −2.716 | 0.00661 | 0.07522 | 0.34886 | 0.31316 | 0.376 |
| rs2218084 | Imputed | T | GEN | 440 | | | | | 5.731 | 0.05696 | 0.3138 | 0.17159 | 0.17368 | 0.17 |
| rs2218084 | Imputed | T | REC | 440 | 2.942 | 0.5498 | 1.002 | 8.643 | 1.963 | 0.04966 | 0.3138 | 0.17159 | 0.17368 | 0.17 |
| rs2236290 | Genotyped | C | GEN | 441 | | | | | 6.206 | 0.04491 | 0.9174 | 0.35488 | 0.31675 | 0.384 |
| rs2243860 | Imputed | A | GEN | 354 | | | | | 2.941 | 0.2298 | 0.4096 | 0.4096 | 0.44737 | 0.38119 |
| rs2243860 | Imputed | A | REC | 354 | 1.553 | 0.289 | 0.8812 | 2.736 | 1.522 | 0.1279 | 0.4422 | 0.4096 | 0.44737 | 0.38119 |
| rs2246564 | Imputed | T | DOM | 443 | 1.177 | 0.2597 | 0.7077 | 1.959 | 0.6286 | 0.5296 | 0.5598 | 0.08691 | 0.09424 | 0.08135 |
| rs2248236 | Imputed | C | DOM | 443 | 0.5404 | 0.2044 | 0.362 | 0.8067 | −3.011 | 0.0026 | 0.8852 | 0.20655 | 0.17016 | 0.23413 |
| rs2250340 | Imputed | T | DOM | 410 | 1.184 | 0.2617 | 0.709 | 1.978 | 0.6458 | 0.5184 | 0.7706 | 0.0939 | 0.10169 | 0.08798 |
| rs2257192 | Imputed | G | DOM | 443 | 1.177 | 0.2597 | 0.7077 | 1.959 | 0.6286 | 0.5296 | 0.5598 | 0.08691 | 0.09424 | 0.08135 |
| rs2270584 | Imputed | A | DOM | 441 | 0.6747 | 0.2026 | 0.4536 | 1.004 | −1.942 | 0.05211 | 0.4848 | 0.39342 | 0.35526 | 0.42231 |
| rs2270586 | Imputed | A | DOM | 442 | 0.6883 | 0.2018 | 0.4634 | 1.022 | −1.851 | 0.06423 | 0.4864 | 0.3602 | 0.35602 | 0.42231 |
| rs2270589 | Imputed | A | ADD | 391 | 0.6468 | 0.1498 | 0.4822 | 0.8674 | −2.909 | 0.00362 | 0.7615 | 0.48082 | 0.42059 | 0.52715 |
| rs2270589 | Imputed | A | DOM | 391 | 0.5799 | 0.2334 | 0.367 | 0.9163 | −2.335 | 0.01956 | 0.7615 | 0.48082 | 0.42059 | 0.52715 |
| rs2270589 | Imputed | A | GEN | 391 | | | | | 8.473 | 0.01446 | 0.7615 | 0.48082 | 0.42059 | 0.52715 |
| rs2296889 | Imputed | C | DOM | 437 | 0.9005 | 0.2162 | 0.5895 | 1.376 | −0.485 | 0.6277 | 0.3269 | 0.17849 | 0.18182 | 0.176 |
| rs2301346 | Imputed | A | ADD | 357 | 1.001 | 0.1711 | 0.7159 | 1.4 | 0.005922 | 0.9953 | 0.4976 | 0.26611 | 0.26563 | 0.2665 |
| rs2301346 | Imputed | A | DOM | 357 | 1.026 | 0.2191 | 0.6675 | 1.576 | 0.1152 | 0.9083 | 0.4976 | 0.26611 | 0.26563 | 0.2665 |
| rs2327929 | Imputed | C | REC | 441 | 1.411 | 0.2475 | 0.8684 | 2.291 | 1.39 | 0.1645 | 0.4376 | 0.42857 | 0.44764 | 0.414 |
| rs2357486 | Imputed | C | DOM | 436 | 0.8855 | 0.316 | 0.4766 | 1.645 | −0.385 | 0.7003 | 0.9136 | 0.32683 | 0.32181 | 0.33065 |
| rs2373793 | Imputed | G | DOM | 435 | 1.599 | 0.2233 | 1.032 | 2.477 | 2.103 | 0.03546 | 1 | 0.14253 | 0.17368 | 0.11837 |
| rs2377622 | Genotyped | T | GEN | 291 | | | | | 8.41 | 0.01492 | | 0.38832 | 0.33333 | 0.42857 |
| rs2377622 | Imputed | T | REC | 291 | 0.2954 | 0.4232 | 0.1289 | 0.677 | −2.882 | 0.00396 | 0.4634 | 0.38832 | 0.33333 | 0.42857 |
| rs2383903 | Imputed | G | DOM | 443 | 0.7568 | 0.1968 | 0.5146 | 1.113 | −1.416 | 0.1569 | 0.8852 | 0.26411 | 0.24607 | 0.27778 |
| rs2389866 | Imputed | C | DOM | 443 | 0.5404 | 0.2044 | 0.362 | 0.8067 | −3.011 | 0.0026 | 0.8852 | 0.20655 | 0.17016 | 0.23413 |
| rs2389869 | Imputed | C | DOM | 443 | 0.5404 | 0.2044 | 0.362 | 0.8067 | −3.011 | 0.0026 | 0.8852 | 0.20655 | 0.17016 | 0.23413 |
| rs2418541 | Imputed | A | DOM | 443 | 0.593 | 0.2016 | 0.3994 | 0.8804 | −2.592 | 0.00954 | 0.1134 | 0.34312 | 0.3089 | 0.36905 |
| rs2418542 | Imputed | A | DOM | 443 | 0.593 | 0.2016 | 0.3994 | 0.8804 | −2.592 | 0.00954 | 0.1134 | 0.34312 | 0.3089 | 0.36905 |
| rs2418548 | Imputed | C | DOM | 442 | 0.6036 | 0.2017 | 0.4065 | 0.8963 | −2.503 | 0.01231 | 0.01683 | 0.35633 | 0.32199 | 0.38247 |
| rs2476976 | Imputed | C | DOM | 443 | 1.391 | 0.1963 | 0.9466 | 2.044 | 1.68 | 0.09288 | 0.2817 | 0.32919 | 0.36387 | 0.30279 |
| rs2483639 | Imputed | A | DOM | 443 | 1.177 | 0.2597 | 0.7077 | 1.959 | 0.6286 | 0.5296 | 0.5598 | 0.08691 | 0.09424 | 0.08135 |
| rs2483640 | Imputed | A | DOM | 443 | 1.177 | 0.2597 | 0.7077 | 1.959 | 0.6286 | 0.5296 | 0.5598 | 0.08691 | 0.09424 | 0.08135 |
| rs2544780 | Imputed | T | REC | 442 | 3.054 | 0.3822 | 1.444 | 6.46 | 2.921 | 0.00349 | 0.3055 | 0.29638 | 0.33246 | 0.26892 |
| rs2586458 | Imputed | T | DOM | 372 | 1.439 | 0.2465 | 0.8877 | 2.333 | 1.477 | 0.1397 | 1 | 0.13172 | 0.14744 | 0.12037 |
| rs2593272 | Imputed | G | ADD | 443 | 0.9033 | 0.1559 | 0.6654 | 1.226 | −0.6524 | 0.5141 | 0.1147 | 0.23702 | 0.22775 | 0.24405 |
| rs2593273 | Imputed | T | ADD | 426 | 0.9769 | 0.1588 | 0.7156 | 1.334 | −0.1474 | 0.8828 | 0.03674 | 0.22418 | 0.2234 | 0.22479 |
| rs2622499 | Imputed | G | ADD | 443 | 0.5404 | 0.2044 | 0.362 | 0.8067 | −3.011 | 0.0026 | 0.8852 | 0.20655 | 0.17016 | 0.23413 |
| rs264126 | Imputed | C | DOM | 439 | 0.6379 | 0.2093 | 0.4232 | 0.9615 | −2.148 | 0.03174 | 0.08131 | 0.44191 | 0.41755 | 0.46016 |

TABLE 11-continued

| | | | | | | | | | | | |
|---|---|---|---|---|---|---|---|---|---|---|---|
| rs264129 | Imputed | T | DOM | 443 | 0.6399 | 0.1948 | 0.4368 | 0.9373 | −2.293 | 0.02187 | 0.8242 | 0.30813 | 0.2801 | 0.32937 |
| rs2656822 | Imputed | T | ADD | 443 | 0.9033 | 0.1559 | 0.6654 | 1.226 | −0.6524 | 0.5141 | 0.1147 | 0.23702 | 0.22775 | 0.24405 |
| rs2656823 | Imputed | G | ADD | 443 | 0.9033 | 0.1559 | 0.6654 | 1.226 | −0.6524 | 0.5141 | 0.1147 | 0.23702 | 0.22775 | 0.24405 |
| rs2656825 | Imputed | T | ADD | 420 | 0.986 | 0.1592 | 0.7217 | 1.347 | −0.08844 | 0.9295 | 0.03522 | 0.225 | 0.2246 | 0.22532 |
| rs2764766 | Imputed | C | REC | 443 | 3.069 | 0.3822 | 1.451 | 6.491 | 2.934 | 0.00335 | 0.3053 | 0.29684 | 0.33246 | 0.26984 |
| rs2793101 | Imputed | T | ADD | 442 | 1.081 | 0.236 | 0.6809 | 1.717 | 0.3309 | 0.7407 | 0.7843 | 0.09615 | 0.09948 | 0.09363 |
| rs2793101 | Imputed | T | DOM | 442 | 1.046 | 0.2497 | 0.6414 | 1.707 | 0.1818 | 0.8557 | 0.7843 | 0.09615 | 0.09948 | 0.09363 |
| rs2795871 | Imputed | A | ADD | 435 | 0.5722 | 0.339 | 0.2944 | 1.112 | −1.647 | 0.09966 | 0.6186 | 0.05172 | 0.03763 | 0.06225 |
| rs2795886 | Imputed | A | ADD | 442 | 0.5272 | 0.3735 | 0.2535 | 1.096 | −1.714 | 0.08652 | 1 | 0.04299 | 0.02895 | 0.05357 |
| rs2795886 | Imputed | A | DOM | 442 | 0.5272 | 0.3735 | 0.2535 | 1.096 | −1.714 | 0.08652 | 1 | 0.04299 | 0.02895 | 0.05357 |
| rs2859994 | Imputed | C | GEN | 436 | | | | | 0.8834 | 0.643 | | | | 0.36694 |
| rs2870464 | Imputed | G | DOM | 441 | 1.969 | 0.2225 | 1.273 | 3.045 | 3.045 | 0.00233 | 0.4109 | 0.36927 | 0.37234 | 0.36694 |
| rs2875528 | Imputed | T | DOM | 443 | 0.8843 | 0.2352 | 0.5577 | 1.402 | −0.5227 | 0.6012 | 0.4419 | 0.14399 | 0.17632 | 0.11952 |
| rs2876227 | Imputed | C | ADD | 442 | 1.389 | 0.1445 | 1.046 | 1.843 | 2.272 | 0.02309 | 1 | 0.11851 | 0.10995 | 0.125 |
| rs2876227 | Imputed | C | GEN | 442 | | | | | 6.593 | 0.03701 | 0.4631 | 0.34502 | 0.38743 | 0.31275 |
| rs2882097 | Imputed | A | DOM | 443 | 1.364 | 0.1959 | 0.9291 | 2.003 | 1.584 | 0.1131 | 0.4631 | 0.33409 | 0.36911 | 0.30754 |
| rs2921983 | Imputed | C | ADD | 416 | 0.8945 | 0.167 | 0.6448 | 1.241 | −0.6677 | 0.5043 | 0.1655 | 0.21755 | 0.20718 | 0.22553 |
| rs2987537 | Imputed | C | ADD | 438 | 1.58 | 0.2184 | 1.03 | 2.424 | 2.095 | 0.03621 | 0.2479 | 0.15753 | 0.18617 | 0.136 |
| rs2996416 | Imputed | C | ADD | 438 | 1.725 | 0.2225 | 1.115 | 2.668 | 2.451 | 0.01426 | 0.718 | 0.11872 | 0.14894 | 0.096 |
| rs2996416 | Imputed | C | DOM | 438 | 1.754 | 0.2318 | 1.113 | 2.762 | 2.423 | 0.01539 | 0.1759 | 0.11872 | 0.14894 | 0.096 |
| rs3015527 | Imputed | C | ADD | 398 | 1.884 | 0.2353 | 1.188 | 2.989 | 2.693 | 0.00708 | 0.3323 | 0.11558 | 0.15029 | 0.08889 |
| rs3015527 | Imputed | C | DOM | 398 | 1.945 | 0.2451 | 1.203 | 3.144 | 2.714 | 0.00664 | 0.3323 | 0.11558 | 0.15029 | 0.08889 |
| rs3015530 | Imputed | C | ADD | 438 | 1.725 | 0.2225 | 1.115 | 2.668 | 2.451 | 0.01426 | 0.1759 | 0.11872 | 0.14894 | 0.096 |
| rs3015530 | Imputed | C | DOM | 438 | 1.754 | 0.2318 | 1.113 | 2.762 | 2.423 | 0.01539 | 0.1759 | 0.11872 | 0.14894 | 0.096 |
| rs3015531 | Imputed | T | ADD | 438 | 1.725 | 0.2225 | 1.115 | 2.668 | 2.451 | 0.01426 | 0.1759 | 0.11872 | 0.14894 | 0.096 |
| rs3015531 | Imputed | T | DOM | 438 | 1.754 | 0.2318 | 1.113 | 2.762 | 2.423 | 0.01539 | 0.1759 | 0.11872 | 0.14894 | 0.096 |
| rs3015535 | Imputed | C | ADD | 438 | 1.725 | 0.2225 | 1.115 | 2.668 | 2.451 | 0.01426 | 0.1759 | 0.11872 | 0.14894 | 0.096 |
| rs3015535 | Imputed | C | DOM | 438 | 1.754 | 0.2318 | 1.113 | 2.762 | 2.423 | 0.01539 | 0.1759 | 0.11872 | 0.14894 | 0.096 |
| rs3019407 | Imputed | A | GEN | 439 | | | | | 0.7217 | 0.6971 | 1 | 0.33941 | 0.35185 | 0.33 |
| rs3019407 | Genotyped | C | REC | 443 | 1.025 | 0.306 | 0.5627 | 1.867 | 0.08058 | 0.9358 | 0.5846 | 0.31828 | 0.31414 | 0.32143 |
| rs36011725 | Imputed | G | DOM | 443 | 1.954 | 0.2168 | 1.277 | 2.988 | 0.6419 | 0.7255 | 0.9193 | 0.41063 | 0.45355 | 0.37662 |
| rs373983 | Imputed | C | DOM | 414 | 0.5162 | 0.2209 | 0.3348 | 0.7959 | 3.089 | 0.00201 | 1 | 0.17668 | 0.13736 | 0.20726 |
| rs37561554 | Imputed | C | ADD | 416 | 1.091 | 0.2583 | 0.6574 | 1.81 | −2.993 | 0.00276 | 0.279 | 0.07336 | 0.07592 | 0.07143 |
| rs3793044 | Imputed | C | DOM | 443 | 1.162 | 0.2804 | 0.6707 | 2.013 | 0.3362 | 0.7367 | 0.279 | 0.07336 | 0.07592 | 0.07143 |
| rs3793044 | Imputed | C | ADD | 443 | 0.995 | 0.236 | 0.6266 | 1.58 | 0.5355 | 0.5923 | 0.06405 | 0.0883 | 0.07592 | 0.08871 |
| rs3793053 | Imputed | C | DOM | 436 | 0.9919 | 0.2675 | 0.5872 | 1.676 | −0.02103 | 0.9832 | 0.06405 | 0.0883 | 0.0877 | 0.08871 |
| rs3796246 | Imputed | G | ADD | 442 | 0.9554 | 0.2625 | 0.5711 | 1.598 | −0.1737 | 0.8621 | 0.5013 | 0.07805 | 0.07592 | 0.07968 |
| rs3796246 | Imputed | G | DOM | 442 | 0.9829 | 0.2682 | 0.5811 | 1.663 | −0.06425 | 0.9488 | 0.5013 | 0.07805 | 0.07592 | 0.07968 |
| rs3805996 | Imputed | G | ADD | 421 | 1.042 | 0.2655 | 0.6195 | 1.754 | 0.1561 | 0.876 | 0.2844 | 0.07601 | 0.07692 | 0.07531 |
| rs3805996 | Imputed | G | DOM | 421 | 1.106 | 0.2862 | 0.631 | 1.938 | 0.3512 | 0.7254 | 0.2844 | 0.07601 | 0.07692 | 0.07531 |
| rs3806003 | Imputed | A | ADD | 443 | 1.091 | 0.2583 | 0.6574 | 1.81 | 0.3362 | 0.7367 | 0.279 | 0.07336 | 0.07592 | 0.07143 |
| rs3806003 | Imputed | A | DOM | 443 | 1.162 | 0.2804 | 0.6707 | 2.013 | 0.5355 | 0.5923 | 0.279 | 0.07336 | 0.07592 | 0.07143 |
| rs3806004 | Imputed | T | ADD | 442 | 0.9899 | 0.2312 | 0.6292 | 1.557 | −0.04381 | 0.9651 | 0.0729 | 0.0905 | 0.08947 | 0.09127 |
| rs3806004 | Imputed | T | DOM | 442 | 0.9899 | 0.2312 | 0.6292 | 1.557 | −0.04381 | 0.9651 | 0.0729 | 0.0905 | 0.08947 | 0.09127 |
| rs3806010 | Imputed | T | ADD | 442 | 0.982 | 0.2619 | 0.5877 | 1.641 | −0.06944 | 0.9446 | 0.0729 | 0.08947 | 0.08947 | 0.09127 |
| rs3806010 | Imputed | T | DOM | 442 | 0.9899 | 0.2619 | 0.5877 | 1.658 | −0.04381 | 0.9651 | 0.0729 | 0.0905 | 0.08947 | 0.09127 |
| rs3806014 | Imputed | T | ADD | 430 | 1.014 | 0.234 | 0.6412 | 1.605 | 0.06078 | 0.9515 | 0.06876 | 0.0907 | 0.09016 | 0.09109 |
| rs3806014 | Imputed | T | DOM | 430 | 1.002 | 0.2658 | 0.5954 | 1.688 | 0.008889 | 0.9929 | 0.06876 | 0.0907 | 0.09016 | 0.09109 |
| rs3806015 | Imputed | A | ADD | 426 | 0.9945 | 0.2345 | 0.634 | 1.589 | 0.01643 | 0.9869 | 0.07007 | 0.09155 | 0.09066 | 0.09221 |
| rs3806015 | Imputed | A | DOM | 426 | 0.9899 | 0.2663 | 0.5902 | 1.676 | −0.02059 | 0.9836 | 0.07007 | 0.09155 | 0.09066 | 0.09221 |
| rs3806018 | Imputed | A | ADD | 442 | 0.982 | 0.2312 | 0.6292 | 1.557 | −0.04381 | 0.9651 | 0.0729 | 0.0905 | 0.08947 | 0.09127 |
| rs3806018 | Imputed | A | DOM | 442 | 0.982 | 0.2619 | 0.5877 | 1.641 | −0.06944 | 0.9446 | 0.0729 | 0.0905 | 0.08947 | 0.09127 |

TABLE 11-continued

| | | | | | | | | | | | | |
|---|---|---|---|---|---|---|---|---|---|---|---|---|
| rs3806019 | Imputed | A | ADD | 438 | 0.974 | 0.2319 | 0.6182 | 1.534 | -0.1137 | 0.9095 | 0.09132 | 0.08995 | 0.09237 |
| rs3806019 | Imputed | A | DOM | 438 | 0.9676 | 0.2625 | 0.5784 | 1.619 | -0.1255 | 0.9001 | 0.09132 | 0.08995 | 0.09237 |
| rs3806024 | Imputed | T | ADD | 442 | 1.029 | 0.2268 | 0.6599 | 1.605 | 0.1274 | 0.8986 | 0.09276 | 0.09424 | 0.09163 |
| rs3806024 | Imputed | T | DOM | 442 | 1.001 | 0.2605 | 0.601 | 1.669 | 0.005209 | 0.9958 | 0.09276 | 0.09424 | 0.09163 |
| rs3847825 | Imputed | G | ADD | 440 | 0.7616 | 0.1432 | 0.5752 | 1.008 | -1.901 | 0.05729 | 0.38523 | 0.34737 | 0.414 |
| rs3847825 | Genotyped | C | GEN | 440 | | | | | 6.939 | 0.03113 | 0.38523 | 0.34737 | 0.414 |
| rs3852001 | Genotyped | C | GEN | 443 | | | | | 0.9298 | 0.6282 | 0.18172 | 0.19634 | 0.17063 |
| rs3852001 | Imputed | G | REC | 443 | 1.348 | 0.5124 | 0.4937 | 3.68 | 0.5827 | 0.5601 | 0.18172 | 0.19634 | 0.17063 |
| rs3852002 | Imputed | G | GEN | 443 | | | | | 1.248 | 0.5357 | 0.17946 | 0.19634 | 0.16667 |
| rs3852002 | Imputed | A | REC | 443 | 1.348 | 0.5124 | 0.4937 | 3.68 | 0.5827 | 0.5601 | 0.17946 | 0.19634 | 0.16667 |
| rs3852003 | Imputed | A | GEN | 442 | | | | | 1.289 | 0.525 | 0.17986 | 0.19737 | 0.16667 |
| rs3852003 | Imputed | A | REC | 442 | 1.351 | 0.5124 | 0.4947 | 3.687 | 0.5864 | 0.5576 | 0.17986 | 0.19737 | 0.16667 |
| rs3942254 | Imputed | T | DOM | 420 | 0.6591 | 0.2081 | 0.4383 | 0.991 | -2.004 | 0.04512 | 0.39167 | 0.35593 | 0.41942 |
| rs3945085 | Imputed | A | DOM | 441 | 1.324 | 0.1969 | 0.9003 | 1.948 | 1.427 | 0.1537 | 0.34014 | 0.37435 | 0.314 |
| rs399485 | Imputed | A | DOM | 437 | 1.648 | 0.1968 | 1.12 | 2.423 | 2.538 | 0.01116 | 0.25973 | 0.29211 | 0.23482 |
| rs4029119 | Imputed | G | ADD | 443 | 0.9741 | 0.2886 | 0.5532 | 1.715 | -0.09096 | 0.9275 | 0.07336 | 0.0733 | 0.07341 |
| rs4029119 | Imputed | G | DOM | 443 | 1.136 | 0.3415 | 0.5817 | 2.218 | 0.3732 | 0.709 | 0.07336 | 0.0733 | 0.07341 |
| rs412791 | Imputed | C | GEN | 432 | | | | | 0.1413 | 0.9318 | 0.33565 | 0.33957 | 0.33265 |
| rs4146972 | Imputed | T | DOM | 443 | 1.832 | 0.2123 | 1.208 | 2.777 | 2.851 | 0.00436 | 0.17043 | 0.20942 | 0.14087 |
| rs4259369 | Genotyped | C | REC | 440 | 0.659 | 0.2526 | 0.4017 | 1.081 | -1.651 | 0.09871 | 0.42727 | 0.39005 | 0.45582 |
| rs4273613 | Imputed | T | ADD | 443 | 0.9741 | 0.2886 | 0.5532 | 1.715 | -0.09096 | 0.9275 | 0.07336 | 0.0733 | 0.07341 |
| rs4273613 | Imputed | T | DOM | 443 | 1.136 | 0.3415 | 0.5817 | 2.218 | 0.3732 | 0.709 | 0.07336 | 0.0733 | 0.07341 |
| rs4294022 | Imputed | C | DOM | 441 | 1.051 | 0.1977 | 0.7133 | 1.548 | 0.251 | 0.8018 | 0.2483 | 0.25132 | 0.24603 |
| rs4310554 | Genotyped | C | ADD | 443 | 1.561 | 0.2379 | 0.9794 | 2.489 | 1.872 | 0.06115 | 0.52032 | 0.55497 | 0.49405 |
| rs4315598 | Imputed | T | ADD | 443 | 1.389 | 0.1433 | 1.049 | 1.839 | 2.291 | 0.02197 | 0.34424 | 0.38743 | 0.31151 |
| rs4315598 | Imputed | T | GEN | 443 | | | | | 6.692 | 0.03523 | 0.34424 | 0.38743 | 0.31151 |
| rs4370878 | Imputed | G | DOM | 440 | 1.312 | 0.1971 | 0.8916 | 1.931 | 1.378 | 0.1682 | 0.33523 | 0.36842 | 0.31 |
| rs4436200 | Imputed | G | ADD | 442 | 0.543 | 0.2248 | 0.3494 | 0.8436 | -2.716 | 0.0066 | 0.13575 | 0.10209 | 0.16135 |
| rs4444612 | Imputed | G | ADD | 443 | 1.389 | 0.1433 | 1.049 | 1.839 | 2.291 | 0.02197 | 0.34424 | 0.38743 | 0.31151 |
| rs4444612 | Imputed | G | GEN | 443 | | | | | 6.692 | 0.03523 | 0.34424 | 0.38743 | 0.31151 |
| rs4450660 | Imputed | C | DOM | 438 | 1.275 | 0.1965 | 0.8675 | 1.874 | 1.236 | 0.2163 | 0.25457 | 0.26316 | 0.24798 |
| rs4463950 | Imputed | C | DOM | 438 | 0.7997 | 0.211 | 0.5288 | 1.209 | -1.06 | 0.2893 | 0.46347 | 0.44415 | 0.478 |
| rs4509702 | Imputed | C | DOM | 440 | 1.312 | 0.1971 | 0.8916 | 1.931 | 1.378 | 0.1682 | 0.33523 | 0.36842 | 0.31 |
| rs4533379 | Imputed | A | ADD | 441 | 1.075 | 0.1633 | 0.7809 | 1.481 | 0.4457 | 0.6558 | 0.23243 | 0.23947 | 0.22709 |
| rs4569984 | Imputed | G | REC | 426 | 1.031 | 0.2026 | 0.6932 | 1.534 | 0.1516 | 0.8795 | 0.23357 | 0.22973 | 0.23651 |
| rs4570530 | Imputed | A | ADD | 440 | 1.312 | 0.1971 | 0.8916 | 1.931 | 1.378 | 0.1682 | 0.33523 | 0.36842 | 0.31 |
| rs4571583 | Imputed | C | DOM | 439 | 1.001 | 0.1996 | 0.6767 | 1.48 | 0.002892 | 0.9977 | 0.22665 | 0.22222 | 0.23 |
| rs4586678 | Imputed | T | DOM | 442 | 1.235 | 0.1959 | 0.8415 | 1.813 | 1.079 | 0.2807 | 0.25679 | 0.26316 | 0.25198 |
| rs4615971 | Imputed | A | DOM | 440 | 1.347 | 0.1965 | 0.9164 | 1.98 | 1.516 | 0.1296 | 0.33182 | 0.36579 | 0.306 |
| rs4629229 | Imputed | G | DOM | 443 | 1.138 | 0.2135 | 0.7487 | 1.729 | 0.6045 | 0.5455 | 0.16817 | 0.17801 | 0.16071 |
| rs4632512 | Imputed | T | GEN | 443 | | | | | 1.248 | 0.5357 | 0.17946 | 0.19634 | 0.16667 |
| rs4641552 | Imputed | A | ADD | 437 | 0.6214 | 0.279 | 0.3596 | 1.074 | -1.705 | 0.08817 | 0.07323 | 0.05585 | 0.08635 |
| rs4682527 | Imputed | C | DOM | 209 | 2.955 | 1.237 | 0.2613 | 33.41 | 0.8755 | 0.3813 | 0.00718 | 0.01111 | 0.0042 |
| rs4688632 | Imputed | G | REC | 429 | 0.6822 | 0.2335 | 0.4316 | 1.078 | -1.638 | 0.1014 | 0.45338 | 0.41892 | 0.47951 |
| rs4702720 | Imputed | A | ADD | 359 | 0.757 | 0.1808 | 0.5311 | 1.079 | -1.54 | 0.1236 | 0.24652 | 0.21935 | 0.26716 |
| rs4702720 | Imputed | A | DOM | 359 | 0.6462 | 0.2205 | 0.4194 | 0.9956 | -1.98 | 0.04769 | 0.24652 | 0.21935 | 0.26716 |
| rs4714484 | Imputed | A | DOM | 439 | 0.8396 | 0.1992 | 0.5682 | 1.241 | -0.8775 | 0.3802 | 0.15718 | 0.1455 | 0.166 |
| rs4714484 | Imputed | A | DOM | 439 | 0.8278 | 0.2185 | 0.5394 | 1.27 | -0.8651 | 0.387 | 0.15718 | 0.1455 | 0.166 |
| rs4725142 | Genotyped | G | REC | 443 | 1.186 | 0.2801 | 0.6847 | 2.053 | 0.6082 | 0.5431 | 0.34537 | 0.35864 | 0.33532 |
| rs4725144 | Imputed | G | REC | 438 | 1.136 | 0.2871 | 0.647 | 1.994 | 0.4432 | 0.6576 | 0.33904 | 0.3484 | 0.332 |
| rs4760785 | Imputed | A | ADD | 432 | 0.7026 | 0.2117 | 0.464 | 1.064 | -1.667 | 0.09546 | 0.4537 | 0.40541 | 0.48988 |
| rs4760785 | Imputed | A | DOM | 432 | 0.7137 | 0.1396 | 0.5429 | 0.9384 | -2.415 | 0.01572 | 0.4537 | 0.40541 | 0.48988 |
| rs4760894 | Imputed | T | ADD | 432 | 0.7137 | 0.1396 | 0.5429 | 0.9384 | -2.415 | 0.01572 | 0.4537 | 0.40541 | 0.48988 |

TABLE 11-continued

| | | | | | | | | | | | |
|---|---|---|---|---|---|---|---|---|---|---|---|
| rs4760894 | Imputed | T | DOM | 432 | 0.7026 | 0.2117 | 0.464 | 1.064 | -1.667 | 0.09546 | 0.438 | 0.4537 | 0.40541 | 0.48988 |
| rs4760895 | Imputed | A | ADD | 432 | 0.7137 | 0.1396 | 0.5429 | 0.9384 | -2.415 | 0.01572 | 0.438 | 0.4537 | 0.40541 | 0.48988 |
| rs4760895 | Imputed | A | DOM | 432 | 0.7026 | 0.2117 | 0.464 | 1.064 | -1.667 | 0.09546 | 0.438 | 0.4537 | 0.40541 | 0.48988 |
| rs4767184 | Imputed | C | ADD | 425 | 0.7759 | 0.1466 | 0.5822 | 1.034 | -1.732 | 0.08334 | 0.8408 | 0.40353 | 0.3674 | 0.43033 |
| rs4767184 | Imputed | C | GEN | 425 | | | | | 8.173 | 0.0168 | 0.8408 | 0.40353 | 0.3674 | 0.43033 |
| rs4773487 | Imputed | T | ADD | 436 | 1.73 | 0.2227 | 1.118 | 2.676 | 2.461 | 0.01385 | 0.1754 | 0.11927 | 0.14973 | 0.09639 |
| rs4780547 | Imputed | G | GEN | 442 | | | | | 7.627 | 0.02207 | 0.3901 | 0.26244 | 0.22775 | 0.28884 |
| rs4780547 | Imputed | G | REC | 442 | 0.2881 | 0.4519 | 0.1188 | 0.6985 | -2.754 | 0.00588 | 0.3901 | 0.26244 | 0.22775 | 0.28884 |
| rs483159 | Imputed | T | DOM | 386 | 1.953 | 0.219 | 1.271 | 2.999 | 3.056 | 0.00225 | 0.3957 | 0.18264 | 0.22561 | 0.1509 |
| rs4836502 | Imputed | T | DOM | 443 | 0.5934 | 0.2016 | 0.3997 | 0.881 | -2.589 | 0.00964 | 0.1134 | 0.34312 | 0.31152 | 0.36706 |
| rs4836507 | Imputed | C | DOM | 442 | 0.5803 | 0.2019 | 0.3906 | 0.862 | -2.696 | 0.00703 | 0.09482 | 0.34955 | 0.31414 | 0.37649 |
| rs4851531 | Imputed | T | DOM | 442 | 0.6071 | 0.2055 | 0.4058 | 0.9082 | -2.428 | 0.01517 | 0.2107 | 0.44231 | 0.40052 | 0.4741 |
| rs4879931 | Imputed | G | ADD | 438 | 0.7451 | 0.1533 | 0.5517 | 1.006 | -1.92 | 0.05489 | 0.5791 | 0.31279 | 0.28042 | 0.33735 |
| rs489441 | Imputed | G | DOM | 409 | 1.224 | 0.1644 | 0.8866 | 1.689 | 1.228 | 0.2195 | 0.6152 | 0.26773 | 0.28736 | 0.25319 |
| rs489441 | Imputed | G | ADD | 409 | 1.384 | 0.2043 | 0.9276 | 2.066 | 1.592 | 0.1114 | 0.6152 | 0.26773 | 0.28736 | 0.25319 |
| rs4976276 | Imputed | T | ADD | 440 | 0.9836 | 0.1502 | 0.7328 | 1.32 | -0.1103 | 0.9121 | 0.5816 | 0.31591 | 0.31316 | 0.318 |
| rs4977681 | Imputed | C | REC | 441 | 0.9851 | 0.323 | 0.523 | 1.856 | -0.04633 | 0.9631 | 0.7396 | 0.31293 | 0.30105 | 0.322 |
| rs4986197 | Imputed | G | ADD | 440 | 1.083 | 0.1634 | 0.7863 | 1.492 | 0.4891 | 0.6248 | 0.7887 | 0.23182 | 0.23947 | 0.226 |
| rs4986220 | Imputed | T | ADD | 442 | 1.075 | 0.1653 | 0.7775 | 1.486 | 0.4371 | 0.6621 | 1 | 0.21946 | 0.22632 | 0.21429 |
| rs525462 | Imputed | A | GEN | 440 | | | | | 8.36 | 0.0153 | 0.4957 | 0.57045 | 0.53704 | 0.59562 |
| rs552006 | Imputed | G | GEN | 443 | | | | | 0.4432 | 0.8012 | 0.8062 | 0.26298 | 0.26178 | 0.26389 |
| rs5756669 | Imputed | C | DOM | 443 | 1.061 | 0.217 | 0.6932 | 1.623 | 0.2716 | 0.7859 | 0.08691 | 0.48646 | 0.50262 | 0.47421 |
| rs581905 | Imputed | T | DOM | 442 | 2.177 | 0.2555 | 1.32 | 3.593 | 3.045 | 0.00232 | 1 | 0.09955 | 0.13089 | 0.0757 |
| rs6033138 | Imputed | C | ADD | 443 | 1.389 | 0.1433 | 1.049 | 1.839 | 2.291 | 0.02197 | 0.2479 | 0.34424 | 0.38743 | 0.31151 |
| rs6033138 | Imputed | C | GEN | 443 | | | | | 6.692 | 0.03523 | 0.2479 | 0.34424 | 0.38743 | 0.31151 |
| rs6040619 | Imputed | C | ADD | 439 | 1.429 | 0.1436 | 1.079 | 1.894 | 2.487 | 0.01287 | 0.3441 | 0.34852 | 0.39628 | 0.31275 |
| rs6040619 | Imputed | C | GEN | 439 | | | | | 7.276 | 0.02631 | 0.3441 | 0.34852 | 0.39628 | 0.31275 |
| rs6040625 | Imputed | T | ADD | 442 | 1.414 | 0.1431 | 1.068 | 1.871 | 2.419 | 0.01557 | 0.3449 | 0.34729 | 0.39267 | 0.31275 |
| rs6040625 | Imputed | T | GEN | 442 | | | | | 6.967 | 0.0307 | 0.3449 | 0.34729 | 0.39267 | 0.31275 |
| rs6040630 | Imputed | A | ADD | 441 | 1.401 | 0.1436 | 1.058 | 1.857 | 2.349 | 0.01881 | 0.2464 | 0.34467 | 0.38947 | 0.31076 |
| rs6040630 | Imputed | A | GEN | 441 | | | | | 6.767 | 0.03392 | 0.2464 | 0.34467 | 0.38947 | 0.31076 |
| rs6040633 | Imputed | A | ADD | 442 | 1.391 | 0.1433 | 1.05 | 1.842 | 2.302 | 0.02133 | 0.2489 | 0.34502 | 0.38947 | 0.31151 |
| rs6040633 | Imputed | A | GEN | 442 | | | | | 6.683 | 0.03539 | 0.2489 | 0.34502 | 0.38947 | 0.31151 |
| rs6040634 | Imputed | A | ADD | 441 | 1.404 | 0.1433 | 1.06 | 1.859 | 2.368 | 0.01791 | 0.295 | 0.34694 | 0.39211 | 0.31275 |
| rs6040634 | Imputed | A | GEN | 441 | | | | | 6.855 | 0.03246 | 0.295 | 0.34694 | 0.39211 | 0.31275 |
| rs6040636 | Imputed | T | ADD | 443 | 1.371 | 0.1435 | 1.034 | 1.816 | 2.196 | 0.0281 | 0.2458 | 0.34312 | 0.38482 | 0.31151 |
| rs6040638 | Imputed | C | ADD | 443 | 1.389 | 0.1433 | 1.049 | 1.839 | 2.291 | 0.03821 | 0.2479 | 0.34424 | 0.38743 | 0.31151 |
| rs6040638 | Imputed | C | GEN | 443 | | | | | 6.529 | 0.02197 | 0.2479 | 0.34424 | 0.38743 | 0.31151 |
| rs6040644 | Imputed | A | ADD | 443 | 1.389 | 0.1433 | 1.049 | 1.839 | 2.291 | 0.03523 | 0.2479 | 0.34424 | 0.38743 | 0.31151 |
| rs6040644 | Imputed | A | GEN | 443 | | | | | 6.692 | 0.02197 | 0.2479 | 0.34424 | 0.38743 | 0.31151 |
| rs6040667 | Imputed | T | ADD | 424 | 1.422 | 0.1447 | 1.071 | 1.888 | 2.432 | 0.01502 | 0.3997 | 0.35731 | 0.40385 | 0.32231 |
| rs6040667 | Imputed | T | GEN | 424 | | | | | 7.201 | 0.02731 | 0.3997 | 0.35731 | 0.40385 | 0.32231 |
| rs6040668 | Imputed | C | ADD | 440 | 1.398 | 0.1448 | 1.053 | 1.857 | 2.314 | 0.02064 | 0.5278 | 0.34659 | 0.38947 | 0.314 |
| rs6040668 | Imputed | C | GEN | 440 | | | | | 6.796 | 0.03345 | 0.5278 | 0.34659 | 0.38947 | 0.314 |
| rs6053005 | Imputed | C | DOM | 275 | 0.4506 | 0.309 | 0.2459 | 0.8257 | -2.58 | 0.00989 | 0.0865 | 0.56909 | 0.53361 | 0.59615 |
| rs6054405 | Imputed | G | REC | 443 | 0.9755 | 0.2643 | 0.5811 | 1.638 | -0.09385 | 0.9252 | 0.108 | 0.38036 | 0.37696 | 0.38294 |
| rs6054427 | Genotyped | G | DOM | 443 | 1.138 | 0.2135 | 0.7487 | 1.729 | 0.8477 | 0.6545 | 0.1259 | 0.36907 | 0.35602 | 0.37897 |
| rs6075186 | Imputed | A | ADD | 351 | 1.166 | 0.1563 | 0.8582 | 1.584 | 0.6045 | 0.5455 | 0.2352 | 0.16817 | 0.17801 | 0.16071 |
| rs608278 | Imputed | G | DOM | 380 | 0.9692 | 0.145 | 0.7295 | 1.288 | 0.9815 | 0.3263 | 0.7448 | 0.43305 | 0.45364 | 0.4175 |
| rs6111540 | Imputed | A | ADD | 424 | 1.493 | 0.1554 | 1.101 | 2.025 | -0.2155 | 0.8294 | 0.1209 | 0.45921 | 0.45181 | 0.46495 |
| rs6131206 | Imputed | C | ADD | 440 | 1.387 | 0.1445 | 1.045 | 1.841 | 2.581 | 0.00986 | 0.2791 | 0.28066 | 0.3288 | 0.24375 |
| rs6131208 | Imputed | T | ADD | 440 | | | | | 2.263 | 0.02364 | 0.2909 | 0.34091 | 0.3836 | 0.30876 |

TABLE 11-continued

| | | | | | | | | | | | |
|---|---|---|---|---|---|---|---|---|---|---|---|
| rs6131208 | Imputed | T | GEN | 440 | | | | | 6.748 | 0.03426 | 0.2909 | 0.34091 | 0.3836 | 0.30876 |
| rs6131919 | Imputed | G | DOM | 443 | 1.138 | 0.2135 | 0.7487 | 1.729 | 0.6045 | 0.5455 | 0.2352 | 0.16817 | 0.17801 | 0.16071 |
| rs6134243 | Imputed | C | ADD | 443 | 1.389 | 0.1433 | 1.049 | 1.839 | 2.291 | 0.02197 | 0.2479 | 0.34424 | 0.38743 | 0.31151 |
| rs6134243 | Imputed | C | GEN | 443 | | | | | 6.692 | 0.03523 | 0.2479 | 0.34424 | 0.38743 | 0.31151 |
| rs6136020 | Imputed | A | DOM | 441 | 1.061 | 0.2134 | 0.6982 | 1.612 | 0.2765 | 0.7822 | 0.1646 | 0.1644 | 0.17016 | 0.16 |
| rs613799 | Imputed | G | DOM | 420 | 1.391 | 0.2013 | 0.9378 | 2.065 | 1.641 | 0.1008 | 0.1798 | 0.32262 | 0.35912 | 0.29998 |
| rs644041 | Imputed | G | ADD | 402 | 1.202 | 0.1659 | 0.8685 | 1.664 | 1.111 | 0.2667 | 0.6136 | 0.27114 | 0.28947 | 0.25758 |
| rs644041 | Imputed | G | DOM | 402 | 1.351 | 0.2068 | 0.9007 | 2.026 | 1.454 | 0.1459 | 0.6136 | 0.27114 | 0.28947 | 0.25758 |
| rs6464377 | Imputed | C | DOM | 443 | 1.043 | 0.2788 | 0.6037 | 1.801 | 0.1498 | 0.8809 | 0.4889 | 0.07223 | 0.07068 | 0.07341 |
| rs6474230 | Imputed | T | DOM | 443 | 1.32 | 0.1941 | 0.9026 | 1.931 | 1.432 | 0.1521 | 0.6236 | 0.26298 | 0.27487 | 0.25397 |
| rs6476565 | Imputed | A | DOM | 442 | 1.184 | 0.2298 | 0.7118 | 1.97 | 0.6512 | 0.5149 | 0.7613 | 0.0871 | 0.09474 | 0.08135 |
| rs6511286 | Imputed | T | ADD | 442 | 1.099 | 0.1394 | 0.8364 | 1.444 | 0.6778 | 0.4979 | 0.1082 | 0.33371 | 0.34737 | 0.32341 |
| rs6541829 | Genotyped | C | REC | 443 | 2.003 | 0.3363 | 1.036 | 3.873 | 2.066 | 0.03883 | 0.1994 | 0.2833 | 0.2801 | 0.28571 |
| rs6544721 | Imputed | G | DOM | 436 | 1.236 | 0.1963 | 0.8409 | 1.815 | 1.077 | 0.2814 | 0.454 | 0.25803 | 0.26455 | 0.25304 |
| rs6544728 | Imputed | T | DOM | 439 | 1.333 | 0.197 | 0.9058 | 1.961 | 1.458 | 0.1448 | 0.7087 | 0.25854 | 0.26862 | 0.251 |
| rs6665910 | Imputed | G | DOM | 433 | 1.047 | 0.1973 | 0.7112 | 1.541 | 0.2331 | 0.8157 | 0.7258 | 0.28753 | 0.29144 | 0.28455 |
| rs6581985 | Imputed | G | GEN | 408 | | | | | 7.356 | 0.02528 | 0.3553 | 0.31127 | 0.35714 | 0.27682 |
| rs6581985 | Imputed | G | REC | 408 | 2.451 | 0.3667 | 1.195 | 5.028 | 2.445 | 0.01449 | 0.3553 | 0.31127 | 0.35714 | 0.27682 |
| rs6685186 | Imputed | T | ADD | 426 | 1.015 | 0.1482 | 0.7591 | 1.357 | 0.1003 | 0.9201 | 0.3984 | 0.35329 | 0.35519 | 0.35185 |
| rs6685186 | Imputed | T | GEN | 426 | | | | | 0.5003 | 0.7787 | 0.3984 | 0.35329 | 0.35519 | 0.35185 |
| rs670593 | Imputed | A | REC | 442 | 0.3987 | 0.3133 | 0.2158 | 0.7367 | -2.935 | 0.00333 | 0.7665 | 0.40045 | 0.38158 | 0.41468 |
| rs6722640 | Imputed | T | DOM | 441 | 0.5987 | 0.207 | 0.399 | 0.8983 | -2.478 | 0.01322 | 0.2486 | 0.44671 | 0.40576 | 0.478 |
| rs6746170 | Imputed | A | DOM | 442 | 1.346 | 0.196 | 0.9168 | 1.977 | 1.517 | 0.1293 | 0.8072 | 0.26471 | 0.27749 | 0.25498 |
| rs6757316 | Imputed | A | GEN | 431 | | | | | 3.593 | 0.1659 | 0.01072 | 0.43155 | 0.45946 | 0.41057 |
| rs6805139 | Imputed | G | DOM | 442 | 1.417 | 0.2237 | 0.9138 | 2.197 | 1.557 | 0.1194 | 0.00028 | 0.52941 | 0.56283 | 0.50398 |
| rs6808571 | Imputed | G | ADD | 440 | 1.138 | 0.1981 | 0.7719 | 1.678 | 0.6528 | 0.5139 | 1 | 0.14091 | 0.15 | 0.134 |
| rs6816479 | Imputed | A | REC | 430 | 0.7905 | 0.293 | 0.4452 | 1.404 | -0.8024 | 0.4223 | 0.3984 | 0.35349 | 0.37247 | 0.32787 |
| rs6865976 | Imputed | C | DOM | 401 | 1.085 | 0.2308 | 0.69 | 1.705 | 0.352 | 0.7249 | 0.2704 | 0.47382 | 0.48276 | 0.46696 |
| rs687047 | Imputed | C | ADD | 443 | 0.5642 | 0.2311 | 0.3587 | 0.8876 | -2.476 | 0.01329 | 0.8186 | 0.11512 | 0.08377 | 0.13889 |
| rs6871041 | Imputed | C | DOM | 418 | 0.6503 | 0.2006 | 0.4389 | 0.9635 | -2.145 | 0.03192 | 0.6303 | 0.2823 | 0.25824 | 0.30085 |
| rs688358 | Imputed | A | DOM | 427 | 0.5756 | 0.2319 | 0.3653 | 0.9068 | -2.382 | 0.01723 | 0.8183 | 0.1171 | 0.08602 | 0.14108 |
| rs6908481 | Imputed | T | REC | 400 | 1.391 | 0.2704 | 0.8186 | 2.363 | 1.22 | 0.2226 | 0.7579 | 0.41875 | 0.43275 | 0.4083 |
| rs6917224 | Imputed | A | ADD | 441 | 0.959 | 0.1367 | 0.7336 | 1.254 | -0.3058 | 0.7597 | 0.1287 | 0.37642 | 0.37105 | 0.38048 |
| rs6917224 | Imputed | A | GEN | 441 | | | | | 2.699 | 0.2593 | 0.1287 | 0.37642 | 0.37105 | 0.38048 |
| rs6920677 | Imputed | C | DOM | 438 | 0.9579 | 0.2018 | 0.645 | 1.422 | -0.2133 | 0.8311 | 0.6893 | 0.37831 | 0.39384 | 0.40562 |
| rs6994498 | Imputed | G | DOM | 443 | 1.32 | 0.1941 | 0.9026 | 1.931 | 1.432 | 0.1521 | 0.6236 | 0.26298 | 0.27487 | 0.25397 |
| rs6998772 | Imputed | G | DOM | 442 | 1.182 | 0.3637 | 0.5795 | 2.411 | 0.4595 | 0.6459 | 1 | 0.04299 | 0.04712 | 0.03984 |
| rs7022281 | Imputed | T | ADD | 441 | 0.6915 | 0.1481 | 0.5172 | 0.9244 | -2.491 | 0.01275 | 0.548 | 0.38776 | 0.34392 | 0.42063 |
| rs7022281 | Imputed | C | DOM | 441 | | | | | 9.434 | 0.00894 | 0.548 | 0.38776 | 0.34392 | 0.42063 |
| rs7022281 | Imputed | C | REC | 441 | 0.386 | 0.3115 | 0.2096 | 0.7108 | -3.056 | 0.00224 | 0.5344 | 0.38776 | 0.34392 | 0.42063 |
| rs7043983 | Imputed | C | DOM | 438 | 1.147 | 0.2639 | 0.6835 | 1.923 | 0.5181 | 0.6044 | 0.1663 | 0.08447 | 0.09043 | 0.08 |
| rs7077799 | Imputed | A | DOM | 442 | 1.347 | 0.1964 | 0.9168 | 1.98 | 1.518 | 0.129 | 0.6185 | 0.33484 | 0.36911 | 0.30876 |
| rs7089947 | Imputed | G | ADD | 436 | 0.5704 | 0.339 | 0.2936 | 1.108 | -1.656 | 0.0977 | 0.3355 | 0.05161 | 0.03743 | 0.06225 |
| rs7089661 | Imputed | C | ADD | 442 | 1.347 | 0.1964 | 0.9168 | 1.98 | 1.518 | 0.129 | 1 | 0.33145 | 0.36649 | 0.30478 |
| rs7102072 | Imputed | A | DOM | 439 | 0.9567 | 0.1978 | 0.6492 | 1.41 | -0.224 | 0.8228 | 0.5412 | 0.26651 | 0.25926 | 0.272 |
| rs710832 | Genotyped | C | REC | 443 | 0.4518 | 0.4871 | 0.1739 | 1.174 | -1.631 | 0.1029 | 0.4404 | 0.24492 | 0.21466 | 0.26786 |
| rs712531 | Imputed | A | DOM | 275 | 2.784 | 1.233 | 1.2485 | 31.19 | -3.056 | 0.4063 | 1 | 0.00545 | 0.00833 | 0.00323 |
| rs7129817 | Imputed | T | ADD | 441 | 0.9401 | 0.1475 | 0.7041 | 1.255 | -0.4191 | 0.6751 | 0.4609 | 0.3424 | 0.33598 | 0.34722 |
| rs7134262 | Imputed | T | GEN | 438 | | | | | 5.456 | 0.06536 | 1 | 0.3379 | 0.37632 | 0.30847 |
| rs7134262 | Imputed | T | REC | 438 | 1.986 | 0.3091 | 1.084 | 3.641 | 2.22 | 0.02641 | 0.438 | 0.3379 | 0.37632 | 0.30847 |
| rs7138300 | Imputed | C | ADD | 432 | 0.7137 | 0.1396 | 0.5429 | 0.9384 | -2.415 | 0.01572 | 0.438 | 0.4537 | 0.40541 | 0.48988 |
| rs7138300 | Imputed | C | DOM | 432 | 0.7026 | 0.2117 | 0.464 | 1.064 | -1.667 | 0.09546 | 1 | 0.4537 | 0.40541 | 0.48988 |
| rs722927 | Imputed | G | ADD | 435 | 0.8492 | 0.2939 | 0.4774 | 1.511 | -0.5561 | 0.5782 | 1 | 0.06207 | 0.05645 | 0.06627 |

TABLE 11-continued

| | | | | | | | | | | | |
|---|---|---|---|---|---|---|---|---|---|---|---|
| rs722927 | Imputed | G | DOM | 435 | 0.874 | 0.3014 | 0.4842 | 1.578 | −0.4468 | 1 | 0.06207 | 0.05645 | 0.06627 |
| rs726424 | Genotyped | G | ADD | 443 | 0.7827 | 0.1433 | 0.5911 | 1.037 | −1.709 | 0.6906 | 0.38939 | 0.35602 | 0.41468 |
| rs726424 | Genotyped | G | GEN | 443 | | | | | 7.021 | 0.6906 | 0.38939 | 0.35602 | 0.41468 |
| rs7295817 | Imputed | C | ADD | 424 | 0.727 | 0.1447 | 0.5475 | 0.9655 | −2.203 | 1 | 0.42807 | 0.38187 | 0.46281 |
| rs7295817 | Imputed | C | GEN | 424 | | | | | 6.629 | 1 | 0.42807 | 0.38187 | 0.46281 |
| rs7297372 | Imputed | A | REC | 424 | 0.4929 | 0.2774 | 0.2862 | 0.849 | −2.55 | 1 | 0.55977 | 0.51862 | 0.59109 |
| rs7297372 | Imputed | A | ADD | 435 | 0.7305 | 0.1423 | 0.5526 | 0.9655 | −2.207 | 1 | 0.55977 | 0.51862 | 0.59109 |
| rs7297372 | Imputed | A | GEN | 435 | | | | | 4.87 | 1 | | | |
| rs7298255 | Imputed | A | ADD | 443 | 0.7433 | 0.1356 | 0.5699 | 0.9696 | −2.188 | 0.2143 | 0.46163 | 0.41885 | 0.49405 |
| rs7298255 | Imputed | A | DOM | 443 | 0.74 | 0.2089 | 0.4914 | 1.114 | −1.442 | 0.2143 | 0.46163 | 0.41885 | 0.49405 |
| rs7305832 | Imputed | C | GEN | 442 | | | | | 5.607 | 1 | 0.33597 | 0.37435 | 0.30677 |
| rs7305832 | Imputed | C | REC | 442 | 2.008 | 0.3089 | 1.096 | 3.678 | 2.256 | 0.06061 | 0.33597 | 0.37435 | 0.30677 |
| rs737542 | Imputed | A | REC | 425 | 2.077 | 0.347 | 1.052 | 4.1 | 2.107 | 0.02404 | 0.27765 | 0.27596 | 0.27893 |
| rs742827 | Imputed | A | ADD | 437 | 1.396 | 0.145 | 1.051 | 1.855 | 2.3 | 0.03514 | 0.34668 | 0.38947 | 0.31377 |
| rs742827 | Imputed | A | GEN | 437 | | | | | 6.499 | 0.02146 | 0.34668 | 0.38947 | 0.31377 |
| rs7446891 | Imputed | G | DOM | 443 | 0.5934 | 0.2016 | 0.3997 | 0.881 | −2.589 | 0.4608 | 0.34312 | 0.31152 | 0.36706 |
| rs7448641 | Imputed | C | ADD | 443 | 0.9741 | 0.2886 | 0.5532 | 1.715 | −0.09096 | 0.09879 | 0.00964 | 0.0733 | 0.07341 |
| rs7448641 | Imputed | C | DOM | 443 | 1.136 | 0.3415 | 0.5817 | 2.218 | 0.3732 | 0.9275 | 0.07336 | 0.0733 | 0.07341 |
| rs7460605 | Imputed | G | DOM | 412 | 1.481 | 0.222 | 0.9584 | 2.288 | 1.769 | 2.36E−05 | 0.07336 | 0.46369 | 0.40343 |
| rs7468898 | Imputed | T | ADD | 426 | 1.05 | 0.1419 | 0.795 | 1.386 | 0.3429 | 0.1313 | 0.42961 | 0.48077 | 0.46516 |
| rs7468898 | Imputed | T | GEN | 426 | | | | | 1.795 | 0.7694 | 0.47183 | 0.48077 | 0.46516 |
| rs7501186 | Imputed | A | DOM | 443 | 2.011 | 0.2218 | 1.302 | 3.107 | 3.15 | 0.6273 | 0.47183 | 0.17801 | 0.11905 |
| rs755117 | Imputed | A | REC | 418 | 0.7161 | 0.2216 | 0.4638 | 1.106 | −1.507 | 0.4471 | 0.14447 | 0.14641 | 0.18143 |
| rs7557560 | Imputed | T | GEN | 437 | | | | | 3.838 | 0.1319 | 0.16627 | 0.20213 | 0.21486 |
| rs7557560 | Imputed | T | REC | 437 | 1.621 | 0.4101 | 0.7258 | 3.622 | 1.179 | 0.14467 | 0.20938 | 0.20213 | 0.21486 |
| rs7562462 | Imputed | T | DOM | 436 | 0.6891 | 0.2101 | 0.4565 | 1.04 | −1.772 | 0.2386 | 0.43349 | 0.40576 | 0.4551 |
| rs757173 | Genotyped | G | DOM | 443 | 1.033 | 0.2035 | 0.6933 | 1.54 | 0.1606 | 0.07634 | 0.37359 | 0.3822 | 0.36706 |
| rs7607447 | Imputed | T | REC | 410 | 2.337 | 0.3138 | 1.264 | 4.323 | 2.706 | 0.8724 | 0.33049 | 0.37288 | 0.29828 |
| rs7639053 | Imputed | A | ADD | 443 | 1.02 | 0.1656 | 0.7375 | 1.411 | 0.1214 | 0.00681 | 0.21558 | 0.21728 | 0.21429 |
| rs7648163 | Imputed | C | REC | 421 | 0.941 | 0.3004 | 0.5223 | 1.695 | −0.2025 | 0.9034 | 0.32542 | 0.32222 | 0.3278 |
| rs7651273 | Imputed | A | GEN | 442 | | | | | 1.393 | 0.8396 | 0.17534 | 0.19211 | 0.1627 |
| rs7653190 | Imputed | C | ADD | 433 | 0.9859 | 0.1679 | 0.7095 | 1.37 | −0.0846 | 0.4984 | 0.21478 | 0.21351 | 0.21573 |
| rs7653685 | Genotyped | C | DOM | 443 | 0.8286 | 0.2404 | 0.5173 | 1.327 | −0.7821 | 0.9326 | 0.10722 | 0.09686 | 0.11508 |
| rs7684899 | Imputed | G | ADD | 417 | 0.5176 | 0.2237 | 0.3339 | 0.8024 | −2.944 | 0.4342 | 0.17266 | 0.13462 | 0.20213 |
| rs7701604 | Imputed | G | DOM | 443 | 0.9741 | 0.2886 | 0.5532 | 1.715 | −0.09096 | 0.8637 | 0.07336 | 0.0733 | 0.07341 |
| rs7701604 | Imputed | G | ADD | 443 | 1.136 | 0.3415 | 0.5817 | 2.218 | 0.3732 | 0.00324 | 0.07336 | 0.0733 | 0.07341 |
| rs7703676 | Imputed | C | DOM | 443 | 0.9741 | 0.2886 | 0.5532 | 1.715 | −0.09096 | 0.9275 | 0.07336 | 0.0733 | 0.07341 |
| rs7703676 | Imputed | C | ADD | 443 | 1.136 | 0.3415 | 0.5817 | 2.218 | 0.3732 | 0.709 | 0.07336 | 0.0733 | 0.07341 |
| rs7711358 | Imputed | A | GEN | 443 | 0.593 | 0.2016 | 0.3994 | 0.8804 | −2.592 | 0.09871 | 0.34312 | 0.3089 | 0.36905 |
| rs7713251 | Imputed | A | REC | 433 | 1.11 | 0.3089 | 0.6058 | 2.033 | 0.3374 | 0.00954 | 0.30485 | 0.29894 | 0.30943 |
| rs7337608 | Imputed | G | REC | 399 | 0.7496 | 0.2094 | 0.4973 | 1.13 | −1.376 | 0.7358 | 0.34712 | 0.32164 | 0.36623 |
| rs7755903 | Imputed | A | GEN | 426 | | | | | 0.886 | 0.1687 | 0.41197 | 0.41129 | 0.4125 |
| rs7762993 | Imputed | A | ADD | 431 | 1.066 | 0.1948 | 0.7276 | 1.561 | 0.3271 | 0.6421 | 0.18213 | 0.18548 | 0.17959 |
| rs7762993 | Imputed | A | DOM | 431 | 1.079 | 0.2057 | 0.7207 | 1.614 | 0.3676 | 0.7436 | 0.18213 | 0.18548 | 0.17959 |
| rs7767265 | Imputed | G | GEN | 430 | 1.155 | 0.1977 | 0.7839 | 1.702 | 0.7283 | 0.7132 | 0.24419 | 0.25936 | 0.23251 |
| rs7769415 | Imputed | C | GEN | 433 | | | | | 11.76 | 0.4664 | 0.34642 | 0.41176 | 0.29675 |
| rs7771264 | Imputed | T | DOM | 441 | 1.051 | 0.1977 | 0.7133 | 1.548 | 0.251 | 0.0028 | 0.2483 | 0.25132 | 0.24603 |
| rs7795792 | Imputed | T | REC | 440 | 0.659 | 0.2526 | 0.4017 | 1.081 | −1.651 | 0.8018 | 0.42727 | 0.39005 | 0.45582 |
| rs7806481 | Imputed | G | REC | 443 | 1.465 | 0.2335 | 0.9272 | 2.316 | 1.636 | 0.09871 | 0.47517 | 0.47906 | 0.47222 |
| rs7808536 | Imputed | G | DOM | 409 | 1.374 | 0.2138 | 0.904 | 2.09 | 1.488 | 0.1017 | 0.18582 | 0.2095 | 0.16739 |
| rs7814819 | Imputed | G | ADD | 250 | 2.296 | 0.3362 | 1.188 | 4.438 | 2.472 | 0.1368 | 0.088 | 0.12736 | 0.05903 |
| rs7814819 | Imputed | G | DOM | 250 | 2.549 | 0.3553 | 1.271 | 5.115 | 2.634 | 0.01342 | 0.088 | 0.12736 | 0.05903 |
| rs7815952 | Imputed | T | DOM | 442 | 1.182 | 0.3637 | 0.5795 | 2.411 | 0.4595 | 0.00844 | 0.04299 | 0.04712 | 0.03984 |
| | | | | | | | | | | 0.6459 | | | |

TABLE 11-continued

| | | | | | | | | | | | |
|---|---|---|---|---|---|---|---|---|---|---|---|
| rs7834090 | Imputed | T | DOM | 442 | 1.182 | 0.3637 | 0.5795 | 2.411 | 0.4595 | 1 | 0.04299 | 0.04712 | 0.03984 |
| rs7859250 | Imputed | C | DOM | 442 | 1.184 | 0.2598 | 0.7118 | 1.97 | 0.6512 | 0.7613 | 0.0871 | 0.09474 | 0.08135 |
| rs7863577 | Genotyped | A | ADD | 443 | 1.029 | 0.2235 | 0.6639 | 1.595 | 0.1275 | 0.01049 | 0.10835 | 0.10995 | 0.10714 |
| rs7863577 | Genotyped | A | DOM | 443 | 0.9475 | 0.2573 | 0.5723 | 1.569 | −0.2095 | 0.01049 | 0.10835 | 0.10995 | 0.10714 |
| rs7902140 | Imputed | C | ADD | 442 | 0.9423 | 0.1886 | 0.6511 | 1.364 | −0.3154 | 0.2408 | 0.16968 | 0.16492 | 0.17331 |
| rs7921834 | Imputed | C | DOM | 440 | 1.347 | 0.1965 | 0.9164 | 1.98 | 1.516 | 0.2375 | 0.33182 | 0.36579 | 0.306 |
| rs7939893 | Imputed | C | ADD | 441 | 0.6916 | 0.1478 | 0.5177 | 0.924 | −2.495 | 0.3875 | 0.32653 | 0.27895 | 0.36255 |
| rs7939893 | Imputed | C | DOM | 441 | 0.506 | 0.1982 | 0.3431 | 0.7463 | −3.437 | 0.3875 | 0.32653 | 0.27895 | 0.36255 |
| rs7955901 | Imputed | C | ADD | 440 | 0.7285 | 0.1367 | 0.5573 | 0.9524 | −2.316 | 0.2142 | 0.46364 | 0.41842 | 0.498 |
| rs7955901 | Imputed | C | DOM | 440 | 0.7139 | 0.2105 | 0.4726 | 1.078 | −1.601 | 0.2142 | 0.46364 | 0.41842 | 0.498 |
| rs7956274 | Imputed | T | ADD | 426 | 0.7156 | 0.1398 | 0.5441 | 0.9412 | −2.394 | 0.3288 | 0.45423 | 0.40659 | 0.48975 |
| rs7956274 | Imputed | T | DOM | 426 | 0.7031 | 0.2129 | 0.4633 | 1.067 | −1.655 | 0.3288 | 0.45423 | 0.40659 | 0.48975 |
| rs7957932 | Imputed | G | ADD | 439 | 0.7234 | 0.1368 | 0.5533 | 0.9459 | −2.366 | 0.3884 | 0.47039 | 0.42408 | 0.50605 |
| rs7957932 | Imputed | G | DOM | 439 | 0.6888 | 0.212 | 0.4546 | 1.044 | −1.758 | 0.3884 | 0.47039 | 0.42408 | 0.50605 |
| rs7984294 | Imputed | A | DOM | 437 | 2.115 | 0.2464 | 1.305 | 3.429 | 3.041 | 0.6016 | 0.10069 | 0.13564 | 0.0743 |
| rs7994286 | Imputed | A | ADD | 436 | 1.764 | 0.2224 | 1.141 | 2.727 | 2.552 | 0.1747 | 0.12041 | 0.15241 | 0.09639 |
| rs7994286 | Imputed | A | DOM | 436 | 1.796 | 0.2315 | 1.141 | 2.828 | 2.529 | 0.1747 | 0.12041 | 0.15241 | 0.09639 |
| rs8038229 | Genotyped | A | ADD | 443 | 0.6909 | 0.1538 | 0.5111 | 0.934 | −2.404 | 0.8204 | 0.29684 | 0.25393 | 0.32937 |
| rs8038229 | Genotyped | A | DOM | 443 | 0.666 | 0.1948 | 0.4546 | 0.9756 | −2.087 | 0.8204 | 0.29684 | 0.25393 | 0.32937 |
| rs8043336 | Imputed | C | GEN | 418 | | | | | 0.2115 | 0.8997 | 0.36124 | 0.35955 | 0.3625 |
| rs8043336 | Imputed | C | REC | 418 | 0.9456 | 0.301 | 0.5242 | 1.706 | −0.186 | 0.8525 | 0.36124 | 0.35955 | 0.3625 |
| rs8054431 | Imputed | T | DOM | 399 | 1.148 | 0.2121 | 0.7573 | 1.739 | 0.6492 | 0.5162 | 0.36842 | 0.37791 | 0.36123 |
| rs8066502 | Imputed | T | DOM | 442 | 0.5122 | 0.2187 | 0.3337 | 0.7864 | −3.059 | 0.00222 | 0.16176 | 0.1178 | 0.19522 |
| rs8068714 | Imputed | T | DOM | 442 | 0.5127 | 0.2016 | 0.334 | 0.7871 | −3.055 | 0.7257 | 0.16403 | 0.11842 | 0.19841 |
| rs892575 | Imputed | T | ADD | 442 | 1.044 | 0.1635 | 0.7579 | 1.439 | 0.2645 | 0.8632 | 0.22624 | 0.23037 | 0.22311 |
| rs892583 | Imputed | A | ADD | 438 | 1.079 | 0.1657 | 0.7796 | 1.492 | 0.457 | 1 | 0.22146 | 0.22872 | 0.216 |
| rs915494 | Imputed | A | DOM | 422 | 1.399 | 0.1473 | 1.048 | 1.868 | 2.281 | 0.1185 | 0.32227 | 0.36828 | 0.28602 |
| rs915494 | Imputed | A | DOM | 422 | 1.486 | 0.1999 | 1.004 | 2.199 | 1.982 | 0.1185 | 0.32227 | 0.36828 | 0.28602 |
| rs917295 | Imputed | G | DOM | 443 | 0.5934 | 0.2016 | 0.3997 | 0.881 | −2.589 | 0.1134 | 0.34312 | 0.31152 | 0.36706 |
| rs922594 | Imputed | T | DOM | 443 | 0.5826 | 0.1985 | 0.3948 | 0.8597 | −2.722 | 0.6802 | 0.36005 | 0.31675 | 0.39286 |
| rs9301653 | Imputed | T | ADD | 438 | 1.725 | 0.2225 | 1.115 | 2.668 | 2.451 | 0.1759 | 0.11872 | 0.14894 | 0.096 |
| rs9301653 | Imputed | T | DOM | 438 | 1.754 | 0.2318 | 1.113 | 2.762 | 2.423 | 0.1759 | 0.11872 | 0.14894 | 0.096 |
| rs9309988 | Imputed | G | DOM | 443 | 0.8286 | 0.2404 | 0.5173 | 1.327 | −0.7821 | 0.8039 | 0.10722 | 0.09686 | 0.11508 |
| rs9309989 | Genotyped | C | DOM | 443 | 0.771 | 0.2394 | 0.4822 | 1.233 | −1.086 | 1 | 0.11174 | 0.09686 | 0.12302 |
| rs9310221 | Imputed | A | DOM | 393 | 0.8966 | 0.2237 | 0.5784 | 1.39 | −0.4881 | 0.1503 | 0.42875 | 0.42604 | 0.4308 |
| rs9327555 | Imputed | T | DOM | 443 | 0.5934 | 0.2016 | 0.3997 | 0.881 | −2.589 | 0.1134 | 0.34312 | 0.31152 | 0.36706 |
| rs937890 | Imputed | G | DOM | 442 | 0.5127 | 0.2187 | 0.334 | 0.7871 | −3.055 | 0.8632 | 0.16403 | 0.11842 | 0.19841 |
| rs9454967 | Imputed | G | ADD | 441 | 0.982 | 0.2314 | 0.624 | 1.545 | −0.07863 | 0.07328 | 0.0907 | 0.08947 | 0.09163 |
| rs9454967 | Imputed | G | DOM | 441 | 0.9744 | 0.1885 | 0.583 | 1.629 | −0.09893 | 0.07328 | 0.0907 | 0.08947 | 0.09163 |
| rs9471295 | Imputed | T | DOM | 443 | 1.784 | 0.2241 | 1.048 | 2.042 | 1.224 | 0.7052 | 0.14447 | 0.18586 | 0.11905 |
| rs9477007 | Imputed | A | ADD | 435 | 1.792 | 0.2155 | 1.169 | 2.721 | 2.686 | 0.00722 | 0.14786 | 0.15135 | 0.38911 |
| rs9477007 | Imputed | A | GEN | 436 | 1.012 | 0.1389 | 0.7712 | 1.329 | 0.08887 | 0.9292 | 0.39106 | 0.39362 | 0.38911 |
| rs9487279 | Imputed | T | DOM | 420 | 1.094 | 0.2113 | 0.7229 | 1.655 | 0.4244 | 0.4209 | 0.42976 | 0.41892 | 0.4383 |
| rs949016 | Imputed | C | ADD | 441 | 1.063 | 0.1656 | 0.7682 | 1.47 | 0.3676 | 0.4873 | 0.21882 | 0.22487 | 0.21429 |
| rs9555973 | Imputed | G | DOM | 437 | 1.732 | 0.2221 | 1.12 | 2.676 | 2.472 | 0.1748 | 0.12014 | 0.15079 | 0.09677 |
| rs9555973 | Imputed | G | ADD | 437 | 1.761 | 0.2314 | 1.119 | 2.772 | 2.446 | 0.1748 | 0.12014 | 0.15079 | 0.09677 |
| rs9557510 | Imputed | G | DOM | 443 | 1.342 | 0.1885 | 0.9272 | 1.941 | 1.559 | 0.08093 | 0.119 | 0.16754 | 0.12698 |
| rs9557510 | Imputed | G | ADD | 443 | 1.316 | 0.2241 | 0.848 | 2.042 | 1.224 | 0.08093 | 0.14447 | 0.16754 | 0.12698 |
| rs9560584 | Imputed | T | DOM | 435 | 1.792 | 0.2322 | 1.137 | 2.824 | 2.512 | 0.1752 | 0.11954 | 0.15135 | 0.096 |
| rs9588770 | Imputed | T | DOM | 443 | 1.714 | 0.2155 | 1.096 | 2.68 | 2.36 | 0.8302 | 0.12754 | 0.15707 | 0.10516 |
| rs9588848 | Imputed | C | ADD | 438 | 1.725 | 0.2225 | 1.115 | 2.668 | 2.451 | 0.1759 | 0.11872 | 0.14894 | 0.096 |
| rs9588848 | Imputed | C | DOM | 438 | 1.754 | 0.2318 | 1.113 | 2.762 | 2.423 | 0.1759 | 0.11872 | 0.14894 | 0.096 |
| rs966583 | Imputed | A | ADD | 439 | 0.7596 | 0.1431 | 0.5738 | 1.005 | −1.922 | 0.05464 | 0.40091 | 0.36579 | 0.42771 |

TABLE 11-continued

| SNP rs # | SOURCE | ALLELE (A1) | MODEL | NMISS | ATORVA_A1_HZ_COUNT | | ATORVA_HET_COUNT | ATORVA_A2_HZ_COUNT | | | |
|---|---|---|---|---|---|---|---|---|---|---|---|
| rs966583 | Imputed | A | DOM | 439 | 0.6781 | 0.203 | 0.4555 | 1.01 | -1.913 | 1 | 0.40091 | 0.36579 | 0.42771 |
| rs974130 | Genotyped | A | REC | 443 | 0.8861 | 0.2801 | 0.5118 | 1.534 | -0.4317 | 0.4714 | 0.3623 | 0.34293 | 0.37698 |
| rs977160 | Imputed | T | ADD | 438 | 0.9972 | 0.168 | 0.7174 | 1.386 | -0.0169 | 0.8862 | 0.21119 | 0.21011 | 0.212 |
| rs9812206 | Imputed | G | ADD | 442 | 1.042 | 0.2668 | 0.6177 | 1.758 | 0.1545 | 0.09556 | 0.07692 | 0.07853 | 0.0757 |
| rs9812206 | Imputed | G | DOM | 442 | 1.042 | 0.2668 | 0.6177 | 1.758 | 0.1545 | 0.09556 | 0.07692 | 0.07853 | 0.0757 |
| rs9813552 | Imputed | G | ADD | 427 | 1.042 | 0.2623 | 0.6235 | 1.743 | 0.1586 | 0.4984 | 0.07692 | 0.07853 | 0.0757 |
| rs9813552 | Imputed | G | DOM | 427 | 1.042 | 0.2623 | 0.6235 | 1.743 | 0.1586 | 0.4984 | 0.07692 | 0.07853 | 0.0757 |
| rs9815037 | Imputed | T | ADD | 440 | 1.077 | 0.2681 | 0.6368 | 1.821 | 0.2766 | 0.874 | 0.07675 | 0.07853 | 0.0754 |
| rs9815037 | Imputed | T | DOM | 440 | 1.048 | 0.2622 | 0.6267 | 1.752 | 0.1778 | 0.8589 | 0.07675 | 0.07853 | 0.0754 |
| rs9825349 | Imputed | A | ADD | 443 | 1.048 | 0.2681 | 0.6401 | 1.831 | 0.2958 | 0.7664 | 0.07675 | 0.07853 | 0.0754 |
| rs9825349 | Imputed | A | DOM | 443 | 1.048 | 0.2681 | 0.6267 | 1.752 | 0.1778 | 0.8589 | 0.07675 | 0.07853 | 0.0754 |
| rs9834217 | Imputed | T | ADD | 443 | 1.083 | 0.2681 | 0.6401 | 1.831 | 0.2958 | 0.7664 | 0.07675 | 0.07853 | 0.0754 |
| rs9834217 | Imputed | T | DOM | 443 | 1.017 | 0.2611 | 0.6096 | 1.696 | 0.06425 | 0.9488 | 0.07788 | 0.07853 | 0.07738 |
| rs9840460 | Imputed | T | ADD | 443 | 1.049 | 0.2668 | 0.6218 | 1.77 | 0.179 | 0.858 | 0.07788 | 0.07853 | 0.07738 |
| rs9840460 | Imputed | T | DOM | 443 | 1.017 | 0.2611 | 0.6096 | 1.696 | 0.06425 | 0.9488 | 0.07788 | 0.07853 | 0.07738 |
| rs9840756 | Imputed | A | ADD | 437 | 1.049 | 0.2668 | 0.6218 | 1.77 | 0.179 | 0.858 | 0.07788 | 0.07853 | 0.07738 |
| rs9840756 | Imputed | A | DOM | 437 | 0.9995 | 0.2614 | 0.5988 | 1.668 | -0.00192 | 0.9985 | 0.07895 | 0.07895 | 0.07895 |
| rs9844801 | Imputed | C | GEN | 423 | 1.031 | 0.2671 | 0.6105 | 1.74 | 0.1127 | 0.9103 | 0.07895 | 0.07895 | 0.07895 |
| rs985375 | Imputed | A | ADD | 442 | 0.8286 | 0.2404 | 0.5173 | 1.327 | -0.7821 | 0.4342 | 0.10722 | 0.09686 | 0.11508 |
| rs9869187 | Imputed | C | DOM | 442 | 1.037 | 0.2669 | 0.6147 | 1.75 | 0.1366 | 0.893 | 0.25296 | 0.25137 | 0.25417 |
| rs9869187 | Imputed | C | ADD | 443 | 1.037 | 0.2669 | 0.6147 | 1.75 | 0.1366 | 0.8914 | 0.07805 | 0.07895 | 0.07738 |
| rs9872327 | Imputed | T | DOM | 440 | 0.8286 | 0.2404 | 0.5173 | 1.327 | -0.7821 | 0.4342 | 0.10722 | 0.09686 | 0.11508 |
| rs9881685 | Imputed | A | ADD | 440 | 1.041 | 0.2668 | 0.6172 | 1.756 | 0.151 | 0.88 | 0.09541 | 0.07727 | 0.076 |
| rs9881685 | Imputed | A | DOM | 422 | 1.716 | 0.1997 | 1.161 | 2.539 | 2.706 | 0.00681 | 0.3045 | 0.33516 | 0.28125 |
| rs9909499 | Imputed | C | DOM | 442 | 0.5127 | 0.2187 | 0.334 | 0.7871 | -3.055 | 0.00225 | 0.16403 | 0.11842 | 0.19841 |
| rs9911847 | Imputed | A | ADD | 438 | 1.083 | 0.1637 | 0.7858 | 1.493 | 0.4879 | 0.6256 | 0.23174 | 0.23947 | 0.22581 |
| rs9958823 | Imputed | T | ADD | 437 | 1.002 | 0.1681 | 0.721 | 1.394 | 0.01427 | 0.9886 | 0.21167 | 0.21123 | 0.212 |

| SNP rs # | SOURCE | ALLELE (A1) | MODEL | NMISS | ATORVA_A1_HZ_COUNT | ATORVA_HET_COUNT | ATORVA_A2_HZ_COUNT | PRAVA_A1_HZ_COUNT | PRAVA_HET_COUNT | PRAVA_A2_HZ_COUNT |
|---|---|---|---|---|---|---|---|---|---|---|
| rs198460 | Genotyped | G | REC | 443 | 64 | 86 | 41 | 52 | 135 | 65 |
| rs603940 | Genotyped | G | REC | 443 | 19 | 107 | 65 | 51 | 107 | 94 |
| rs10021016 | Genotyped | T | GEN | 443 | 20 | 74 | 97 | 12 | 95 | 145 |
| rs1003148 | Imputed | C | ADD | 427 | 23 | 96 | 64 | 55 | 115 | 74 |
| rs1003148 | Imputed | C | GEN | 427 | 23 | 96 | 64 | 55 | 115 | 74 |
| rs10046799 | Imputed | C | REC | 440 | 23 | 78 | 50 | 82 | 115 | 74 |
| rs10046799 | Imputed | C | ADD | 440 | 61 | 78 | 50 | 82 | 131 | 38 |
| rs10051148 | Imputed | G | GEN | 443 | 20 | 67 | 104 | 23 | 120 | 109 |
| rs10054055 | Imputed | T | DOM | 440 | 23 | 65 | 101 | 29 | 120 | 102 |
| rs10067895 | Imputed | A | DOM | 440 | 27 | 65 | 98 | 35 | 118 | 97 |
| rs1008705 | Imputed | C | DOM | 353 | 11 | 76 | 63 | 20 | 66 | 117 |
| rs10105871 | Imputed | C | DOM | 382 | 22 | 92 | 51 | 27 | 103 | 87 |
| rs10116807 | Imputed | A | GEN | 436 | 13 | 70 | 107 | 7 | 75 | 164 |
| rs10116807 | Imputed | A | REC | 436 | 13 | 70 | 107 | 7 | 75 | 164 |
| rs10121941 | Imputed | C | DOM | 443 | 2 | 32 | 157 | 2 | 37 | 213 |
| rs10128638 | Genotyped | G | DOM | 443 | 50 | 90 | 51 | 72 | 131 | 49 |
| rs1012924 | Imputed | G | ADD | 438 | 2 | 52 | 134 | 1 | 46 | 203 |
| rs1012924 | Imputed | G | DOM | 438 | 2 | 52 | 134 | 1 | 46 | 203 |
| rs1016030 | Genotyped | G | ADD | 442 | 27 | 92 | 72 | 31 | 114 | 106 |
| rs1016030 | Genotyped | G | GEN | 442 | 27 | 92 | 72 | 31 | 114 | 106 |

TABLE 11-continued

| SNP | Status | Allele | Model | N | | | | | |
|---|---|---|---|---|---|---|---|---|---|
| rs1017558 | Imputed | A | REC | 430 | 22 | 76 | 85 | 36 | 99 |
| rs10183431 | Imputed | T | DOM | 438 | 11 | 76 | 101 | 20 | 146 |
| rs10195401 | Imputed | C | DOM | 440 | 27 | 99 | 64 | 35 | 86 |
| rs10239416 | Imputed | A | DOM | 431 | 31 | 93 | 63 | 31 | 99 |
| rs1032188 | Imputed | G | GEN | 443 | 10 | 84 | 97 | 30 | 129 |
| rs1032188 | Imputed | G | REC | 443 | 10 | 84 | 97 | 30 | 129 |
| rs10468988 | Imputed | G | ADD | 438 | 9 | 73 | 108 | 13 | 149 |
| rs10478919 | Imputed | G | DOM | 443 | 26 | 66 | 99 | 34 | 100 |
| rs10506623 | Imputed | C | DOM | 442 | 26 | 86 | 78 | 45 | 86 |
| rs10506626 | Imputed | A | DOM | 443 | 26 | 84 | 81 | 46 | 85 |
| rs10509477 | Imputed | T | DOM | 443 | 29 | 83 | 79 | 27 | 124 |
| rs10511071 | Imputed | C | DOM | 443 | 1 | 35 | 155 | 3 | 197 |
| rs10511072 | Imputed | C | DOM | 443 | 1 | 35 | 155 | 3 | 197 |
| rs10511199 | Imputed | C | ADD | 442 | 10 | 67 | 113 | 13 | 152 |
| rs10513283 | Imputed | G | GEN | 442 | 7 | 59 | 124 | 8 | 178 |
| rs10520072 | Imputed | T | DOM | 443 | 27 | 65 | 99 | 33 | 100 |
| rs1065639 | Imputed | C | DOM | 209 | 0 | 2 | 88 | 0 | 118 |
| rs10733846 | Imputed | G | ADD | 435 | 5 | 45 | 137 | 4 | 166 |
| rs10733846 | Imputed | G | DOM | 435 | 5 | 45 | 137 | 4 | 166 |
| rs10737390 | Imputed | T | DOM | 418 | 30 | 90 | 59 | 35 | 82 |
| rs10749293 | Imputed | G | DOM | 441 | 26 | 84 | 80 | 26 | 129 |
| rs10752159 | Imputed | T | ADD | 442 | 7 | 72 | 112 | 14 | 167 |
| rs10753760 | Imputed | T | GEN | 423 | 36 | 80 | 69 | 50 | 86 |
| rs10753760 | Imputed | T | DOM | 423 | 36 | 80 | 69 | 50 | 86 |
| rs10757887 | Imputed | C | DOM | 443 | 19 | 70 | 102 | 23 | 139 |
| rs10758326 | Imputed | A | ADD | 440 | 16 | 98 | 76 | 46 | 87 |
| rs10758326 | Imputed | A | DOM | 440 | 16 | 98 | 76 | 46 | 87 |
| rs10758326 | Imputed | A | REC | 440 | 16 | 98 | 76 | 46 | 87 |
| rs10762236 | Genotyped | G | ADD | 443 | 7 | 53 | 131 | 5 | 163 |
| rs10765769 | Imputed | C | ADD | 441 | 31 | 94 | 64 | 34 | 100 |
| rs10765769 | Imputed | C | DOM | 441 | 31 | 94 | 64 | 34 | 100 |
| rs10784891 | Imputed | C | ADD | 422 | 30 | 89 | 65 | 58 | 69 |
| rs10784891 | Imputed | C | DOM | 422 | 30 | 89 | 65 | 58 | 69 |
| rs10787923 | Imputed | C | DOM | 439 | 26 | 83 | 79 | 26 | 129 |
| rs10787949 | Imputed | A | DOM | 442 | 29 | 84 | 78 | 29 | 122 |
| rs10787951 | Imputed | G | DOM | 441 | 29 | 83 | 78 | 29 | 122 |
| rs10787983 | Imputed | C | DOM | 441 | 29 | 83 | 79 | 27 | 123 |
| rs10788380 | Imputed | C | ADD | 438 | 51 | 100 | 37 | 56 | 73 |
| rs10788380 | Imputed | C | DOM | 438 | 51 | 100 | 37 | 56 | 73 |
| rs10788380 | Imputed | C | GEN | 438 | 51 | 100 | 37 | 56 | 73 |
| rs10814418 | Imputed | C | DOM | 442 | 2 | 32 | 156 | 2 | 213 |
| rs10831417 | Imputed | A | ADD | 443 | 25 | 93 | 73 | 29 | 107 |
| rs10831417 | Imputed | A | GEN | 443 | 25 | 93 | 73 | 29 | 107 |
| rs10831422 | Imputed | A | ADD | 441 | 27 | 90 | 72 | 30 | 106 |
| rs10831422 | Imputed | G | GEN | 441 | 27 | 90 | 72 | 30 | 106 |
| rs10862931 | Imputed | G | GEN | 439 | 32 | 81 | 77 | 23 | 110 |
| rs10865197 | Imputed | C | DOM | 438 | 11 | 76 | 101 | 20 | 146 |
| rs10871302 | Imputed | A | DOM | 443 | 3 | 62 | 126 | 8 | 200 |
| rs10877463 | Imputed | C | DOM | 443 | 21 | 79 | 91 | 34 | 88 |
| rs10877468 | Imputed | C | ADD | 442 | 21 | 79 | 91 | 34 | 88 |
| rs10879240 | Imputed | C | DOM | 428 | 30 | 92 | 66 | 60 | 69 |
| rs10879242 | Imputed | A | ADD | 421 | 26 | 86 | 73 | 45 | 75 |
| rs10879245 | Imputed | G | DOM | 421 | 26 | 86 | 73 | 45 | 75 |

TABLE 11-continued

| | | | | | | | | |
|---|---|---|---|---|---|---|---|---|
| rs10879249 | Imputed | T | DOM | 440 | 26 | 87 | 77 | 45 | 121 | 84 |
| rs10886452 | Imputed | A | DOM | 440 | 30 | 82 | 78 | 26 | 101 | 123 |
| rs10886463 | Imputed | C | DOM | 442 | 30 | 83 | 78 | 29 | 100 | 122 |
| rs10886465 | Imputed | A | DOM | 441 | 30 | 83 | 78 | 28 | 100 | 122 |
| rs10886526 | Imputed | C | DOM | 439 | 28 | 83 | 78 | 26 | 101 | 123 |
| rs10902437 | Imputed | G | ADD | 393 | 34 | 74 | 55 | 24 | 118 | 88 |
| rs10941126 | Imputed | G | ADD | 443 | 3 | 22 | 166 | 7 | 23 | 222 |
| rs10941126 | Imputed | G | DOM | 443 | 3 | 22 | 166 | 7 | 23 | 222 |
| rs10947871 | Imputed | A | DOM | 391 | 3 | 49 | 122 | 2 | 34 | 181 |
| rs10972978 | Imputed | G | DOM | 437 | 2 | 32 | 153 | 2 | 36 | 212 |
| rs10973012 | Imputed | A | DOM | 443 | 2 | 32 | 157 | 2 | 37 | 213 |
| rs10974028 | Genotyped | G | ADD | 443 | 5 | 56 | 130 | 5 | 66 | 181 |
| rs10974028 | Genotyped | G | DOM | 443 | 5 | 56 | 130 | 5 | 66 | 181 |
| rs11021302 | Imputed | A | ADD | 441 | 27 | 90 | 72 | 30 | 116 | 106 |
| rs11021302 | Imputed | A | GEN | 441 | 27 | 90 | 72 | 30 | 116 | 106 |
| rs11099644 | Imputed | G | REC | 430 | 22 | 76 | 85 | 36 | 112 | 99 |
| rs11138315 | Imputed | G | ADD | 443 | 2 | 35 | 154 | 9 | 63 | 180 |
| rs11149802 | Imputed | G | DOM | 443 | 3 | 62 | 126 | 8 | 44 | 200 |
| rs11116596 | Imputed | T | DOM | 443 | 26 | 66 | 99 | 34 | 118 | 100 |
| rs11178531 | Imputed | A | ADD | 439 | 34 | 92 | 64 | 67 | 117 | 65 |
| rs11178531 | Imputed | A | DOM | 439 | 34 | 92 | 64 | 67 | 117 | 65 |
| rs11178575 | Imputed | C | GEN | 441 | 22 | 91 | 78 | 14 | 105 | 131 |
| rs11178575 | Imputed | C | REC | 441 | 22 | 91 | 78 | 14 | 105 | 131 |
| rs11178577 | Imputed | T | GEN | 439 | 22 | 92 | 76 | 14 | 106 | 129 |
| rs11178577 | Imputed | T | REC | 439 | 22 | 92 | 76 | 14 | 106 | 129 |
| rs11178583 | Imputed | A | DOM | 443 | 26 | 87 | 78 | 45 | 121 | 86 |
| rs11178589 | Imputed | A | DOM | 437 | 26 | 87 | 77 | 45 | 120 | 82 |
| rs11178594 | Imputed | C | DOM | 441 | 26 | 88 | 76 | 45 | 125 | 81 |
| rs11178602 | Imputed | T | DOM | 439 | 26 | 87 | 76 | 45 | 124 | 81 |
| rs11178648 | Imputed | T | DOM | 440 | 26 | 83 | 80 | 46 | 120 | 85 |
| rs11198877 | Imputed | T | DOM | 441 | 30 | 82 | 78 | 26 | 102 | 123 |
| rs11198942 | Imputed | T | DOM | 443 | 29 | 83 | 79 | 27 | 101 | 124 |
| rs11221075 | Imputed | A | ADD | 417 | 0 | 27 | 152 | 5 | 58 | 175 |
| rs11242020 | Imputed | T | DOM | 443 | 26 | 66 | 99 | 34 | 118 | 100 |
| rs11242021 | Imputed | T | DOM | 443 | 27 | 65 | 99 | 33 | 119 | 100 |
| rs11242022 | Imputed | T | DOM | 443 | 27 | 65 | 99 | 33 | 119 | 100 |
| rs11242023 | Imputed | C | DOM | 443 | 27 | 65 | 99 | 33 | 119 | 100 |
| rs1149350 | Imputed | G | DOM | 435 | 6 | 60 | 125 | 24 | 70 | 158 |
| rs1150143 | Imputed | T | DOM | 441 | 31 | 83 | 72 | 42 | 109 | 98 |
| rs11576627 | Imputed | T | ADD | 441 | 7 | 43 | 140 | 6 | 40 | 205 |
| rs11602189 | Imputed | T | DOM | 441 | 7 | 43 | 140 | 6 | 40 | 205 |
| rs11605163 | Imputed | A | DOM | 440 | 17 | 86 | 87 | 25 | 118 | 107 |
| rs11615214 | Imputed | G | ADD | 437 | 4 | 34 | 151 | 2 | 45 | 204 |
| rs11615214 | Imputed | G | GEN | 437 | 18 | 99 | 73 | 49 | 111 | 87 |
| rs11642394 | Imputed | C | DOM | 443 | 18 | 99 | 73 | 49 | 111 | 87 |
| rs11644943 | Imputed | T | ADD | 421 | 3 | 62 | 126 | 8 | 44 | 200 |
| rs11656608 | Imputed | A | DOM | 442 | 13 | 72 | 98 | 10 | 75 | 153 |
| rs11661309 | Imputed | T | ADD | 441 | 2 | 41 | 147 | 9 | 82 | 161 |
| rs11661309 | Imputed | A | DOM | 439 | 3 | 55 | 131 | 12 | 74 | 164 |
| rs11666131 | Imputed | A | ADD | 441 | 3 | 55 | 131 | 12 | 74 | 164 |
| rs11743355 | Imputed | C | ADD | 443 | 6 | 76 | 108 | 7 | 88 | 151 |
| rs11743355 | Imputed | C | DOM | 443 | 3 | 22 | 166 | 7 | 23 | 222 |

TABLE 11-continued

| | | | | | | | | |
|---|---|---|---|---|---|---|---|---|
| rs11746806 | Imputed | T | ADD | 443 | 3 | 22 | 166 | 7 | 23 | 222 |
| rs11746806 | Imputed | T | DOM | 443 | 3 | 22 | 166 | 7 | 23 | 222 |
| rs11746959 | Imputed | T | ADD | 443 | 3 | 22 | 166 | 7 | 23 | 222 |
| rs11746959 | Imputed | T | DOM | 443 | 3 | 22 | 166 | 7 | 23 | 222 |
| rs11749272 | Imputed | T | DOM | 443 | 26 | 66 | 99 | 34 | 118 | 100 |
| rs11901899 | Imputed | A | DOM | 426 | 14 | 85 | 85 | 14 | 94 | 134 |
| rs11926319 | Imputed | G | ADD | 443 | 0 | 29 | 162 | 1 | 37 | 214 |
| rs11926319 | Imputed | G | DOM | 443 | 0 | 29 | 162 | 1 | 37 | 214 |
| rs11956952 | Imputed | C | DOM | 418 | 12 | 56 | 115 | 12 | 99 | 124 |
| rs12025826 | Imputed | C | DOM | 434 | 29 | 103 | 54 | 46 | 109 | 93 |
| rs1204522 | Imputed | C | GEN | 422 | 24 | 82 | 78 | 28 | 108 | 102 |
| rs1204524 | Imputed | A | GEN | 422 | 24 | 82 | 78 | 28 | 108 | 102 |
| rs12153185 | Imputed | T | DOM | 441 | 27 | 65 | 98 | 36 | 118 | 97 |
| rs12182651 | Imputed | T | ADD | 441 | 3 | 28 | 159 | 4 | 38 | 209 |
| rs12182651 | Imputed | T | DOM | 441 | 3 | 28 | 159 | 4 | 38 | 209 |
| rs12193568 | Imputed | G | DOM | 361 | 5 | 45 | 109 | 7 | 39 | 156 |
| rs12264914 | Imputed | C | DOM | 311 | 8 | 41 | 89 | 12 | 79 | 82 |
| rs12307767 | Imputed | C | DOM | 419 | 20 | 73 | 86 | 32 | 122 | 86 |
| rs1232298 | Imputed | G | REC | 408 | 33 | 71 | 74 | 24 | 98 | 108 |
| rs12407412 | Imputed | C | ADD | 441 | 7 | 43 | 140 | 6 | 40 | 205 |
| rs12407412 | Imputed | C | DOM | 441 | 7 | 43 | 140 | 6 | 40 | 205 |
| rs12420184 | Imputed | C | DOM | 438 | 4 | 56 | 129 | 5 | 57 | 187 |
| rs12422750 | Imputed | A | DOM | 442 | 17 | 78 | 95 | 27 | 131 | 94 |
| rs12446951 | Imputed | A | ADD | 310 | 1 | 33 | 107 | 1 | 26 | 142 |
| rs12446951 | Imputed | A | DOM | 310 | 1 | 33 | 107 | 1 | 26 | 142 |
| rs12457400 | Imputed | G | DOM | 443 | 2 | 27 | 162 | 2 | 58 | 192 |
| rs1247340 | Imputed | C | DOM | 441 | 4 | 60 | 126 | 22 | 69 | 160 |
| rs1247341 | Imputed | C | DOM | 441 | 4 | 61 | 126 | 21 | 69 | 160 |
| rs12521291 | Imputed | G | ADD | 435 | 21 | 94 | 71 | 35 | 105 | 109 |
| rs12526849 | Imputed | T | ADD | 436 | 34 | 80 | 74 | 37 | 119 | 92 |
| rs12526849 | Imputed | T | DOM | 436 | 34 | 80 | 74 | 37 | 119 | 92 |
| rs12543110 | Imputed | G | DOM | 443 | 9 | 87 | 95 | 19 | 90 | 143 |
| rs12678600 | Imputed | A | DOM | 439 | 18 | 77 | 94 | 26 | 113 | 111 |
| rs12719415 | Imputed | T | DOM | 443 | 27 | 65 | 99 | 33 | 119 | 100 |
| rs12831292 | Imputed | G | DOM | 436 | 26 | 86 | 74 | 45 | 124 | 81 |
| rs12923993 | Imputed | C | DOM | 443 | 3 | 62 | 126 | 8 | 44 | 200 |
| rs12936964 | Imputed | T | DOM | 431 | 23 | 92 | 71 | 46 | 99 | 100 |
| rs12960663 | Imputed | C | ADD | 435 | 3 | 53 | 131 | 11 | 73 | 164 |
| rs13038146 | Imputed | C | DOM | 443 | 34 | 80 | 77 | 24 | 109 | 119 |
| rs13038146 | Imputed | C | GEN | 443 | 34 | 80 | 77 | 24 | 109 | 119 |
| rs13134222 | Imputed | A | GEN | 442 | 13 | 81 | 96 | 12 | 89 | 151 |
| rs13172910 | Imputed | A | DOM | 417 | 12 | 56 | 115 | 13 | 98 | 123 |
| rs13194907 | Imputed | A | ADD | 443 | 1 | 27 | 163 | 3 | 30 | 219 |
| rs13194907 | Imputed | A | DOM | 443 | 1 | 27 | 163 | 3 | 30 | 219 |
| rs13195745 | Imputed | A | ADD | 443 | 1 | 27 | 163 | 3 | 30 | 219 |
| rs13195745 | Imputed | A | DOM | 443 | 1 | 27 | 163 | 3 | 30 | 219 |
| rs1321432 | Imputed | A | REC | 443 | 31 | 82 | 78 | 41 | 111 | 100 |
| rs1321457 | Imputed | G | REC | 435 | 26 | 84 | 78 | 36 | 107 | 104 |
| rs13265054 | Imputed | T | DOM | 434 | 17 | 76 | 94 | 25 | 114 | 108 |
| rs13282131 | Imputed | C | GEN | 440 | 47 | 85 | 58 | 39 | 129 | 82 |
| rs13353526 | Imputed | C | DOM | 438 | 2 | 41 | 147 | 5 | 57 | 186 |
| rs1336382 | Imputed | T | DOM | 443 | 29 | 83 | 79 | 27 | 101 | 124 |
| rs1336383 | Imputed | T | DOM | 443 | 29 | 83 | 79 | 27 | 101 | 124 |

TABLE 11-continued

| | | | | | | | | |
|---|---|---|---|---|---|---|---|---|
| rs1336407 | Imputed | T | DOM | 442 | 29 | 83 | 27 | 101 | 123 |
| rs1336409 | Imputed | T | DOM | 442 | 29 | 83 | 27 | 101 | 123 |
| rs1336596 | Imputed | A | DOM | 440 | 28 | 87 | 28 | 126 | 96 |
| rs1343560 | Imputed | T | ADD | 437 | 2 | 52 | 1 | 46 | 202 |
| rs1343560 | Imputed | T | DOM | 437 | 2 | 52 | 1 | 46 | 202 |
| rs1361987 | Imputed | T | GEN | 443 | 25 | 83 | 28 | 114 | 110 |
| rs1386153 | Imputed | T | ADD | 441 | 16 | 87 | 27 | 118 | 106 |
| rs1386153 | Imputed | T | DOM | 441 | 16 | 87 | 27 | 118 | 106 |
| rs1394015 | Imputed | C | DOM | 372 | 0 | 2 | 0 | 1 | 213 |
| rs1407038 | Imputed | A | REC | 443 | 27 | 83 | 37 | 107 | 108 |
| rs1407039 | Imputed | A | REC | 443 | 31 | 82 | 41 | 111 | 100 |
| rs1412802 | Imputed | T | GEN | 428 | 8 | 78 | 23 | 98 | 123 |
| rs1414865 | Imputed | T | DOM | 442 | 29 | 84 | 29 | 100 | 122 |
| rs1414873 | Imputed | A | DOM | 442 | 29 | 83 | 27 | 101 | 123 |
| rs1414876 | Imputed | C | DOM | 442 | 29 | 83 | 27 | 101 | 123 |
| rs1418671 | Imputed | C | REC | 424 | 29 | 88 | 35 | 120 | 87 |
| rs1419490 | Genotyped | T | GEN | 443 | 23 | 83 | 27 | 115 | 110 |
| rs1434507 | Imputed | A | ADD | 442 | 9 | 70 | 13 | 86 | 152 |
| rs1434508 | Imputed | T | ADD | 442 | 9 | 70 | 13 | 86 | 152 |
| rs1435205 | Imputed | A | ADD | 442 | 10 | 67 | 13 | 87 | 152 |
| rs1443928 | Imputed | C | REC | 435 | 65 | 87 | 84 | 112 | 48 |
| rs1452235 | Imputed | G | GEN | 443 | 30 | 81 | 22 | 110 | 120 |
| rs1452236 | Imputed | G | GEN | 443 | 30 | 81 | 22 | 110 | 120 |
| rs1452237 | Imputed | G | GEN | 443 | 30 | 81 | 22 | 110 | 120 |
| rs1452243 | Genotyped | T | GEN | 443 | 31 | 81 | 22 | 114 | 116 |
| rs1463768 | Genotyped | G | REC | 443 | 38 | 88 | 30 | 115 | 107 |
| rs1463769 | Imputed | G | REC | 443 | 38 | 88 | 30 | 115 | 107 |
| rs1472435 | Imputed | A | ADD | 437 | 0 | 14 | 0 | 33 | 215 |
| rs1472435 | Imputed | A | DOM | 437 | 0 | 14 | 0 | 33 | 215 |
| rs1476714 | Imputed | A | DOM | 439 | 27 | 65 | 33 | 118 | 98 |
| rs1495159 | Imputed | G | ADD | 429 | 18 | 94 | 28 | 88 | 128 |
| rs1495159 | Imputed | G | GEN | 429 | 18 | 94 | 28 | 88 | 128 |
| rs1495375 | Imputed | A | DOM | 421 | 26 | 86 | 45 | 116 | 75 |
| rs1495376 | Imputed | A | DOM | 424 | 36 | 96 | 58 | 125 | 57 |
| rs1495377 | Imputed | G | DOM | 425 | 36 | 96 | 58 | 125 | 58 |
| rs1495381 | Imputed | T | GEN | 442 | 35 | 95 | 25 | 126 | 101 |
| rs1495381 | Imputed | T | REC | 442 | 35 | 95 | 25 | 126 | 101 |
| rs1498992 | Imputed | G | DOM | 428 | 22 | 75 | 34 | 113 | 97 |
| rs1499001 | Imputed | G | DOM | 437 | 16 | 66 | 24 | 102 | 124 |
| rs1512988 | Imputed | A | DOM | 442 | 26 | 86 | 45 | 121 | 86 |
| rs1512989 | Imputed | T | DOM | 442 | 26 | 86 | 45 | 121 | 86 |
| rs1512991 | Imputed | T | ADD | 425 | 30 | 89 | 63 | 113 | 66 |
| rs1512991 | Imputed | T | DOM | 425 | 30 | 89 | 63 | 113 | 66 |
| rs1516855 | Imputed | G | REC | 398 | 29 | 77 | 31 | 97 | 95 |
| rs1527450 | Imputed | T | ADD | 441 | 25 | 91 | 29 | 116 | 107 |
| rs1527450 | Imputed | T | GEN | 441 | 25 | 91 | 29 | 116 | 107 |
| rs1567740 | Imputed | T | DOM | 439 | 26 | 87 | 45 | 121 | 83 |
| rs1572573 | Imputed | A | ADD | 396 | 2 | 61 | 3 | 78 | 142 |
| rs1572573 | Imputed | A | DOM | 396 | 2 | 61 | 3 | 78 | 142 |
| rs1584003 | Imputed | C | DOM | 432 | 35 | 89 | 47 | 138 | 58 |
| rs1584005 | Imputed | C | DOM | 427 | 35 | 87 | 46 | 136 | 58 |
| rs1585771 | Imputed | G | ADD | 433 | 13 | 72 | 17 | 98 | 133 |
| rs1592015 | Imputed | G | DOM | 443 | 8 | 52 | 8 | 65 | 179 |

TABLE 11-continued

| SNP | | | | | | | | | |
|---|---|---|---|---|---|---|---|---|---|
| rs1594885 | Imputed | A | ADD | 440 | 9 | 73 | 108 | 87 | 150 |
| rs1603232 | Imputed | A | DOM | 412 | 36 | 94 | 50 | 120 | 53 |
| rs1614565 | Imputed | C | DOM | 439 | 39 | 97 | 53 | 128 | 58 |
| rs1648200 | Imputed | G | ADD | 411 | 14 | 68 | 97 | 84 | 138 |
| rs16877387 | Imputed | C | GEN | 436 | 23 | 73 | 92 | 113 | 109 |
| rs16877387 | Imputed | C | REC | 435 | 23 | 73 | 92 | 113 | 109 |
| rs16938626 | Imputed | G | DOM | 399 | 15 | 63 | 109 | 100 | 129 |
| rs1694334 | Imputed | G | ADD | 443 | 7 | 60 | 103 | 75 | 147 |
| rs1698821 | Imputed | T | DOM | 417 | 8 | 52 | 131 | 65 | 179 |
| rs1700400 | Imputed | G | ADD | 443 | 12 | 58 | 111 | 79 | 141 |
| rs1700620 | Imputed | G | ADD | 408 | 7 | 66 | 104 | 75 | 143 |
| rs1700620 | Imputed | G | DOM | 408 | 7 | 66 | 104 | 75 | 143 |
| rs1723290 | Imputed | C | DOM | 443 | 1 | 35 | 155 | 52 | 197 |
| rs1747957 | Imputed | C | DOM | 439 | 7 | 64 | 118 | 56 | 187 |
| rs1705237 | Imputed | A | DOM | 439 | 39 | 97 | 53 | 128 | 58 |
| rs1705261 | Imputed | A | GEN | 442 | 37 | 93 | 60 | 125 | 99 |
| rs1705261 | Imputed | A | REC | 442 | 37 | 93 | 60 | 125 | 99 |
| rs17076972 | Imputed | C | ADD | 442 | 38 | 101 | 52 | 126 | 74 |
| rs17076972 | Imputed | C | GEN | 442 | 38 | 101 | 52 | 126 | 74 |
| rs17076972 | Imputed | C | REC | 442 | 38 | 101 | 52 | 126 | 74 |
| rs17189710 | Imputed | T | ADD | 430 | 33 | 77 | 75 | 108 | 114 |
| rs17189710 | Imputed | T | GEN | 430 | 33 | 77 | 75 | 108 | 114 |
| rs17196143 | Imputed | A | GEN | 443 | 2 | 54 | 135 | 77 | 163 |
| rs17353809 | Imputed | G | ADD | 433 | 10 | 59 | 116 | 83 | 153 |
| rs17368986 | Imputed | A | GEN | 442 | 7 | 59 | 124 | 66 | 178 |
| rs17369097 | Imputed | A | GEN | 443 | 8 | 59 | 124 | 68 | 176 |
| rs17434511 | Imputed | C | GEN | 442 | 7 | 59 | 124 | 66 | 178 |
| rs17434589 | Imputed | C | GEN | 442 | 7 | 59 | 124 | 66 | 178 |
| rs17434603 | Imputed | G | GEN | 442 | 8 | 59 | 124 | 68 | 176 |
| rs17434840 | Imputed | G | GEN | 443 | 8 | 82 | 68 | 104 | 94 |
| rs17446418 | Imputed | G | DOM | 380 | 14 | 82 | 64 | 106 | 90 |
| rs17530747 | Imputed | T | DOM | 374 | 14 | 29 | 162 | 40 | 212 |
| rs17604285 | Imputed | C | ADD | 443 | 0 | 29 | 162 | 40 | 212 |
| rs17604285 | Imputed | C | DOM | 443 | 0 | 51 | 135 | 79 | 163 |
| rs17662322 | Imputed | T | DOM | 443 | 5 | 59 | 116 | 83 | 153 |
| rs17769826 | Imputed | T | ADD | 433 | 10 | 59 | 116 | 83 | 153 |
| rs17821641 | Imputed | T | DOM | 442 | 10 | 67 | 113 | 87 | 152 |
| rs1782328 | Imputed | A | ADD | 426 | 5 | 51 | 126 | 77 | 163 |
| rs1796337 | Imputed | A | ADD | 428 | 38 | 101 | 47 | 128 | 47 |
| rs1798083 | Imputed | C | DOM | 441 | 41 | 97 | 52 | 128 | 56 |
| rs1798085 | Imputed | T | DOM | 439 | 39 | 97 | 53 | 128 | 58 |
| rs1798086 | Imputed | T | DOM | 416 | 41 | 94 | 49 | 119 | 51 |
| rs1798089 | Imputed | C | REC | 366 | 8 | 81 | 63 | 107 | 102 |
| rs1798089 | Imputed | C | GEN | 366 | 8 | 81 | 63 | 107 | 102 |
| rs1798090 | Imputed | T | REC | 367 | 8 | 82 | 63 | 107 | 102 |
| rs1798090 | Imputed | T | GEN | 367 | 8 | 82 | 63 | 107 | 102 |
| rs1832222 | Imputed | C | ADD | 443 | 29 | 83 | 79 | 102 | 123 |
| rs1838104 | Imputed | A | ADD | 440 | 61 | 89 | 40 | 128 | 47 |
| rs1838104 | Imputed | A | DOM | 440 | 61 | 89 | 40 | 128 | 47 |
| rs1868616 | Imputed | G | GEN | 437 | 6 | 52 | 130 | 80 | 159 |
| rs1874313 | Imputed | A | ADD | 443 | 26 | 87 | 78 | 121 | 86 |
| rs1884902 | Imputed | C | REC | 443 | 31 | 82 | 41 | 111 | 100 |
| rs1913201 | Imputed | G | ADD | 432 | 30 | 90 | 65 | 116 | 68 |

TABLE 11-continued

| | | | | | | | | | |
|---|---|---|---|---|---|---|---|---|---|
| rs1913201 | Imputed | G | DOM | 432 | 30 | 90 | 65 | 63 | 116 | 68 |
| rs1913201 | Imputed | G | GEN | 432 | 30 | 90 | 65 | 63 | 116 | 68 |
| rs1944279 | Imputed | A | ADD | 438 | 9 | 73 | 108 | 13 | 86 | 149 |
| rs198461 | Imputed | C | DOM | 433 | 40 | 82 | 64 | 65 | 129 | 53 |
| rs1987179 | Imputed | T | DOM | 417 | 6 | 37 | 139 | 7 | 81 | 147 |
| rs1990023 | Imputed | T | DOM | 443 | 26 | 66 | 99 | 34 | 118 | 100 |
| rs2016194 | Imputed | G | DOM | 443 | 27 | 65 | 99 | 33 | 119 | 100 |
| rs2024789 | Imputed | C | ADD | 440 | 49 | 93 | 47 | 65 | 125 | 61 |
| rs2024789 | Imputed | C | GEN | 440 | 49 | 93 | 47 | 65 | 125 | 61 |
| rs2024902 | Imputed | A | DOM | 442 | 1 | 27 | 163 | 3 | 30 | 218 |
| rs2024902 | Imputed | A | ADD | 442 | 1 | 27 | 163 | 3 | 30 | 218 |
| rs2025107 | Imputed | A | ADD | 442 | 3 | 28 | 159 | 4 | 38 | 210 |
| rs2025108 | Imputed | A | DOM | 442 | 3 | 28 | 159 | 4 | 38 | 210 |
| rs2025108 | Imputed | T | DOM | 442 | 3 | 28 | 159 | 4 | 38 | 210 |
| rs2062448 | Imputed | T | ADD | 442 | 3 | 28 | 159 | 4 | 38 | 210 |
| rs2062448 | Imputed | T | DOM | 442 | 0 | 28 | 162 | 0 | 40 | 212 |
| rs2063591 | Imputed | T | ADD | 441 | 0 | 28 | 162 | 0 | 40 | 212 |
| rs2063591 | Imputed | C | DOM | 441 | 36 | 92 | 63 | 69 | 117 | 64 |
| rs2065604 | Imputed | C | ADD | 441 | 36 | 92 | 63 | 69 | 117 | 64 |
| rs2066238 | Imputed | C | DOM | 443 | 2 | 32 | 157 | 2 | 37 | 213 |
| rs2068051 | Imputed | T | ADD | 443 | 8 | 52 | 131 | 8 | 65 | 179 |
| rs2068051 | Imputed | G | DOM | 269 | 36 | 59 | 16 | 57 | 79 | 22 |
| rs2077702 | Genotyped | G | GEN | 269 | 36 | 59 | 16 | 57 | 79 | 22 |
| rs208757 | Imputed | G | ADD | 443 | 22 | 91 | 78 | 15 | 104 | 133 |
| rs208757 | Imputed | G | GEN | 435 | 8 | 73 | 108 | 10 | 60 | 176 |
| rs2095586 | Imputed | A | DOM | 435 | 8 | 73 | 108 | 10 | 60 | 176 |
| rs2108426 | Imputed | C | ADD | 442 | 28 | 84 | 79 | 25 | 103 | 123 |
| rs2110664 | Imputed | A | DOM | 443 | 27 | 65 | 99 | 33 | 119 | 100 |
| rs2132242 | Imputed | A | DOM | 399 | 14 | 77 | 81 | 16 | 83 | 128 |
| rs2151644 | Imputed | T | DOM | 440 | 26 | 88 | 76 | 45 | 125 | 80 |
| rs2157752 | Genotyped | A | GEN | 442 | 2 | 32 | 156 | 2 | 37 | 213 |
| rs2158958 | Imputed | A | DOM | 443 | 20 | 74 | 97 | 25 | 106 | 121 |
| rs2158961 | Imputed | G | DOM | 443 | 27 | 65 | 99 | 33 | 119 | 100 |
| rs2164099 | Imputed | G | ADD | 441 | 20 | 67 | 104 | 23 | 120 | 109 |
| rs2173254 | Imputed | G | GEN | 438 | 9 | 73 | 108 | 13 | 88 | 150 |
| rs2173254 | Imputed | C | REC | 438 | 22 | 89 | 78 | 28 | 110 | 111 |
| rs2188079 | Imputed | C | ADD | 443 | 22 | 89 | 92 | 28 | 110 | 76 |
| rs2188079 | Imputed | C | GEN | 443 | 39 | 84 | 60 | 43 | 133 | 76 |
| rs2190304 | Imputed | G | REC | 443 | 39 | 84 | 60 | 43 | 133 | 76 |
| rs2190597 | Imputed | T | DOM | 440 | 50 | 83 | 58 | 50 | 138 | 64 |
| rs2190598 | Imputed | T | DOM | 443 | 42 | 74 | 72 | 53 | 126 | 73 |
| rs2190600 | Imputed | T | DOM | 443 | 27 | 65 | 99 | 33 | 119 | 100 |
| rs2218084 | Imputed | A | DOM | 440 | 27 | 65 | 98 | 35 | 118 | 97 |
| rs2218084 | Imputed | T | GEN | 440 | 11 | 44 | 135 | 5 | 75 | 170 |
| rs2236290 | Genotyped | T | REC | 440 | 11 | 44 | 135 | 5 | 75 | 170 |
| rs2243860 | Imputed | C | GEN | 441 | 16 | 89 | 86 | 40 | 112 | 98 |
| rs2246564 | Imputed | A | GEN | 354 | 33 | 70 | 49 | 30 | 94 | 78 |
| rs2248236 | Imputed | A | REC | 354 | 33 | 70 | 49 | 30 | 94 | 78 |
| rs2250340 | Imputed | T | DOM | 443 | 2 | 32 | 157 | 2 | 37 | 213 |
| rs2257192 | Imputed | C | DOM | 410 | 9 | 47 | 135 | 9 | 100 | 143 |
| rs2270584 | Imputed | G | DOM | 443 | 2 | 32 | 157 | 2 | 37 | 194 |
| | Imputed | A | DOM | 441 | 26 | 83 | 81 | 46 | 120 | 213 85 |

TABLE 11-continued

| | | | | | | | | |
|---|---|---|---|---|---|---|---|---|
| rs2270586 | Imputed | A | DOM | 442 | 26 | 84 | 46 | 120 | 85 |
| rs2270589 | Imputed | A | ADD | 391 | 30 | 83 | 62 | 109 | 50 |
| rs2270589 | Imputed | A | DOM | 391 | 30 | 83 | 62 | 109 | 50 |
| rs2270589 | Imputed | A | GEN | 391 | 30 | 83 | 62 | 109 | 50 |
| rs2296889 | Imputed | C | DOM | 437 | 10 | 48 | 7 | 74 | 169 |
| rs2301346 | Imputed | C | ADD | 357 | 12 | 61 | 16 | 73 | 108 |
| rs2301346 | Imputed | C | DOM | 357 | 12 | 61 | 16 | 73 | 108 |
| rs2327929 | Imputed | G | REC | 441 | 42 | 87 | 43 | 121 | 86 |
| rs2357486 | Imputed | C | REC | 436 | 19 | 83 | 28 | 108 | 112 |
| rs2373793 | Imputed | G | DOM | 435 | 6 | 54 | 3 | 52 | 190 |
| rs2377622 | Imputed | T | GEN | 291 | 10 | 62 | 34 | 76 | 58 |
| rs2377622 | Imputed | T | REC | 291 | 10 | 62 | 34 | 76 | 58 |
| rs2383903 | Imputed | G | DOM | 443 | 15 | 64 | 19 | 102 | 131 |
| rs2389866 | Imputed | C | DOM | 443 | 9 | 47 | 9 | 100 | 143 |
| rs2389869 | Imputed | C | DOM | 443 | 9 | 47 | 9 | 100 | 143 |
| rs2418541 | Imputed | A | DOM | 443 | 26 | 66 | 34 | 118 | 100 |
| rs2418542 | Imputed | A | DOM | 443 | 26 | 66 | 34 | 118 | 100 |
| rs2418548 | Imputed | C | DOM | 442 | 29 | 65 | 39 | 114 | 98 |
| rs2476976 | Imputed | C | DOM | 442 | 27 | 85 | 26 | 100 | 125 |
| rs2483639 | Imputed | A | DOM | 443 | 2 | 32 | 2 | 37 | 213 |
| rs2483640 | Imputed | A | DOM | 443 | 2 | 32 | 2 | 37 | 213 |
| rs2544780 | Imputed | T | REC | 442 | 23 | 81 | 11 | 113 | 127 |
| rs2586458 | Imputed | T | DOM | 372 | 2 | 42 | 4 | 44 | 168 |
| rs2593272 | Imputed | G | ADD | 443 | 12 | 63 | 19 | 85 | 148 |
| rs2593273 | Imputed | T | ADD | 426 | 12 | 60 | 17 | 73 | 148 |
| rs2622499 | Imputed | G | DOM | 443 | 9 | 47 | 9 | 100 | 143 |
| rs264126 | Imputed | T | DOM | 439 | 42 | 73 | 53 | 125 | 73 |
| rs264129 | Imputed | T | DOM | 443 | 20 | 67 | 23 | 120 | 109 |
| rs2656822 | Imputed | T | ADD | 443 | 12 | 63 | 19 | 85 | 148 |
| rs2656823 | Imputed | G | ADD | 443 | 12 | 63 | 19 | 85 | 148 |
| rs2656825 | Imputed | T | ADD | 420 | 12 | 60 | 17 | 71 | 145 |
| rs2764766 | Imputed | C | REC | 443 | 23 | 81 | 11 | 114 | 127 |
| rs2793101 | Imputed | T | ADD | 442 | 2 | 34 | 1 | 45 | 205 |
| rs2793101 | Imputed | T | DOM | 442 | 2 | 34 | 1 | 45 | 205 |
| rs2795871 | Imputed | A | ADD | 435 | 0 | 14 | 0 | 31 | 218 |
| rs2795886 | Imputed | A | ADD | 442 | 0 | 11 | 0 | 27 | 225 |
| rs2795886 | Imputed | A | ADD | 442 | 0 | 11 | 0 | 27 | 225 |
| rs2859994 | Imputed | G | GEN | 436 | 22 | 96 | 33 | 116 | 99 |
| rs2870464 | Imputed | G | DOM | 441 | 3 | 61 | 8 | 44 | 199 |
| rs2875528 | Imputed | T | DOM | 443 | 1 | 40 | 5 | 53 | 194 |
| rs2876227 | Imputed | C | ADD | 442 | 33 | 82 | 23 | 111 | 117 |
| rs2876227 | Imputed | C | GEN | 442 | 33 | 82 | 23 | 111 | 117 |
| rs2882097 | Imputed | A | DOM | 443 | 29 | 83 | 27 | 101 | 124 |
| rs2921983 | Imputed | C | ADD | 416 | 9 | 57 | 15 | 76 | 144 |
| rs2987537 | Imputed | C | DOM | 438 | 6 | 58 | 6 | 56 | 188 |
| rs2996416 | Imputed | C | ADD | 438 | 2 | 52 | 1 | 46 | 203 |
| rs2996416 | Imputed | C | DOM | 438 | 2 | 52 | 1 | 46 | 203 |
| rs3015527 | Imputed | C | ADD | 398 | 2 | 48 | 1 | 38 | 186 |
| rs3015527 | Imputed | C | DOM | 398 | 2 | 48 | 1 | 38 | 186 |
| rs3015530 | Imputed | C | ADD | 438 | 2 | 52 | 1 | 46 | 203 |
| rs3015530 | Imputed | T | ADD | 438 | 2 | 52 | 1 | 46 | 203 |
| rs3015531 | Imputed | T | DOM | 438 | 2 | 52 | 1 | 46 | 203 |
| rs3015531 | Imputed | T | DOM | 438 | 2 | 52 | 1 | 46 | 203 |

TABLE 11-continued

| SNP | Status | Allele | Model | | | | | | |
|---|---|---|---|---|---|---|---|---|---|
| rs3015535 | Imputed | C | ADD | 438 | 2 | 52 | 134 | 1 | 46 | 203 |
| rs3015535 | Imputed | C | DOM | 438 | 2 | 52 | 134 | 1 | 46 | 203 |
| rs3019407 | Imputed | A | GEN | 439 | 22 | 89 | 78 | 28 | 109 | 113 |
| rs3019407 | Imputed | A | REC | 439 | 22 | 89 | 78 | 28 | 109 | 113 |
| rs36071725 | Genotyped | C | GEN | 443 | 16 | 88 | 87 | 26 | 110 | 116 |
| rs373983 | Imputed | G | DOM | 414 | 31 | 104 | 48 | 38 | 98 | 95 |
| rs3756154 | Imputed | C | DOM | 416 | 6 | 38 | 138 | 7 | 83 | 144 |
| rs3793044 | Imputed | C | ADD | 443 | 1 | 27 | 163 | 3 | 30 | 219 |
| rs3793044 | Imputed | C | DOM | 443 | 1 | 27 | 163 | 3 | 30 | 219 |
| rs3793053 | Imputed | C | DOM | 436 | 3 | 27 | 158 | 4 | 36 | 208 |
| rs3793053 | Imputed | C | ADD | 436 | 3 | 27 | 158 | 4 | 36 | 208 |
| rs3796246 | Imputed | G | DOM | 442 | 0 | 29 | 162 | 1 | 38 | 212 |
| rs3796246 | Imputed | G | ADD | 442 | 0 | 29 | 162 | 1 | 38 | 212 |
| rs3805996 | Imputed | G | DOM | 421 | 1 | 26 | 155 | 3 | 30 | 206 |
| rs3805996 | Imputed | G | ADD | 421 | 1 | 26 | 155 | 3 | 30 | 206 |
| rs3806003 | Imputed | A | ADD | 443 | 1 | 27 | 163 | 3 | 30 | 219 |
| rs3806003 | Imputed | A | DOM | 443 | 1 | 27 | 163 | 3 | 30 | 219 |
| rs3806004 | Imputed | T | DOM | 442 | 3 | 28 | 159 | 4 | 38 | 210 |
| rs3806004 | Imputed | T | ADD | 442 | 3 | 28 | 159 | 4 | 38 | 210 |
| rs3806010 | Imputed | T | DOM | 442 | 3 | 28 | 159 | 4 | 38 | 210 |
| rs3806010 | Imputed | T | ADD | 442 | 3 | 28 | 159 | 4 | 38 | 210 |
| rs3806014 | Imputed | T | ADD | 430 | 3 | 27 | 153 | 4 | 37 | 206 |
| rs3806014 | Imputed | T | DOM | 430 | 3 | 27 | 153 | 4 | 37 | 206 |
| rs3806015 | Imputed | A | ADD | 426 | 3 | 27 | 152 | 4 | 37 | 203 |
| rs3806015 | Imputed | A | DOM | 426 | 3 | 27 | 152 | 4 | 37 | 203 |
| rs3806018 | Imputed | A | DOM | 442 | 3 | 28 | 159 | 4 | 38 | 210 |
| rs3806018 | Imputed | A | ADD | 442 | 3 | 28 | 159 | 4 | 38 | 210 |
| rs3806019 | Imputed | A | ADD | 438 | 3 | 28 | 158 | 4 | 38 | 207 |
| rs3806019 | Imputed | A | DOM | 438 | 3 | 28 | 158 | 4 | 38 | 207 |
| rs3806024 | Imputed | T | ADD | 442 | 4 | 28 | 159 | 4 | 38 | 209 |
| rs3806024 | Imputed | T | DOM | 442 | 4 | 28 | 159 | 4 | 38 | 209 |
| rs3847825 | Imputed | G | ADD | 440 | 18 | 96 | 76 | 47 | 113 | 90 |
| rs3847825 | Imputed | G | GEN | 440 | 18 | 96 | 76 | 47 | 113 | 90 |
| rs3852001 | Genotyped | C | GEN | 443 | 8 | 59 | 124 | 8 | 70 | 174 |
| rs3852001 | Genotyped | C | REC | 443 | 8 | 59 | 124 | 8 | 70 | 174 |
| rs3852002 | Imputed | G | GEN | 443 | 8 | 59 | 124 | 8 | 68 | 176 |
| rs3852002 | Imputed | G | REC | 443 | 8 | 59 | 124 | 8 | 68 | 176 |
| rs3852003 | Imputed | A | GEN | 442 | 8 | 59 | 123 | 8 | 68 | 176 |
| rs3852003 | Imputed | A | REC | 442 | 8 | 59 | 123 | 8 | 68 | 176 |
| rs3942254 | Imputed | T | DOM | 420 | 26 | 74 | 78 | 45 | 113 | 122 |
| rs3945085 | Imputed | A | DOM | 441 | 31 | 81 | 79 | 29 | 99 | 84 |
| rs399485 | Imputed | A | DOM | 437 | 10 | 91 | 89 | 15 | 86 | 146 |
| rs4029119 | Imputed | G | ADD | 443 | 3 | 22 | 166 | 7 | 23 | 222 |
| rs4029119 | Imputed | G | DOM | 443 | 3 | 22 | 166 | 7 | 23 | 222 |
| rs412791 | Imputed | C | GEN | 432 | 23 | 81 | 83 | 27 | 109 | 109 |
| rs4146972 | Genotyped | T | DOM | 443 | 7 | 66 | 118 | 7 | 57 | 188 |
| rs4259369 | Imputed | T | REC | 440 | 30 | 89 | 72 | 55 | 117 | 77 |
| rs4273613 | Imputed | T | DOM | 443 | 3 | 22 | 166 | 7 | 23 | 222 |
| rs4273613 | Imputed | T | ADD | 443 | 3 | 22 | 166 | 7 | 23 | 222 |
| rs4294022 | Genotyped | C | DOM | 441 | 14 | 67 | 108 | 18 | 88 | 146 |
| rs4310554 | Imputed | C | DOM | 443 | 56 | 100 | 35 | 63 | 123 | 66 |
| rs4315598 | Imputed | T | ADD | 443 | 34 | 80 | 77 | 24 | 109 | 119 |
| rs4315598 | Imputed | T | GEN | 443 | 34 | 80 | 77 | 24 | 109 | 119 |

TABLE 11-continued

| | | | | | | | | |
|---|---|---|---|---|---|---|---|---|
| rs4370878 | Imputed | G | DOM | 440 | 29 | 82 | 79 | 27 | 101 | 122 |
| rs4436200 | Imputed | C | ADD | 442 | 2 | 35 | 154 | 9 | 63 | 179 |
| rs4444612 | Imputed | G | ADD | 443 | 34 | 80 | 77 | 24 | 109 | 119 |
| rs4444612 | Imputed | G | GEN | 443 | 34 | 80 | 77 | 21 | 109 | 119 |
| rs4450660 | Imputed | C | DOM | 438 | 11 | 78 | 101 | 60 | 81 | 146 |
| rs4463950 | Imputed | C | DOM | 440 | 41 | 85 | 62 | 27 | 119 | 71 |
| rs4509702 | Imputed | G | DOM | 441 | 29 | 82 | 79 | 13 | 101 | 122 |
| rs4533379 | Imputed | A | ADD | 426 | 9 | 73 | 108 | 16 | 88 | 150 |
| rs4569984 | Imputed | A | DOM | 440 | 10 | 65 | 110 | 27 | 82 | 143 |
| rs4570530 | Imputed | C | DOM | 440 | 29 | 82 | 79 | 16 | 101 | 122 |
| rs4571583 | Imputed | T | DOM | 439 | 10 | 64 | 115 | 21 | 83 | 151 |
| rs4586678 | Imputed | A | DOM | 442 | 11 | 78 | 101 | 26 | 85 | 146 |
| rs4615971 | Imputed | C | DOM | 440 | 28 | 83 | 79 | 8 | 101 | 123 |
| rs4629229 | Imputed | G | DOM | 443 | 8 | 52 | 131 | 8 | 65 | 179 |
| rs4632512 | Imputed | T | GEN | 443 | 8 | 59 | 124 | 2 | 68 | 176 |
| rs4641552 | Imputed | A | ADD | 437 | 0 | 21 | 167 | 0 | 39 | 208 |
| rs4682527 | Imputed | C | DOM | 209 | 0 | 2 | 88 | 68 | 1 | 118 |
| rs4688632 | Imputed | G | REC | 429 | 38 | 79 | 68 | 12 | 98 | 78 |
| rs4702720 | Imputed | A | ADD | 359 | 10 | 48 | 97 | 12 | 85 | 107 |
| rs4702720 | Imputed | A | DOM | 359 | 10 | 48 | 97 | 5 | 85 | 107 |
| rs4714484 | Imputed | A | ADD | 439 | 3 | 49 | 137 | 5 | 73 | 172 |
| rs4714484 | Imputed | A | DOM | 439 | 3 | 49 | 137 | 32 | 73 | 172 |
| rs4725142 | Genotyped | G | REC | 443 | 28 | 81 | 82 | 31 | 105 | 115 |
| rs4725144 | Imputed | G | REC | 438 | 26 | 79 | 83 | 63 | 104 | 115 |
| rs4760785 | Imputed | A | ADD | 432 | 30 | 90 | 65 | 63 | 116 | 68 |
| rs4760785 | Imputed | A | DOM | 432 | 30 | 90 | 65 | 63 | 116 | 68 |
| rs4760894 | Imputed | T | ADD | 432 | 30 | 90 | 65 | 63 | 116 | 68 |
| rs4760894 | Imputed | T | DOM | 432 | 30 | 90 | 65 | 63 | 116 | 68 |
| rs4760895 | Imputed | A | ADD | 432 | 30 | 90 | 65 | 63 | 116 | 68 |
| rs4760895 | Imputed | A | DOM | 432 | 30 | 90 | 65 | 50 | 110 | 84 |
| rs4767184 | Imputed | C | ADD | 425 | 18 | 97 | 66 | 50 | 110 | 84 |
| rs4767184 | Imputed | C | GEN | 425 | 18 | 97 | 66 | 1 | 46 | 202 |
| rs4773487 | Imputed | T | ADD | 436 | 2 | 52 | 133 | 27 | 91 | 133 |
| rs4780547 | Imputed | G | GEN | 442 | 7 | 73 | 111 | 27 | 91 | 133 |
| rs4780547 | Imputed | G | REC | 442 | 7 | 73 | 111 | 6 | 55 | 161 |
| rs483159 | Imputed | T | DOM | 386 | 4 | 66 | 94 | 33 | 119 | 100 |
| rs4836502 | Imputed | T | DOM | 443 | 27 | 65 | 99 | 35 | 119 | 97 |
| rs4836507 | Imputed | C | DOM | 442 | 27 | 66 | 98 | 57 | 124 | 70 |
| rs4851531 | Imputed | C | DOM | 442 | 36 | 81 | 74 | 30 | 108 | 132 |
| rs4879931 | Imputed | G | ADD | 438 | 10 | 86 | 93 | 16 | 87 | 132 |
| rs489441 | Imputed | G | DOM | 409 | 11 | 78 | 85 | 16 | 87 | 115 |
| rs489441 | Imputed | G | DOM | 409 | 11 | 78 | 85 | 24 | 111 | 115 |
| rs4976276 | Imputed | T | DOM | 440 | 17 | 85 | 88 | 26 | 109 | 150 |
| rs4977681 | Imputed | C | REC | 441 | 19 | 77 | 95 | 13 | 87 | 156 |
| rs4986197 | Imputed | C | ADD | 440 | 9 | 73 | 108 | 12 | 84 | 37 |
| rs4986220 | Imputed | T | ADD | 442 | 9 | 68 | 113 | 85 | 129 | 137 |
| rs525462 | Imputed | A | GEN | 440 | 62 | 79 | 48 | 18 | 97 | 73 |
| rs552006 | Imputed | G | GEN | 443 | 11 | 78 | 102 | 60 | 119 | 215 |
| rs5756669 | Imputed | C | DOM | 443 | 54 | 84 | 53 | 2 | 34 | 119 |
| rs581905 | Imputed | T | DOM | 442 | 2 | 46 | 143 | 24 | 109 | 119 |
| rs6033138 | Imputed | C | GEN | 443 | 34 | 80 | 77 | 24 | 109 | 118 |
| rs6033138 | Imputed | C | GEN | 443 | 34 | 80 | 77 | | | |
| rs6040619 | Imputed | C | ADD | 439 | 34 | 81 | 73 | | | |

TABLE 11-continued

| SNP | Status | Allele | Model | n1 | n2 | n3 | n4 | n5 |
|---|---|---|---|---|---|---|---|---|
| rs6040619 | Imputed | C | GEN | 439 | 34 | 81 | 73 | 109 | 118 |
| rs6040625 | Imputed | T | ADD | 442 | 34 | 82 | 75 | 109 | 118 |
| rs6040625 | Imputed | T | GEN | 442 | 34 | 82 | 75 | 109 | 118 |
| rs6040630 | Imputed | A | ADD | 441 | 34 | 80 | 76 | 108 | 119 |
| rs6040630 | Imputed | A | GEN | 441 | 34 | 80 | 76 | 108 | 119 |
| rs6040633 | Imputed | A | ADD | 442 | 34 | 80 | 76 | 109 | 119 |
| rs6040633 | Imputed | A | GEN | 442 | 34 | 80 | 76 | 109 | 118 |
| rs6040634 | Imputed | T | ADD | 441 | 34 | 81 | 75 | 109 | 118 |
| rs6040634 | Imputed | T | GEN | 441 | 34 | 81 | 75 | 109 | 119 |
| rs6040636 | Imputed | T | ADD | 443 | 34 | 79 | 78 | 109 | 119 |
| rs6040636 | Imputed | T | GEN | 443 | 34 | 79 | 78 | 109 | 119 |
| rs6040638 | Imputed | C | ADD | 443 | 34 | 80 | 77 | 109 | 119 |
| rs6040638 | Imputed | C | GEN | 443 | 34 | 80 | 77 | 109 | 119 |
| rs6040644 | Imputed | A | ADD | 443 | 34 | 80 | 77 | 109 | 119 |
| rs6040644 | Imputed | A | GEN | 443 | 34 | 80 | 77 | 109 | 119 |
| rs6040667 | Imputed | T | ADD | 424 | 34 | 79 | 69 | 108 | 110 |
| rs6040667 | Imputed | T | GEN | 424 | 34 | 79 | 69 | 108 | 110 |
| rs6040668 | Imputed | C | ADD | 440 | 33 | 82 | 75 | 111 | 116 |
| rs6040668 | Imputed | C | GEN | 440 | 33 | 82 | 75 | 111 | 116 |
| rs6053005 | Imputed | C | DOM | 275 | 41 | 45 | 33 | 76 | 25 |
| rs6054405 | Imputed | A | REC | 443 | 31 | 82 | 78 | 111 | 100 |
| rs6054427 | Genotyped | G | GEN | 443 | 29 | 78 | 84 | 113 | 100 |
| rs6075186 | Imputed | G | DOM | 443 | 8 | 52 | 131 | 65 | 179 |
| rs608278 | Imputed | A | ADD | 351 | 31 | 75 | 45 | 101 | 66 |
| rs6111540 | Imputed | A | ADD | 380 | 35 | 80 | 51 | 93 | 68 |
| rs6131206 | Imputed | C | ADD | 424 | 23 | 75 | 86 | 87 | 138 |
| rs6131208 | Imputed | T | ADD | 440 | 33 | 79 | 77 | 109 | 119 |
| rs6131208 | Imputed | T | GEN | 440 | 33 | 79 | 77 | 109 | 119 |
| rs6131919 | Imputed | G | DOM | 443 | 8 | 52 | 131 | 65 | 179 |
| rs6134243 | Imputed | C | ADD | 443 | 34 | 80 | 77 | 109 | 119 |
| rs6134243 | Imputed | C | GEN | 443 | 34 | 80 | 77 | 109 | 119 |
| rs6136020 | Imputed | A | DOM | 441 | 8 | 49 | 134 | 64 | 178 |
| rs613799 | Imputed | C | DOM | 420 | 26 | 78 | 77 | 93 | 122 |
| rs644041 | Imputed | G | ADD | 402 | 11 | 77 | 83 | 87 | 128 |
| rs644041 | Imputed | G | GEN | 402 | 11 | 77 | 83 | 87 | 128 |
| rs6464377 | Imputed | C | DOM | 443 | 0 | 27 | 164 | 31 | 218 |
| rs6474230 | Imputed | T | ADD | 443 | 9 | 87 | 95 | 90 | 143 |
| rs6476565 | Imputed | A | DOM | 442 | 2 | 32 | 156 | 37 | 213 |
| rs6511286 | Imputed | T | ADD | 442 | 24 | 84 | 82 | 97 | 122 |
| rs6541829 | Genotyped | C | REC | 443 | 24 | 59 | 108 | 110 | 125 |
| rs6544721 | Imputed | G | DOM | 436 | 11 | 78 | 100 | 83 | 143 |
| rs6544728 | Imputed | T | DOM | 439 | 10 | 81 | 97 | 84 | 146 |
| rs6565910 | Imputed | G | DOM | 433 | 15 | 79 | 93 | 102 | 125 |
| rs6581985 | Imputed | G | GEN | 408 | 22 | 81 | 72 | 103 | 117 |
| rs6581985 | Imputed | G | REC | 408 | 22 | 81 | 72 | 103 | 117 |
| rs6685186 | Imputed | T | ADD | 426 | 23 | 84 | 76 | 119 | 98 |
| rs6685186 | Imputed | T | GEN | 426 | 23 | 84 | 76 | 119 | 98 |
| rs670593 | Imputed | A | REC | 442 | 19 | 59 | 64 | 109 | 93 |
| rs6722640 | Imputed | T | DOM | 441 | 37 | 107 | 73 | 125 | 68 |
| rs6746170 | Imputed | A | DOM | 408 | 11 | 81 | 96 | 86 | 144 |
| rs6757316 | Imputed | A | GEN | 431 | 31 | 108 | 46 | 130 | 80 |
| rs6805139 | Imputed | G | GEN | 442 | 67 | 81 | 43 | 101 | 74 |
| rs6808571 | Imputed | G | ADD | 440 | 5 | 47 | 138 | 61 | 186 |

TABLE 11-continued

| | | | | | | | | |
|---|---|---|---|---|---|---|---|---|
| rs6816479 | Imputed | A | REC | 430 | 22 | 76 | 85 | 36 | 99 |
| rs6865976 | Imputed | C | DOM | 401 | 38 | 92 | 44 | 46 | 61 |
| rs687047 | Imputed | C | ADD | 443 | 0 | 32 | 159 | 5 | 187 |
| rs6871041 | Imputed | G | DOM | 418 | 16 | 62 | 104 | 15 | 109 |
| rs688358 | Imputed | A | ADD | 427 | 0 | 32 | 154 | 5 | 178 |
| rs6908481 | Imputed | C | REC | 400 | 35 | 78 | 58 | 37 | 79 |
| rs6917224 | Imputed | A | ADD | 441 | 33 | 75 | 82 | 37 | 97 |
| rs6917224 | Imputed | A | GEN | 441 | 33 | 75 | 82 | 37 | 97 |
| rs6920677 | Imputed | G | DOM | 438 | 25 | 93 | 71 | 45 | 92 |
| rs6994498 | Imputed | G | DOM | 443 | 9 | 87 | 95 | 19 | 143 |
| rs6998772 | Imputed | T | DOM | 442 | 0 | 18 | 173 | 0 | 231 |
| rs7022281 | Imputed | C | ADD | 441 | 16 | 98 | 75 | 47 | 87 |
| rs7022281 | Imputed | C | GEN | 441 | 16 | 98 | 75 | 47 | 87 |
| rs7022281 | Imputed | C | REC | 441 | 16 | 98 | 75 | 47 | 87 |
| rs7043983 | Imputed | T | DOM | 438 | 2 | 30 | 156 | 2 | 212 |
| rs7077799 | Imputed | A | DOM | 442 | 29 | 83 | 79 | 27 | 123 |
| rs7088947 | Imputed | A | ADD | 436 | 0 | 14 | 173 | 0 | 218 |
| rs7089661 | Imputed | A | DOM | 442 | 28 | 84 | 79 | 25 | 123 |
| rs7102072 | Imputed | A | DOM | 439 | 10 | 78 | 101 | 18 | 132 |
| rs710832 | Genotyped | A | REC | 443 | 6 | 70 | 115 | 17 | 134 |
| rs712531 | Imputed | A | DOM | 275 | 0 | 2 | 118 | 0 | 154 |
| rs7129817 | Imputed | T | ADD | 441 | 20 | 87 | 82 | 28 | 105 |
| rs7134262 | Imputed | T | GEN | 438 | 29 | 85 | 76 | 21 | 116 |
| rs7134262 | Imputed | T | REC | 438 | 29 | 85 | 76 | 21 | 116 |
| rs7138300 | Imputed | C | ADD | 432 | 30 | 90 | 65 | 63 | 68 |
| rs7138300 | Imputed | C | DOM | 432 | 30 | 90 | 65 | 63 | 68 |
| rs722927 | Imputed | G | ADD | 435 | 0 | 21 | 165 | 1 | 217 |
| rs722927 | Imputed | G | DOM | 435 | 0 | 21 | 165 | 1 | 217 |
| rs726424 | Imputed | G | ADD | 443 | 18 | 100 | 73 | 47 | 90 |
| rs726424 | Genotyped | G | GEN | 443 | 18 | 100 | 73 | 47 | 90 |
| rs7295817 | Imputed | C | ADD | 424 | 23 | 93 | 66 | 55 | 73 |
| rs7295817 | Imputed | C | GEN | 424 | 23 | 93 | 66 | 55 | 73 |
| rs7295817 | Imputed | C | REC | 424 | 23 | 93 | 66 | 55 | 73 |
| rs7297372 | Imputed | A | ADD | 435 | 50 | 95 | 43 | 86 | 41 |
| rs7297372 | Imputed | A | GEN | 435 | 50 | 95 | 43 | 86 | 41 |
| rs7298255 | Imputed | A | ADD | 443 | 34 | 92 | 65 | 67 | 70 |
| rs7298255 | Imputed | A | DOM | 443 | 34 | 92 | 65 | 67 | 70 |
| rs7305832 | Imputed | C | GEN | 442 | 29 | 85 | 77 | 21 | 118 |
| rs7305832 | Imputed | C | REC | 425 | 23 | 55 | 105 | 16 | 123 |
| rs737542 | Imputed | A | ADD | 437 | 33 | 82 | 75 | 23 | 115 |
| rs742827 | Imputed | A | GEN | 437 | 33 | 82 | 75 | 23 | 115 |
| rs742827 | Imputed | A | DOM | 443 | 27 | 65 | 99 | 33 | 100 |
| rs7446891 | Imputed | G | ADD | 443 | 3 | 22 | 166 | 7 | 222 |
| rs7448641 | Imputed | C | DOM | 443 | 3 | 22 | 166 | 7 | 222 |
| rs7460605 | Imputed | G | DOM | 412 | 33 | 100 | 46 | 35 | 80 |
| rs7468898 | Imputed | T | ADD | 426 | 44 | 87 | 51 | 48 | 65 |
| rs7468898 | Imputed | T | GEN | 426 | 44 | 87 | 51 | 48 | 65 |
| rs7501186 | Imputed | A | DOM | 443 | 3 | 62 | 126 | 8 | 200 |
| rs755117 | Imputed | A | DOM | 418 | 7 | 39 | 135 | 10 | 161 |
| rs7557560 | Imputed | T | GEN | 437 | 14 | 48 | 126 | 12 | 154 |
| rs7557560 | Imputed | T | REC | 437 | 14 | 48 | 126 | 12 | 154 |
| rs7562462 | Imputed | T | DOM | 436 | 31 | 93 | 67 | 44 | 66 |

TABLE 11-continued

| | | | | | | | | |
|---|---|---|---|---|---|---|---|---|
| rs757173 | Genotyped | G | DOM | 443 | 23 | 100 | 68 | 26 | 93 |
| rs7607447 | Imputed | T | REC | 410 | 30 | 72 | 75 | 19 | 113 |
| rs7639053 | Imputed | A | ADD | 443 | 10 | 63 | 118 | 12 | 156 |
| rs7648163 | Imputed | C | REC | 421 | 22 | 72 | 86 | 31 | 114 |
| rs7651273 | Imputed | A | GEN | 442 | 7 | 59 | 124 | 8 | 178 |
| rs7653190 | Imputed | C | ADD | 433 | 10 | 59 | 116 | 12 | 153 |
| rs7653685 | Genotyped | C | DOM | 443 | 1 | 35 | 155 | 3 | 197 |
| rs7684899 | Imputed | C | DOM | 417 | 6 | 37 | 139 | 7 | 147 |
| rs7701604 | Imputed | G | ADD | 443 | 3 | 22 | 166 | 7 | 222 |
| rs7701604 | Imputed | G | DOM | 443 | 3 | 22 | 166 | 7 | 222 |
| rs7703676 | Imputed | C | ADD | 443 | 3 | 22 | 166 | 7 | 222 |
| rs7703676 | Imputed | C | DOM | 443 | 3 | 22 | 166 | 7 | 222 |
| rs7711358 | Imputed | A | DOM | 443 | 26 | 66 | 99 | 34 | 100 |
| rs7713251 | Imputed | C | REC | 433 | 22 | 69 | 98 | 26 | 119 |
| rs7737608 | Imputed | G | DOM | 399 | 18 | 74 | 79 | 29 | 90 |
| rs7755903 | Imputed | A | GEN | 426 | 29 | 95 | 62 | 43 | 85 |
| rs7762993 | Imputed | A | ADD | 431 | 2 | 65 | 119 | 3 | 160 |
| rs7762993 | Imputed | A | DOM | 431 | 2 | 65 | 119 | 3 | 160 |
| rs7767265 | Imputed | G | DOM | 430 | 9 | 79 | 99 | 7 | 137 |
| rs7769415 | Imputed | C | GEN | 433 | 35 | 84 | 68 | 23 | 123 |
| rs7771264 | Imputed | T | DOM | 441 | 14 | 67 | 108 | 18 | 146 |
| rs7795792 | Imputed | G | REC | 440 | 30 | 89 | 72 | 55 | 77 |
| rs7806481 | Imputed | G | REC | 443 | 50 | 83 | 58 | 50 | 64 |
| rs7808536 | Imputed | G | DOM | 409 | 8 | 59 | 112 | 7 | 160 |
| rs7814819 | Imputed | G | ADD | 250 | 1 | 25 | 80 | 1 | 128 |
| rs7814819 | Imputed | G | DOM | 250 | 1 | 25 | 80 | 1 | 128 |
| rs7815952 | Imputed | T | DOM | 442 | 0 | 18 | 173 | 0 | 231 |
| rs7834090 | Imputed | T | DOM | 442 | 0 | 18 | 173 | 0 | 231 |
| rs7859250 | Imputed | C | DOM | 442 | 2 | 32 | 156 | 2 | 213 |
| rs7863577 | Genotyped | A | ADD | 443 | 6 | 30 | 155 | 5 | 203 |
| rs7863577 | Genotyped | A | DOM | 443 | 6 | 30 | 155 | 5 | 203 |
| rs7902140 | Imputed | C | ADD | 442 | 5 | 53 | 133 | 4 | 168 |
| rs7921834 | Imputed | C | DOM | 440 | 28 | 83 | 79 | 26 | 123 |
| rs7939893 | Imputed | C | ADD | 441 | 22 | 62 | 106 | 29 | 98 |
| rs7939893 | Imputed | C | DOM | 441 | 22 | 62 | 106 | 29 | 98 |
| rs7955901 | Imputed | C | ADD | 440 | 34 | 91 | 65 | 67 | 68 |
| rs7955901 | Imputed | C | DOM | 440 | 34 | 91 | 65 | 67 | 68 |
| rs7956274 | Imputed | T | ADD | 426 | 30 | 88 | 64 | 63 | 68 |
| rs7956274 | Imputed | T | DOM | 426 | 30 | 88 | 64 | 63 | 68 |
| rs7957932 | Imputed | G | ADD | 439 | 35 | 92 | 64 | 67 | 64 |
| rs7957932 | Imputed | G | DOM | 439 | 35 | 92 | 64 | 67 | 64 |
| rs7984294 | Imputed | A | DOM | 437 | 2 | 47 | 139 | 1 | 213 |
| rs7994286 | Imputed | A | ADD | 436 | 2 | 53 | 132 | 1 | 202 |
| rs7994286 | Imputed | A | DOM | 436 | 2 | 53 | 132 | 1 | 202 |
| rs8038229 | Genotyped | A | ADD | 443 | 12 | 73 | 106 | 28 | 114 |
| rs8038229 | Genotyped | A | DOM | 443 | 12 | 73 | 106 | 28 | 114 |
| rs8043336 | Imputed | A | GEN | 418 | 23 | 82 | 73 | 35 | 101 |
| rs8054431 | Imputed | C | REC | 418 | 23 | 82 | 73 | 35 | 101 |
| rs8066502 | Imputed | T | DOM | 399 | 19 | 92 | 61 | 24 | 87 |
| rs8068714 | Imputed | T | DOM | 442 | 2 | 41 | 148 | 8 | 161 |
| rs7994286 | Imputed | T | DOM | 442 | 2 | 41 | 147 | 9 | 161 |
| rs892575 | Imputed | T | ADD | 442 | 9 | 70 | 112 | 13 | 152 |
| rs892583 | Imputed | G | ADD | 438 | 9 | 68 | 111 | 12 | 154 |

TABLE 11-continued

| | | | | | | | | |
|---|---|---|---|---|---|---|---|---|
| rs915494 | Imputed | A | ADD | 422 | 29 | 79 | 78 | 22 | 91 | 123 |
| rs915494 | Imputed | A | DOM | 422 | 29 | 79 | 78 | 22 | 91 | 123 |
| rs917295 | Imputed | G | DOM | 443 | 27 | 65 | 99 | 33 | 119 | 100 |
| rs922594 | Imputed | T | DOM | 443 | 21 | 79 | 91 | 34 | 130 | 88 |
| rs9301653 | Imputed | T | ADD | 438 | 2 | 52 | 134 | 1 | 46 | 203 |
| rs9301653 | Imputed | T | DOM | 438 | 2 | 52 | 134 | 1 | 46 | 203 |
| rs9309988 | Imputed | G | DOM | 443 | 1 | 35 | 155 | 3 | 52 | 197 |
| rs9309989 | Genotyped | C | DOM | 443 | 1 | 35 | 155 | 4 | 54 | 194 |
| rs9310221 | Imputed | A | DOM | 393 | 29 | 86 | 54 | 36 | 121 | 67 |
| rs9327555 | Imputed | T | DOM | 443 | 27 | 65 | 99 | 33 | 119 | 100 |
| rs937890 | Imputed | G | DOM | 442 | 2 | 41 | 147 | 9 | 82 | 161 |
| rs9454967 | Imputed | G | ADD | 441 | 3 | 28 | 159 | 4 | 38 | 209 |
| rs9454967 | Imputed | G | DOM | 441 | 3 | 28 | 159 | 4 | 38 | 209 |
| rs9471295 | Imputed | T | DOM | 443 | 5 | 61 | 125 | 3 | 54 | 195 |
| rs9477007 | Imputed | A | ADD | 436 | 34 | 80 | 74 | 37 | 119 | 92 |
| rs9477007 | Imputed | A | GEN | 436 | 34 | 80 | 74 | 37 | 119 | 92 |
| rs9487279 | Imputed | T | DOM | 420 | 29 | 97 | 59 | 52 | 102 | 81 |
| rs949016 | Imputed | C | ADD | 441 | 9 | 67 | 113 | 12 | 84 | 156 |
| rs9555973 | Imputed | G | ADD | 437 | 2 | 53 | 134 | 1 | 46 | 201 |
| rs9555973 | Imputed | G | DOM | 437 | 2 | 53 | 134 | 1 | 46 | 201 |
| rs9557510 | Imputed | G | ADD | 443 | 9 | 46 | 136 | 5 | 54 | 193 |
| rs9557510 | Imputed | G | DOM | 443 | 9 | 46 | 136 | 5 | 54 | 193 |
| rs9560584 | Imputed | T | DOM | 435 | 2 | 52 | 131 | 1 | 46 | 203 |
| rs9588770 | Imputed | T | DOM | 443 | 3 | 54 | 134 | 3 | 47 | 202 |
| rs9588848 | Imputed | C | ADD | 438 | 2 | 52 | 134 | 1 | 46 | 203 |
| rs9588848 | Imputed | C | DOM | 438 | 2 | 52 | 134 | 1 | 46 | 203 |
| rs966583 | Imputed | A | ADD | 439 | 26 | 87 | 77 | 44 | 125 | 80 |
| rs966583 | Imputed | A | DOM | 439 | 26 | 87 | 77 | 44 | 125 | 80 |
| rs974130 | Genotyped | A | REC | 443 | 25 | 81 | 85 | 37 | 116 | 99 |
| rs977160 | Imputed | T | ADD | 438 | 9 | 61 | 118 | 11 | 84 | 155 |
| rs9812206 | Imputed | G | ADD | 442 | 0 | 30 | 161 | 0 | 38 | 213 |
| rs9812206 | Imputed | G | DOM | 442 | 0 | 30 | 161 | 0 | 38 | 213 |
| rs9813552 | Imputed | G | ADD | 442 | 0 | 30 | 161 | 1 | 36 | 214 |
| rs9813552 | Imputed | G | DOM | 442 | 0 | 30 | 161 | 1 | 36 | 214 |

TABLE 11-continued

| | | | | | | | | |
|---|---|---|---|---|---|---|---|---|
| rs9815037 | Imputed | T | ADD | 443 | 0 | 30 | 161 | 1 | 36 | 215 |
| rs9815037 | Imputed | T | DOM | 443 | 0 | 30 | 161 | 1 | 36 | 215 |
| rs9825349 | Imputed | A | ADD | 443 | 0 | 30 | 161 | 1 | 36 | 215 |
| rs9825349 | Imputed | A | DOM | 443 | 0 | 30 | 161 | 1 | 36 | 215 |
| rs9834217 | Imputed | T | ADD | 443 | 0 | 30 | 161 | 1 | 37 | 214 |
| rs9834217 | Imputed | T | DOM | 443 | 0 | 30 | 161 | 1 | 37 | 214 |
| rs9840460 | Imputed | T | ADD | 443 | 0 | 30 | 161 | 1 | 37 | 214 |
| rs9840460 | Imputed | T | DOM | 443 | 0 | 30 | 161 | 1 | 37 | 214 |
| rs9840756 | Imputed | A | ADD | 437 | 0 | 30 | 160 | 1 | 37 | 209 |
| rs9840756 | Imputed | A | DOM | 437 | 0 | 30 | 160 | 1 | 37 | 209 |
| rs9844801 | Imputed | C | DOM | 443 | 1 | 35 | 155 | 3 | 52 | 197 |
| rs985375 | Imputed | A | GEN | 423 | 12 | 68 | 103 | 14 | 94 | 132 |
| rs9869187 | Imputed | C | ADD | 442 | 0 | 30 | 160 | 0 | 39 | 213 |
| rs9869187 | Imputed | C | DOM | 442 | 0 | 30 | 160 | 0 | 39 | 213 |
| rs9872327 | Imputed | T | DOM | 443 | 1 | 35 | 155 | 3 | 52 | 197 |
| rs9881685 | Imputed | A | ADD | 440 | 0 | 30 | 160 | 0 | 38 | 212 |
| rs9881685 | Imputed | A | DOM | 440 | 0 | 30 | 160 | 0 | 38 | 212 |
| rs9909499 | Imputed | C | DOM | 422 | 15 | 92 | 75 | 26 | 83 | 131 |
| rs9911847 | Imputed | G | DOM | 442 | 2 | 41 | 147 | 9 | 82 | 161 |
| rs9958823 | Imputed | A | ADD | 438 | 9 | 73 | 108 | 13 | 86 | 149 |
| rs9965248 | Imputed | T | ADD | 437 | 9 | 61 | 117 | 11 | 84 | 155 |

TABLE 12

| SNP rs # | SOURCE | ALLELE (A1) | MODEL | P | P(R) | OR | OR(R) | Q | I |
|---|---|---|---|---|---|---|---|---|---|
| rs198460 | Genotyped | G | RECESSIVE | 2.29E-04 | 0.000229 | 1.7469 | 1.7469 | 0.3205 | 0 |
| rs603940 | Genotyped | G | RECESSIVE | 4.77E-03 | 0.004769 | 0.6036 | 0.6036 | 0.9004 | 0 |
| rs10021016 | Genotyped | G | GENOTYPIC | 1.53E-03 | 0.001532 | 2.2715 | 2.2715 | 0.7583 | 0 |
| rs1003148 | Imputed | C | ADDITIVE | 1.09E-04 | 0.0001087 | 0.706 | 0.706 | 0.7408 | 0 |
| rs1003148 | Imputed | C | GENOTYPIC | 0.0001585 | 0.0001585 | 0.4899 | 0.4899 | 0.518 | 0 |
| rs1003148 | Imputed | C | RECESSIVE | 0.001753 | 0.00218 | 0.5819 | 0.5829 | 0.3099 | 3.02 |
| rs10046799 | Imputed | C | ADDITIVE | 3.21E-04 | 0.003933 | 0.724 | 0.7134 | 0.2084 | 36.82 |
| rs10046799 | Imputed | C | GENOTYPIC | 0.0005855 | 0.003461 | 0.5342 | 0.5221 | 0.2386 | 28.01 |
| rs10051148 | Imputed | C | DOMINANT | 1.63E-05 | 1.63E-05 | 0.5783 | 0.5783 | 0.7565 | 0 |
| rs10054055 | Imputed | T | DOMINANT | 1.71E-05 | 1.71E-05 | 0.5791 | 0.5791 | 0.7456 | 0 |
| rs10067895 | Imputed | A | DOMINANT | 1.57E-05 | 1.57E-05 | 0.5759 | 0.5759 | 0.7904 | 0 |
| rs1008705 | Imputed | C | DOMINANT | 8.42E-03 | 0.00842 | 1.4761 | 1.4761 | 0.9317 | 0 |
| rs10105871 | Imputed | C | DOMINANT | 5.40E-04 | 0.0005398 | 1.6092 | 1.6092 | 0.4959 | 0 |
| rs10116807 | Imputed | A | GENOTYPIC | 4.73E-04 | 0.0004726 | 3.0952 | 3.0952 | 0.9876 | 0 |
| rs10116807 | Imputed | A | RECESSIVE | 5.24E-04 | 5.24E-04 | 3.0277 | 3.0277 | 0.956 | 0 |
| rs10121941 | Imputed | C | DOMINANT | 7.75E-05 | 7.75E-05 | 0.5093 | 0.5093 | 0.7525 | 0 |
| rs10128638 | Genotyped | G | DOMINANT | 3.84E-04 | 0.0003837 | 0.6023 | 0.6023 | 0.6707 | 0 |
| rs1012924 | Imputed | G | ADDITIVE | 6.55E-05 | 6.55E-05 | 0.5369 | 0.5369 | 0.7455 | 0 |
| rs1012924 | Imputed | G | DOMINANT | 4.31E-05 | 4.31E-05 | 0.5009 | 0.5009 | 0.6615 | 0 |
| rs1016030 | Genotyped | G | ADDITIVE | 7.02E-05 | 7.02E-05 | 1.4487 | 1.4487 | 0.5994 | 0 |
| rs1016030 | Genotyped | G | GENOTYPIC | 8.31E-05 | 8.31E-05 | 2.1351 | 2.1351 | 0.6388 | 0 |
| rs10175558 | Imputed | A | RECESSIVE | 9.48E-05 | 9.48E-05 | 2.016 | 2.016 | 0.6946 | 0 |
| rs10183431 | Imputed | T | DOMINANT | 9.50E-05 | 9.50E-05 | 1.6438 | 1.6438 | 0.7949 | 0 |
| rs10195401 | Imputed | C | DOMINANT | 8.08E-05 | 8.08E-05 | 1.679 | 1.679 | 0.7757 | 0 |
| rs10239416 | Imputed | A | DOMINANT | 5.37E-05 | 5.37E-05 | 0.5939 | 0.5939 | 0.6861 | 0 |
| rs1032188 | Imputed | G | GENOTYPIC | 0.0003684 | 0.004755 | 0.411 | 0.3885 | 0.2102 | 36.31 |
| rs1032188 | Imputed | G | RECESSIVE | 0.0009593 | 0.01499 | 0.4495 | 0.4153 | 0.1711 | 46.62 |
| rs10468988 | Imputed | G | ADDITIVE | 2.45E-05 | 2.45E-05 | 1.5305 | 1.5305 | 0.6802 | 0 |
| rs10478919 | Imputed | G | DOMINANT | 1.10E-05 | 1.10E-05 | 0.5722 | 0.5722 | 0.6924 | 0 |
| rs10506623 | Imputed | C | DOMINANT | 1.26E-04 | 0.0001255 | 0.6039 | 0.6039 | 0.8321 | 0 |
| rs10506626 | Imputed | A | DOMINANT | 2.45E-05 | 2.45E-05 | 0.5722 | 0.5722 | 0.8985 | 0 |
| rs10509477 | Imputed | T | DOMINANT | 1.46E-04 | 0.000146 | 1.6135 | 1.6135 | 0.3224 | 0 |
| rs10511071 | Imputed | C | DOMINANT | 5.30E-05 | 8.76E-05 | 1.9326 | 1.9381 | 0.3031 | 5.72 |
| rs10511072 | Imputed | G | DOMINANT | 5.30E-05 | 8.76E-05 | 1.9326 | 1.9381 | 0.3031 | 5.72 |
| rs10511199 | Imputed | C | ADDITIVE | 9.67E-05 | 9.67E-05 | 1.5246 | 1.5246 | 0.8383 | 0 |
| rs10513283 | Imputed | G | GENOTYPIC | 8.48E-05 | 8.48E-05 | 3.6142 | 3.6142 | 0.3734 | 0 |
| rs10520072 | Imputed | T | DOMINANT | 1.41E-05 | 1.41E-05 | 0.5759 | 0.5759 | 0.7897 | 0 |
| rs1065639 | Imputed | C | DOMINANT | 6.94E-05 | 6.94E-05 | 1.7059 | 1.7059 | 0.8002 | 0 |
| rs10733846 | Imputed | G | ADDITIVE | 8.04E-06 | 8.04E-06 | 0.5881 | 0.5881 | 0.4857 | 0 |
| rs10733846 | Imputed | G | DOMINANT | 7.17E-05 | 7.17E-05 | 0.5809 | 0.5809 | 0.6915 | 0 |
| rs10737390 | Imputed | T | DOMINANT | 5.78E-05 | 5.78E-05 | 0.5929 | 0.5929 | 0.5632 | 0 |
| rs10749293 | Imputed | G | DOMINANT | 9.87E-05 | 0.0001063 | 1.6321 | 1.6316 | 0.3156 | 0.71 |
| rs10752159 | Imputed | G | DOMINANT | 0.0003712 | 0.001012 | 1.5856 | 1.5961 | 0.2786 | 14.82 |
| rs10753760 | Imputed | T | ADDITIVE | 9.28E-05 | 9.28E-05 | 1.4355 | 1.4355 | 0.8085 | 0 |
| rs10753760 | Imputed | T | GENOTYPIC | 8.65E-05 | 8.65E-05 | 2.1142 | 2.1142 | 0.8438 | 0 |
| rs10757887 | Imputed | C | DOMINANT | 8.87E-05 | 8.87E-05 | 0.604 | 0.604 | 0.8342 | 0 |
| rs10758326 | Imputed | A | ADDITIVE | 8.55E-04 | 0.0008545 | 0.7335 | 0.7335 | 0.95 | 0 |
| rs10758326 | Imputed | A | GENOTYPIC | 0.001038 | 0.001038 | 0.5194 | 0.5194 | 0.7462 | 0 |
| rs10758326 | Imputed | A | RECESSIVE | 6.13E-03 | 0.006132 | 0.603 | 0.603 | 0.5469 | 0 |
| rs10762236 | Genotyped | G | ADDITIVE | 2.14E-05 | 2.14E-05 | 0.6093 | 0.6093 | 0.584 | 0 |
| rs10765769 | Imputed | C | ADDITIVE | 2.91E-05 | 2.91E-05 | 1.474 | 1.474 | 0.756 | 0 |
| rs10765769 | Imputed | C | GENOTYPIC | 5.17E-05 | 5.17E-05 | 2.1499 | 2.1499 | 0.7054 | 0 |
| rs10784891 | Imputed | C | ADDITIVE | 0.0003093 | 0.0003093 | 0.711 | 0.711 | 0.6979 | 0 |
| rs10784891 | Imputed | C | DOMINANT | 5.54E-05 | 5.54E-05 | 0.5722 | 0.5722 | 0.9756 | 0 |
| rs10787923 | Imputed | G | DOMINANT | 6.47E-05 | 1.80E-04 | 1.6581 | 1.6522 | 0.2931 | 9.54 |
| rs10787949 | Imputed | A | DOMINANT | 1.77E-04 | 0.001337 | 1.6068 | 1.5927 | 0.2585 | 21.69 |
| rs10787951 | Imputed | G | DOMINANT | 0.0001766 | 0.001337 | 1.6068 | 1.5927 | 0.2585 | 21.69 |
| rs10787983 | Imputed | C | DOMINANT | 1.40E-04 | 0.0004442 | 1.6153 | 1.6079 | 0.2874 | 11.66 |
| rs10788380 | Imputed | C | ADDITIVE | 0.0005839 | 0.0005839 | 1.3678 | 1.3678 | 0.66 | 0 |
| rs10788380 | Imputed | C | DOMINANT | 4.48E-04 | 4.48E-04 | 1.7138 | 1.7138 | 0.8013 | 0 |
| rs10788380 | Imputed | C | GENOTYPIC | 0.0004936 | 0.0004936 | 1.8999 | 1.8999 | 0.7216 | 0 |
| rs10814418 | Imputed | G | DOMINANT | 8.78E-05 | 8.78E-05 | 0.5119 | 0.5119 | 0.7369 | 0 |
| rs10831417 | Imputed | A | ADDITIVE | 1.96E-05 | 1.96E-05 | 1.4929 | 1.4929 | 0.5559 | 0 |
| rs10831417 | Imputed | A | GENOTYPIC | 1.73E-05 | 1.73E-05 | 2.3097 | 2.3097 | 0.6056 | 0 |
| rs10831422 | Imputed | C | ADDITIVE | 5.92E-05 | 5.92E-05 | 1.4561 | 1.4561 | 0.7103 | 0 |
| rs10831422 | Imputed | C | GENOTYPIC | 4.43E-05 | 4.43E-05 | 2.2133 | 2.2133 | 0.7026 | 0 |
| rs10862931 | Imputed | C | GENOTYPIC | 9.68E-05 | 9.68E-05 | 0.4267 | 0.4267 | 0.4634 | 0 |
| rs10865197 | Imputed | C | DOMINANT | 9.34E-05 | 9.34E-05 | 1.6437 | 1.6437 | 0.7947 | 0 |
| rs10871302 | Imputed | A | DOMINANT | 0.009612 | 0.009612 | 1.4552 | 1.4552 | 0.5024 | 0 |
| rs10877463 | Imputed | C | DOMINANT | 2.64E-03 | 0.002642 | 0.6825 | 0.6825 | 0.4291 | 0 |
| rs10877468 | Imputed | C | DOMINANT | 2.82E-03 | 0.002816 | 0.6833 | 0.6833 | 0.3554 | 0 |
| rs10879240 | Imputed | C | ADDITIVE | 5.13E-04 | 0.001027 | 0.6811 | 0.6808 | 0.2896 | 10.85 |
| rs10879242 | Imputed | A | DOMINANT | 2.95E-05 | 2.95E-05 | 0.5555 | 0.5555 | 0.3862 | 0 |
| rs10879245 | Imputed | G | DOMINANT | 2.95E-05 | 2.95E-05 | 0.5555 | 0.5555 | 0.3862 | 0 |
| rs10879249 | Imputed | T | DOMINANT | 1.19E-04 | 0.0001194 | 0.6021 | 0.6021 | 0.7426 | 0 |
| rs10886452 | Imputed | A | DOMINANT | 1.77E-04 | 0.001337 | 1.6068 | 1.5927 | 0.2585 | 21.69 |
| rs10886463 | Imputed | C | DOMINANT | 1.54E-04 | 6.44E-04 | 1.6141 | 1.6047 | 0.2786 | 14.82 |

TABLE 12-continued

| SNP rs # | SOURCE | ALLELE (A1) | MODEL | P | P(R) | OR | OR(R) | Q | I |
|---|---|---|---|---|---|---|---|---|---|
| rs10886465 | Imputed | A | DOMINANT | 0.00019 | 0.0006506 | 1.604 | 1.596 | 0.2834 | 13.1 |
| rs10886526 | Imputed | C | DOMINANT | 1.74E-04 | 0.0001743 | 1.6053 | 1.6053 | 0.3255 | 0 |
| rs10902437 | Imputed | G | ADDITIVE | 1.74E-03 | 1.74E-03 | 1.3336 | 1.3336 | 0.3478 | 0 |
| rs10941126 | Imputed | G | ADDITIVE | 2.13E-05 | 2.13E-05 | 0.1976 | 0.1976 | 0.798 | 0 |
| rs10941126 | Imputed | G | DOMINANT | 3.85E-05 | 3.85E-05 | 0.2007 | 0.2007 | 0.8145 | 0 |
| rs10947871 | Imputed | A | DOMINANT | 2.08E-03 | 0.002076 | 1.5391 | 1.5391 | 0.8556 | 0 |
| rs10972978 | Imputed | G | DOMINANT | 6.77E-05 | 6.77E-05 | 0.5018 | 0.5018 | 0.7975 | 0 |
| rs10973012 | Imputed | A | DOMINANT | 7.75E-05 | 7.75E-05 | 0.5093 | 0.5093 | 0.7525 | 0 |
| rs10974028 | Genotyped | G | ADDITIVE | 9.41E-05 | 9.41E-05 | 0.6153 | 0.6153 | 0.8548 | 0 |
| rs10974028 | Genotyped | G | DOMINANT | 1.15E-05 | 1.15E-05 | 0.5349 | 0.5349 | 0.733 | 0 |
| rs11021302 | Imputed | A | ADDITIVE | 6.97E-05 | 6.97E-05 | 1.4505 | 1.4505 | 0.6892 | 0 |
| rs11021302 | Imputed | A | GENOTYPIC | 4.72E-05 | 4.72E-05 | 2.2069 | 2.2069 | 0.695 | 0 |
| rs11099644 | Imputed | G | RECESSIVE | 9.48E-05 | 9.48E-05 | 2.016 | 2.016 | 0.6946 | 0 |
| rs11138315 | Imputed | G | ADDITIVE | 0.002501 | 0.002501 | 0.6333 | 0.6333 | 0.4998 | 0 |
| rs11149802 | Imputed | T | DOMINANT | 9.61E-03 | 0.009612 | 1.4552 | 1.4552 | 0.5024 | 0 |
| rs1116596 | Imputed | T | DOMINANT | 1.10E-05 | 1.10E-05 | 0.5722 | 0.5722 | 0.6924 | 0 |
| rs11178531 | Imputed | A | ADDITIVE | 0.001066 | 0.001066 | 0.7412 | 0.7412 | 0.6947 | 0 |
| rs11178531 | Imputed | A | DOMINANT | 5.75E-05 | 5.75E-05 | 0.572 | 0.572 | 0.8111 | 0 |
| rs11178575 | Imputed | C | GENOTYPIC | 0.002546 | 0.002546 | 1.8735 | 1.8735 | 0.3907 | 0 |
| rs11178575 | Imputed | C | RECESSIVE | 0.001194 | 0.001194 | 1.8848 | 1.8848 | 0.3922 | 0 |
| rs11178577 | Imputed | T | GENOTYPIC | 0.002616 | 0.002616 | 1.87 | 1.87 | 0.3948 | 0 |
| rs11178577 | Imputed | T | RECESSIVE | 0.001154 | 0.001154 | 1.8884 | 1.8884 | 0.4001 | 0 |
| rs11178583 | Imputed | A | DOMINANT | 7.82E-05 | 7.82E-05 | 0.5918 | 0.5918 | 0.6676 | 0 |
| rs11178589 | Imputed | T | DOMINANT | 0.0001977 | 0.0001977 | 0.6108 | 0.6108 | 0.7703 | 0 |
| rs11178594 | Imputed | C | DOMINANT | 8.34E-05 | 8.34E-05 | 0.5951 | 0.5951 | 0.7778 | 0 |
| rs11178602 | Imputed | T | DOMINANT | 7.78E-05 | 7.78E-05 | 0.5942 | 0.5942 | 0.6786 | 0 |
| rs11178648 | Imputed | T | DOMINANT | 2.45E-05 | 2.45E-05 | 0.576 | 0.576 | 0.8248 | 0 |
| rs11198877 | Imputed | T | DOMINANT | 0.0001766 | 0.001337 | 1.6068 | 1.5927 | 0.2585 | 21.69 |
| rs11198942 | Imputed | T | DOMINANT | 0.0001123 | 0.0002521 | 1.6276 | 1.6227 | 0.2973 | 7.94 |
| rs11221075 | Imputed | A | ADDITIVE | 0.002456 | 0.002456 | 0.6561 | 0.6561 | 0.6722 | 0 |
| rs11242020 | Imputed | T | DOMINANT | 8.24E-06 | 8.24E-06 | 0.5675 | 0.5675 | 0.7214 | 0 |
| rs11242021 | Imputed | T | DOMINANT | 1.39E-05 | 1.39E-05 | 0.5753 | 0.5753 | 0.7864 | 0 |
| rs11242022 | Imputed | T | DOMINANT | 1.90E-05 | 1.90E-05 | 0.5805 | 0.5805 | 0.7156 | 0 |
| rs11242023 | Imputed | T | DOMINANT | 1.94E-05 | 1.94E-05 | 0.5807 | 0.5807 | 0.7577 | 0 |
| rs1149350 | Imputed | A | DOMINANT | 8.78E-05 | 8.78E-05 | 1.6713 | 1.6713 | 0.3701 | 0 |
| rs1150143 | Imputed | G | DOMINANT | 5.41E-05 | 5.41E-05 | 1.6852 | 1.6852 | 0.741 | 0 |
| rs11576627 | Imputed | T | ADDITIVE | 2.21E-04 | 0.0002213 | 1.6268 | 1.6268 | 0.4154 | 0 |
| rs11576627 | Imputed | T | DOMINANT | 0.0002026 | 0.0002026 | 1.7055 | 1.7055 | 0.4813 | 0 |
| rs11602189 | Imputed | A | DOMINANT | 5.90E-05 | 5.90E-05 | 0.6007 | 0.6007 | 0.9545 | 0 |
| rs11605163 | Imputed | A | DOMINANT | 6.08E-05 | 6.08E-05 | 2.1075 | 2.1075 | 0.8875 | 0 |
| rs11615214 | Imputed | G | ADDITIVE | 3.71E-05 | 3.71E-05 | 0.6853 | 0.6853 | 0.3765 | 0 |
| rs11615214 | Imputed | G | GENOTYPIC | 9.43E-05 | 0.001874 | 0.4648 | 0.4738 | 0.2292 | 30.83 |
| rs11642394 | Imputed | C | DOMINANT | 0.009359 | 0.009359 | 1.4572 | 1.4572 | 0.5108 | 0 |
| rs11644943 | Imputed | A | ADDITIVE | 0.001027 | 0.001027 | 1.4247 | 1.4247 | 0.3922 | 0 |
| rs11656608 | Imputed | T | DOMINANT | 4.43E-03 | 0.004428 | 0.6695 | 0.6695 | 0.7811 | 0 |
| rs11661309 | Imputed | A | ADDITIVE | 3.52E-05 | 3.52E-05 | 0.6163 | 0.6163 | 0.8488 | 0 |
| rs11661309 | Imputed | A | DOMINANT | 8.21E-05 | 8.21E-05 | 0.5852 | 0.5852 | 0.7907 | 0 |
| rs11666131 | Imputed | A | ADDITIVE | 6.47E-05 | 6.47E-05 | 1.5364 | 1.5364 | 0.8474 | 0 |
| rs11743355 | Imputed | C | ADDITIVE | 2.07E-05 | 2.07E-05 | 0.1796 | 0.1796 | 0.7144 | 0 |
| rs11743355 | Imputed | C | DOMINANT | 3.53E-05 | 3.53E-05 | 0.1817 | 0.1817 | 0.7255 | 0 |
| rs11746806 | Imputed | T | ADDITIVE | 3.41E-05 | 3.41E-05 | 0.2206 | 0.2206 | 0.9267 | 0 |
| rs11746806 | Imputed | T | DOMINANT | 6.55E-05 | 6.55E-05 | 0.2253 | 0.2253 | 0.9509 | 0 |
| rs11746959 | Imputed | T | ADDITIVE | 2.13E-05 | 2.13E-05 | 0.1976 | 0.1976 | 0.798 | 0 |
| rs11746959 | Imputed | T | DOMINANT | 3.85E-05 | 3.85E-05 | 0.2007 | 0.2007 | 0.8145 | 0 |
| rs11749272 | Imputed | T | DOMINANT | 1.23E-05 | 1.23E-05 | 0.5734 | 0.5734 | 0.7009 | 0 |
| rs11901899 | Imputed | A | DOMINANT | 0.0003007 | 0.0003007 | 1.5824 | 1.5824 | 0.3922 | 0 |
| rs11926319 | Imputed | G | ADDITIVE | 7.83E-07 | 7.83E-07 | 0.4343 | 0.4343 | 0.3992 | 0 |
| rs11926319 | Imputed | G | DOMINANT | 1.01E-06 | 1.01E-06 | 0.4237 | 0.4237 | 0.4489 | 0 |
| rs11956952 | Imputed | C | DOMINANT | 0.0009505 | 0.0009505 | 0.6564 | 0.6564 | 0.7028 | 0 |
| rs12025826 | Imputed | G | DOMINANT | 0.0005142 | 0.0005142 | 1.5794 | 1.5794 | 0.3682 | 0 |
| rs1204522 | Imputed | C | GENOTYPIC | 8.61E-05 | 8.61E-05 | 0.4353 | 0.4353 | 0.6828 | 0 |
| rs1204524 | Imputed | A | GENOTYPIC | 8.54E-05 | 8.54E-05 | 0.4351 | 0.4351 | 0.6472 | 0 |
| rs12153185 | Imputed | T | DOMINANT | 1.57E-05 | 1.57E-05 | 0.5759 | 0.5759 | 0.7904 | 0 |
| rs12182651 | Imputed | T | ADDITIVE | 7.03E-06 | 7.03E-06 | 2.1926 | 2.1926 | 0.7348 | 0 |
| rs12182651 | Imputed | T | DOMINANT | 1.21E-06 | 1.21E-06 | 2.4795 | 2.4795 | 0.5648 | 0 |
| rs12193568 | Imputed | G | DOMINANT | 0.000391 | 0.004677 | 1.7403 | 1.8042 | 0.2164 | 34.55 |
| rs12264914 | Imputed | C | DOMINANT | 1.11E-02 | 0.01109 | 0.6442 | 0.6442 | 0.505 | 0 |
| rs12307767 | Imputed | C | DOMINANT | 0.001811 | 0.001811 | 0.6667 | 0.6667 | 0.3444 | 0 |
| rs12232298 | Imputed | G | RECESSIVE | 0.0006722 | 0.006032 | 2.0566 | 2.0955 | 0.2088 | 36.69 |
| rs12407412 | Imputed | C | ADDITIVE | 0.0002213 | 0.0002213 | 1.6268 | 1.6268 | 0.4154 | 0 |
| rs12407412 | Imputed | C | DOMINANT | 2.03E-04 | 0.0002026 | 1.7055 | 1.7055 | 0.4813 | 0 |
| rs12420184 | Imputed | G | DOMINANT | 6.39E-05 | 6.39E-05 | 0.5645 | 0.5645 | 0.7037 | 0 |
| rs12422750 | Imputed | A | DOMINANT | 0.00369 | 0.00369 | 0.6919 | 0.6919 | 0.3546 | 0 |
| rs12446951 | Imputed | A | ADDITIVE | 6.52E-05 | 6.52E-05 | 2.3413 | 2.3413 | 0.3314 | 0 |
| rs12446951 | Imputed | A | DOMINANT | 0.0001226 | 0.0001226 | 2.3135 | 2.3135 | 0.3285 | 0 |
| rs12457400 | Imputed | G | DOMINANT | 0.0009766 | 0.0009766 | 0.5884 | 0.5884 | 0.6035 | 0 |
| rs12247340 | Imputed | C | DOMINANT | 8.32E-05 | 8.32E-05 | 1.6742 | 1.6742 | 0.3604 | 0 |

TABLE 12-continued

| SNP rs # | SOURCE | ALLELE (A1) | MODEL | P | P(R) | OR | OR(R) | Q | I |
|---|---|---|---|---|---|---|---|---|---|
| rs1247341 | Imputed | C | DOMINANT | 7.02E−05 | 7.02E−05 | 1.684 | 1.684 | 0.3274 | 0 |
| rs12521291 | Imputed | G | ADDITIVE | 6.67E−05 | 6.67E−05 | 0.6857 | 0.6857 | 0.9769 | 0 |
| rs12526849 | Imputed | T | ADDITIVE | 7.52E−05 | 7.52E−05 | 1.4208 | 1.4208 | 0.6829 | 0 |
| rs12526849 | Imputed | T | GENOTYPIC | 7.73E−05 | 7.73E−05 | 2.0445 | 2.0445 | 0.7856 | 0 |
| rs12543110 | Imputed | G | DOMINANT | 0.0001096 | 0.0001096 | 1.6401 | 1.6401 | 0.5183 | 0 |
| rs12678600 | Imputed | A | DOMINANT | 9.83E−05 | 9.83E−05 | 0.6104 | 0.6104 | 0.9092 | 0 |
| rs12719415 | Imputed | T | DOMINANT | 8.10E−06 | 8.10E−06 | 0.5662 | 0.5662 | 0.7128 | 0 |
| rs12831292 | Imputed | G | DOMINANT | 9.77E−05 | 9.77E−05 | 0.5982 | 0.5982 | 0.6795 | 0 |
| rs12923993 | Imputed | C | DOMINANT | 0.009359 | 0.009359 | 1.4572 | 1.4572 | 0.5108 | 0 |
| rs12936964 | Imputed | T | DOMINANT | 9.02E−05 | 9.02E−05 | 1.6688 | 1.6688 | 0.7618 | 0 |
| rs12960663 | Imputed | G | ADDITIVE | 5.61E−05 | 5.61E−05 | 0.6241 | 0.6241 | 0.7884 | 0 |
| rs13038146 | Imputed | C | ADDITIVE | 0.0005045 | 0.0005045 | 1.3708 | 1.3708 | 0.7263 | 0 |
| rs13038146 | Imputed | C | GENOTYPIC | 0.0006517 | 0.0006517 | 1.9308 | 1.9308 | 0.8764 | 0 |
| rs13134222 | Imputed | A | GENOTYPIC | 9.86E−05 | 9.86E−05 | 0.3011 | 0.3011 | 0.8224 | 0 |
| rs13172910 | Imputed | A | DOMINANT | 0.0008666 | 0.0008666 | 0.6547 | 0.6547 | 0.7269 | 0 |
| rs13194907 | Imputed | A | ADDITIVE | 1.34E−05 | 1.34E−05 | 2.303 | 2.303 | 0.9028 | 0 |
| rs13194907 | Imputed | A | DOMINANT | 5.24E−06 | 5.24E−06 | 2.505 | 2.505 | 0.845 | 0 |
| rs13195745 | Imputed | A | ADDITIVE | 1.34E−05 | 1.34E−05 | 2.303 | 2.303 | 0.9028 | 0 |
| rs13195745 | Imputed | A | DOMINANT | 5.24E−06 | 5.24E−06 | 2.505 | 2.505 | 0.845 | 0 |
| rs1321432 | Imputed | A | RECESSIVE | 3.78E−05 | 3.78E−05 | 2.1221 | 2.1221 | 0.4916 | 0 |
| rs1321457 | Imputed | G | RECESSIVE | 7.32E−05 | 7.32E−05 | 2.0656 | 2.0656 | 0.4383 | 0 |
| rs13265054 | Imputed | T | DOMINANT | 1.26E−04 | 0.0001261 | 0.6144 | 0.6144 | 0.8838 | 0 |
| rs13282131 | Imputed | C | GENOTYPIC | 6.83E−04 | 0.0006831 | 1.8412 | 1.8412 | 0.8885 | 0 |
| rs13353526 | Imputed | C | DOMINANT | 4.66E−05 | 4.66E−05 | 1.9371 | 1.9371 | 0.4192 | 0 |
| rs1336382 | Imputed | T | DOMINANT | 1.46E−04 | 1.46E−04 | 1.6135 | 1.6135 | 0.3224 | 0 |
| rs1336383 | Imputed | T | DOMINANT | 0.000146 | 0.000146 | 1.6135 | 1.6135 | 0.3224 | 0 |
| rs1336407 | Imputed | T | DOMINANT | 0.000146 | 0.000146 | 1.6135 | 1.6135 | 0.3224 | 0 |
| rs1336409 | Imputed | T | DOMINANT | 1.62E−04 | 0.0002489 | 1.6085 | 1.6059 | 0.3065 | 4.35 |
| rs1336596 | Imputed | A | DOMINANT | 5.25E−05 | 5.25E−05 | 0.5951 | 0.5951 | 0.5868 | 0 |
| rs1343560 | Imputed | T | ADDITIVE | 7.42E−05 | 7.42E−05 | 0.5393 | 0.5393 | 0.7611 | 0 |
| rs1343560 | Imputed | T | DOMINANT | 4.91E−05 | 4.91E−05 | 0.5034 | 0.5034 | 0.6771 | 0 |
| rs1361987 | Imputed | T | GENOTYPIC | 9.25E−05 | 9.25E−05 | 0.4404 | 0.4404 | 0.5591 | 0 |
| rs1386153 | Imputed | T | ADDITIVE | 8.36E−05 | 8.36E−05 | 0.6841 | 0.6841 | 0.8357 | 0 |
| rs1386153 | Imputed | T | DOMINANT | 5.01E−05 | 5.01E−05 | 0.599 | 0.599 | 0.9393 | 0 |
| rs1394015 | Imputed | C | DOMINANT | 5.43E−05 | 5.43E−05 | 1.7294 | 1.7294 | 0.6444 | 0 |
| rs1407038 | Imputed | A | RECESSIVE | 5.83E−05 | 5.83E−05 | 2.0823 | 2.0823 | 0.4381 | 0 |
| rs1407039 | Imputed | A | RECESSIVE | 9.91E−05 | 9.91E−05 | 2.0129 | 2.0129 | 0.5236 | 0 |
| rs1412802 | Imputed | T | GENOTYPIC | 0.0007205 | 0.0007205 | 0.4264 | 0.4264 | 0.7234 | 0 |
| rs1414865 | Imputed | T | DOMINANT | 0.0001766 | 0.001337 | 1.6068 | 1.5927 | 0.2585 | 21.69 |
| rs1414873 | Imputed | A | DOMINANT | 0.000122 | 0.0001815 | 1.6219 | 1.6195 | 0.3077 | 3.88 |
| rs1414876 | Imputed | C | DOMINANT | 0.000122 | 0.0001815 | 1.6219 | 1.6195 | 0.3077 | 3.88 |
| rs1418671 | Imputed | C | RECESSIVE | 9.36E−06 | 9.36E−06 | 2.1762 | 2.1762 | 0.8027 | 0 |
| rs1419490 | Genotyped | T | GENOTYPIC | 8.94E−05 | 8.94E−05 | 0.4398 | 0.4398 | 0.5307 | 0 |
| rs1434507 | Imputed | A | ADDITIVE | 7.02E−05 | 7.02E−05 | 1.4932 | 1.4932 | 0.6454 | 0 |
| rs1434508 | Imputed | T | ADDITIVE | 9.01E−05 | 9.01E−05 | 1.4841 | 1.4841 | 0.6551 | 0 |
| rs1435205 | Imputed | A | ADDITIVE | 9.67E−05 | 9.67E−05 | 1.5246 | 1.5246 | 0.8383 | 0 |
| rs1443928 | Imputed | C | RECESSIVE | 6.72E−05 | 6.72E−05 | 0.5586 | 0.5586 | 0.6157 | 0 |
| rs1452235 | Imputed | G | GENOTYPIC | 7.97E−05 | 7.97E−05 | 0.4269 | 0.4269 | 0.4549 | 0 |
| rs1452236 | Imputed | G | GENOTYPIC | 7.57E−05 | 7.57E−05 | 0.4257 | 0.4257 | 0.4487 | 0 |
| rs1452237 | Imputed | G | GENOTYPIC | 7.97E−05 | 7.97E−05 | 0.4269 | 0.4269 | 0.4549 | 0 |
| rs1452243 | Genotyped | T | GENOTYPIC | 7.97E−05 | 7.97E−05 | 0.4269 | 0.4269 | 0.4549 | 0 |
| rs1463768 | Genotyped | G | RECESSIVE | 4.61E−04 | 0.01223 | 1.8009 | 1.8886 | 0.1522 | 51.22 |
| rs1463769 | Imputed | G | RECESSIVE | 3.34E−04 | 0.007743 | 1.8295 | 1.9062 | 0.171 | 46.65 |
| rs1472435 | Imputed | A | ADDITIVE | 0.0002548 | 0.001662 | 0.5022 | 0.4908 | 0.2466 | 25.51 |
| rs1472435 | Imputed | A | DOMINANT | 5.02E−04 | 0.004002 | 0.5076 | 0.4938 | 0.2238 | 32.42 |
| rs1476714 | Imputed | A | DOMINANT | 1.19E−05 | 1.19E−05 | 0.5726 | 0.5726 | 0.7844 | 0 |
| rs1495159 | Imputed | G | ADDITIVE | 1.61E−05 | 1.61E−05 | 0.6509 | 0.6509 | 0.7963 | 0 |
| rs1495159 | Imputed | G | GENOTYPIC | 7.70E−05 | 7.70E−05 | 0.3915 | 0.3915 | 0.8463 | 0 |
| rs1495375 | Imputed | A | DOMINANT | 0.0001025 | 0.0001025 | 0.5962 | 0.5962 | 0.6659 | 0 |
| rs1495376 | Imputed | T | DOMINANT | 2.01E−05 | 2.01E−05 | 0.5347 | 0.5347 | 0.3504 | 0 |
| rs1495377 | Imputed | G | DOMINANT | 3.97E−05 | 7.56E−05 | 0.5484 | 0.5467 | 0.2993 | 7.17 |
| rs1495381 | Imputed | T | GENOTYPIC | 0.0009636 | 0.0009636 | 1.8616 | 1.8616 | 0.5241 | 0 |
| rs1495381 | Imputed | T | RECESSIVE | 0.0001018 | 0.0001018 | 1.9326 | 1.9326 | 0.6962 | 0 |
| rs1498992 | Imputed | G | DOMINANT | 1.48E−04 | 0.0001483 | 0.6213 | 0.6213 | 0.4944 | 0 |
| rs1499001 | Imputed | T | DOMINANT | 0.0001967 | 0.0001967 | 0.6214 | 0.6214 | 0.5607 | 0 |
| rs1512988 | Imputed | A | DOMINANT | 9.29E−05 | 9.29E−05 | 0.5976 | 0.5976 | 0.8745 | 0 |
| rs1512989 | Imputed | T | DOMINANT | 9.29E−05 | 9.29E−05 | 0.5976 | 0.5976 | 0.8745 | 0 |
| rs1512991 | Imputed | T | ADDITIVE | 1.02E−03 | 0.001016 | 0.7391 | 0.7391 | 0.9158 | 0 |
| rs1512991 | Imputed | T | DOMINANT | 8.22E−05 | 8.22E−05 | 0.5816 | 0.5816 | 0.9166 | 0 |
| rs1516855 | Imputed | G | RECESSIVE | 7.25E−05 | 7.25E−05 | 2.1755 | 2.1755 | 0.4759 | 0 |
| rs1527450 | Imputed | T | ADDITIVE | 2.46E−05 | 2.46E−05 | 1.486 | 1.486 | 0.5328 | 0 |
| rs1527450 | Imputed | T | GENOTYPIC | 2.19E−05 | 2.19E−05 | 2.2868 | 2.2868 | 0.5806 | 0 |
| rs1567740 | Imputed | T | DOMINANT | 8.80E−05 | 8.80E−05 | 0.596 | 0.596 | 0.8322 | 0 |
| rs1572573 | Imputed | A | ADDITIVE | 2.45E−05 | 2.45E−05 | 1.6309 | 1.6309 | 0.4087 | 0 |
| rs1572573 | Imputed | A | DOMINANT | 4.83E−06 | 4.83E−06 | 1.8564 | 1.8564 | 0.424 | 0 |
| rs1584003 | Imputed | C | DOMINANT | 3.11E−05 | 3.11E−05 | 1.8445 | 1.8445 | 0.5284 | 0 |
| rs1584005 | Imputed | C | DOMINANT | 4.62E−05 | 4.62E−05 | 1.8227 | 1.8227 | 0.5661 | 0 |

TABLE 12-continued

| SNP rs # | SOURCE | ALLELE (A1) | MODEL | P | P(R) | OR | OR(R) | Q | I |
|---|---|---|---|---|---|---|---|---|---|
| rs1585771 | Imputed | G | ADDITIVE | 8.69E-05 | 8.69E-05 | 1.4824 | 1.4824 | 0.9898 | 0 |
| rs1592015 | Imputed | G | DOMINANT | 6.94E-05 | 6.94E-05 | 0.5728 | 0.5728 | 0.3692 | 0 |
| rs1594885 | Imputed | A | ADDITIVE | 3.75E-05 | 3.75E-05 | 1.5121 | 1.5121 | 0.6724 | 0 |
| rs1603232 | Imputed | A | DOMINANT | 8.75E-05 | 8.75E-05 | 0.5656 | 0.5656 | 0.3264 | 0 |
| rs1614565 | Imputed | C | DOMINANT | 1.53E-05 | 1.53E-05 | 0.5357 | 0.5357 | 0.5207 | 0 |
| rs1648200 | Imputed | G | ADDITIVE | 0.0002847 | 0.0002847 | 1.4867 | 1.4867 | 0.9072 | 0 |
| rs16877387 | Imputed | C | GENOTYPIC | 6.36E-05 | 6.36E-05 | 2.2411 | 2.2411 | 0.7064 | 0 |
| rs16877387 | Imputed | C | RECESSIVE | 2.50E-05 | 2.50E-05 | 2.2227 | 2.2227 | 0.938 | 0 |
| rs16938626 | Imputed | G | DOMINANT | 1.07E-04 | 0.0001071 | 0.6116 | 0.6116 | 0.7404 | 0 |
| rs1694334 | Imputed | G | ADDITIVE | 8.91E-05 | 8.91E-05 | 0.6436 | 0.6436 | 0.6943 | 0 |
| rs16998821 | Imputed | C | DOMINANT | 6.94E-05 | 6.94E-05 | 0.5728 | 0.5728 | 0.3692 | 0 |
| rs1700400 | Imputed | T | ADDITIVE | 4.31E-05 | 4.31E-05 | 0.6508 | 0.6508 | 0.3976 | 0 |
| rs17007620 | Imputed | G | ADDITIVE | 2.46E-05 | 2.46E-05 | 1.6003 | 1.6003 | 0.8148 | 0 |
| rs17007620 | Imputed | G | DOMINANT | 3.02E-05 | 3.02E-05 | 1.7521 | 1.7521 | 0.9606 | 0 |
| rs17023290 | Imputed | C | DOMINANT | 5.30E-05 | 8.76E-05 | 1.9326 | 1.9381 | 0.3031 | 5.72 |
| rs17047957 | Imputed | C | DOMINANT | 0.001192 | 0.001192 | 1.5648 | 1.5648 | 0.6233 | 0 |
| rs1705237 | Imputed | A | DOMINANT | 1.05E-05 | 1.05E-05 | 0.5283 | 0.5283 | 0.5228 | 0 |
| rs1705261 | Imputed | A | GENOTYPIC | 0.0008093 | 0.0008093 | 1.8782 | 1.8782 | 0.4997 | 0 |
| rs1705261 | Imputed | A | RECESSIVE | 0.0001018 | 0.0001018 | 1.9326 | 1.9326 | 0.6962 | 0 |
| rs17076972 | Imputed | C | ADDITIVE | 6.68E-05 | 6.68E-05 | 1.4316 | 1.4316 | 0.9615 | 0 |
| rs17076972 | Imputed | C | GENOTYPIC | 4.84E-05 | 4.84E-05 | 2.0743 | 2.0743 | 0.953 | 0 |
| rs17076972 | Imputed | C | RECESSIVE | 5.68E-05 | 5.68E-05 | 1.8279 | 1.8279 | 0.9528 | 0 |
| rs17189710 | Imputed | T | ADDITIVE | 0.0005045 | 0.0005045 | 1.3708 | 1.3708 | 0.7263 | 0 |
| rs17189710 | Imputed | T | GENOTYPIC | 0.0006517 | 0.0006517 | 1.9308 | 1.9308 | 0.8764 | 0 |
| rs17196143 | Imputed | A | ADDITIVE | 8.38E-05 | 8.38E-05 | 1.5602 | 1.5602 | 0.9412 | 0 |
| rs17353809 | Imputed | G | ADDITIVE | 5.27E-05 | 5.27E-05 | 1.5478 | 1.5478 | 0.7656 | 0 |
| rs17368986 | Imputed | A | GENOTYPIC | 8.61E-05 | 8.61E-05 | 3.6103 | 3.6103 | 0.3631 | 0 |
| rs17369097 | Imputed | A | GENOTYPIC | 9.78E-05 | 9.78E-05 | 3.572 | 3.572 | 0.5084 | 0 |
| rs17434511 | Imputed | C | GENOTYPIC | 8.13E-05 | 8.13E-05 | 3.6271 | 3.6271 | 0.3688 | 0 |
| rs17434589 | Imputed | C | GENOTYPIC | 7.42E-05 | 7.42E-05 | 3.6546 | 3.6546 | 0.3705 | 0 |
| rs17434603 | Imputed | G | GENOTYPIC | 8.48E-05 | 8.48E-05 | 3.6142 | 3.6142 | 0.3734 | 0 |
| rs17434840 | Imputed | C | GENOTYPIC | 9.78E-05 | 9.78E-05 | 3.572 | 3.572 | 0.5084 | 0 |
| rs17446418 | Imputed | G | DOMINANT | 3.25E-05 | 3.25E-05 | 0.587 | 0.587 | 0.3535 | 0 |
| rs17530747 | Imputed | T | DOMINANT | 2.26E-05 | 2.63E-05 | 0.5795 | 0.5797 | 0.3143 | 1.26 |
| rs17604285 | Imputed | C | ADDITIVE | 1.05E-05 | 1.05E-05 | 0.4906 | 0.4906 | 0.4675 | 0 |
| rs17604285 | Imputed | C | DOMINANT | 9.86E-06 | 9.86E-06 | 0.4707 | 0.4707 | 0.5868 | 0 |
| rs17662322 | Imputed | T | DOMINANT | 0.0001449 | 0.0001449 | 0.6002 | 0.6002 | 0.4533 | 0 |
| rs17769826 | Imputed | T | ADDITIVE | 5.88E-05 | 5.88E-05 | 1.5431 | 1.5431 | 0.7499 | 0 |
| rs17821641 | Imputed | T | ADDITIVE | 9.67E-05 | 9.67E-05 | 1.5246 | 1.5246 | 0.8383 | 0 |
| rs1782328 | Imputed | A | ADDITIVE | 2.46E-05 | 2.46E-05 | 0.6019 | 0.6019 | 0.8261 | 0 |
| rs1796337 | Imputed | T | DOMINANT | 0.0001492 | 0.0001492 | 0.576 | 0.576 | 0.7496 | 0 |
| rs1798083 | Imputed | C | DOMINANT | 3.81E-05 | 3.81E-05 | 0.5525 | 0.5525 | 0.4283 | 0 |
| rs1798085 | Imputed | T | DOMINANT | 1.84E-05 | 1.84E-05 | 0.538 | 0.538 | 0.506 | 0 |
| rs1798086 | Imputed | T | DOMINANT | 6.52E-06 | 6.52E-06 | 0.5214 | 0.5214 | 0.5861 | 0 |
| rs1798089 | Imputed | C | GENOTYPIC | 0.0003263 | 0.0003263 | 1.9613 | 1.9613 | 0.6074 | 0 |
| rs1798089 | Imputed | C | RECESSIVE | 4.85E-05 | 4.85E-05 | 1.9649 | 1.9649 | 0.6513 | 0 |
| rs1798090 | Imputed | C | GENOTYPIC | 0.0002913 | 0.0002913 | 1.9722 | 1.9722 | 0.6702 | 0 |
| rs1798090 | Imputed | C | RECESSIVE | 6.28E-05 | 6.28E-05 | 1.941 | 1.941 | 0.6999 | 0 |
| rs1832222 | Imputed | G | DOMINANT | 0.0001402 | 0.0004442 | 1.6153 | 1.6079 | 0.2874 | 11.66 |
| rs1838104 | Imputed | A | ADDITIVE | 6.20E-05 | 6.20E-05 | 0.6927 | 0.6927 | 0.4982 | 0 |
| rs1838104 | Imputed | A | GENOTYPIC | 7.67E-05 | 7.67E-05 | 0.4828 | 0.4828 | 0.4457 | 0 |
| rs1868616 | Imputed | G | ADDITIVE | 6.07E-05 | 6.07E-05 | 0.6201 | 0.6201 | 0.3729 | 0 |
| rs1874313 | Imputed | A | DOMINANT | 7.43E-05 | 7.43E-05 | 0.5922 | 0.5922 | 0.8066 | 0 |
| rs1884902 | Imputed | C | RECESSIVE | 6.21E-05 | 6.21E-05 | 2.0651 | 2.0651 | 0.5825 | 0 |
| rs1913201 | Imputed | G | ADDITIVE | 0.0004149 | 0.0004149 | 0.7177 | 0.7177 | 0.6151 | 0 |
| rs1913201 | Imputed | G | DOMINANT | 9.54E-05 | 9.54E-05 | 0.5843 | 0.5843 | 0.9445 | 0 |
| rs1913201 | Imputed | G | GENOTYPIC | 0.001991 | 0.001991 | 0.5555 | 0.5555 | 0.4282 | 0 |
| rs1944279 | Imputed | A | ADDITIVE | 2.61E-05 | 2.61E-05 | 1.5292 | 1.5292 | 0.6713 | 0 |
| rs198461 | Imputed | C | DOMINANT | 0.0001487 | 0.0001487 | 0.5632 | 0.5632 | 0.3797 | 0 |
| rs1987179 | Imputed | T | DOMINANT | 0.003872 | 0.003872 | 0.6885 | 0.6885 | 0.8528 | 0 |
| rs1990023 | Imputed | T | DOMINANT | 8.24E-06 | 8.24E-06 | 0.5675 | 0.5675 | 0.7214 | 0 |
| rs2016194 | Imputed | G | DOMINANT | 1.39E-05 | 1.39E-05 | 0.5753 | 0.5753 | 0.7864 | 0 |
| rs2024789 | Imputed | C | ADDITIVE | 7.32E-05 | 7.32E-05 | 0.7001 | 0.7001 | 0.5939 | 0 |
| rs2024789 | Imputed | C | GENOTYPIC | 9.80E-05 | 9.80E-05 | 0.4935 | 0.4935 | 0.6182 | 0 |
| rs2024902 | Imputed | A | ADDITIVE | 3.48E-05 | 3.48E-05 | 2.1731 | 2.1731 | 0.7139 | 0 |
| rs2024902 | Imputed | A | DOMINANT | 1.02E-05 | 1.02E-05 | 2.3955 | 2.3955 | 0.7005 | 0 |
| rs2025107 | Imputed | A | ADDITIVE | 1.24E-05 | 1.24E-05 | 2.1211 | 2.1211 | 0.6401 | 0 |
| rs2025107 | Imputed | A | DOMINANT | 1.83E-06 | 1.83E-06 | 2.4108 | 2.4108 | 0.5006 | 0 |
| rs2025108 | Imputed | T | ADDITIVE | 1.24E-05 | 1.24E-05 | 2.1211 | 2.1211 | 0.6401 | 0 |
| rs2025108 | Imputed | T | DOMINANT | 1.83E-06 | 1.83E-06 | 2.4108 | 2.4108 | 0.5006 | 0 |
| rs2062448 | Imputed | T | ADDITIVE | 1.78E-05 | 1.78E-05 | 0.4975 | 0.4975 | 0.4296 | 0 |
| rs2062448 | Imputed | T | DOMINANT | 1.73E-05 | 1.73E-05 | 0.4776 | 0.4776 | 0.5425 | 0 |
| rs2063591 | Imputed | C | ADDITIVE | 0.001202 | 0.001202 | 0.7439 | 0.7439 | 0.7716 | 0 |
| rs2063591 | Imputed | C | DOMINANT | 5.22E-05 | 5.22E-05 | 0.5704 | 0.5704 | 0.86 | 0 |
| rs2065604 | Imputed | C | DOMINANT | 7.75E-05 | 7.75E-05 | 0.5093 | 0.5093 | 0.7525 | 0 |
| rs2066238 | Imputed | T | DOMINANT | 6.31E-05 | 6.31E-05 | 0.5711 | 0.5711 | 0.3613 | 0 |
| rs2068051 | Imputed | G | ADDITIVE | 3.45E-05 | 3.45E-05 | 0.6225 | 0.6225 | 0.8406 | 0 |

TABLE 12-continued

| SNP rs # | SOURCE | ALLELE (A1) | MODEL | P | P(R) | OR | OR(R) | Q | I |
|---|---|---|---|---|---|---|---|---|---|
| rs2068051 | Imputed | G | GENOTYPIC | 5.01E−05 | 5.01E−05 | 0.3895 | 0.3895 | 0.8309 | 0 |
| rs2077702 | Genotyped | G | GENOTYPIC | 0.002605 | 0.002605 | 1.8705 | 1.8705 | 0.3942 | 0 |
| rs208757 | Imputed | G | ADDITIVE | 0.001261 | 0.001261 | 1.4776 | 1.4776 | 0.5869 | 0 |
| rs208757 | Imputed | G | DOMINANT | 0.0009161 | 0.0009161 | 1.5787 | 1.5787 | 0.6624 | 0 |
| rs2095586 | Imputed | A | DOMINANT | 0.0001402 | 0.0004442 | 1.6153 | 1.6079 | 0.2874 | 11.66 |
| rs2108426 | Imputed | C | DOMINANT | 1.31E−05 | 1.31E−05 | 0.5744 | 0.5744 | 0.799 | 0 |
| rs2110664 | Imputed | A | DOMINANT | 0.0005399 | 0.0005399 | 1.568 | 1.568 | 0.6563 | 0 |
| rs2132242 | Imputed | A | DOMINANT | 0.0001181 | 0.0001181 | 0.6005 | 0.6005 | 0.7904 | 0 |
| rs2151644 | Imputed | T | DOMINANT | 7.40E−05 | 7.40E−05 | 0.5083 | 0.5083 | 0.7589 | 0 |
| rs2157752 | Genotyped | A | GENOTYPIC | 7.96E−05 | 7.96E−05 | 0.4178 | 0.4178 | 0.6318 | 0 |
| rs2158958 | Imputed | A | DOMINANT | 1.37E−05 | 1.37E−05 | 0.5753 | 0.5753 | 0.7855 | 0 |
| rs2158961 | Imputed | G | DOMINANT | 1.89E−05 | 1.89E−05 | 0.5806 | 0.5806 | 0.7575 | 0 |
| rs2164099 | Imputed | G | ADDITIVE | 3.91E−05 | 3.91E−05 | 1.51 | 1.51 | 0.6597 | 0 |
| rs2173254 | Imputed | G | GENOTYPIC | 4.24E−05 | 4.24E−05 | 0.3535 | 0.3535 | 0.8105 | 0 |
| rs2173254 | Imputed | G | RECESSIVE | 7.44E−05 | 7.44E−05 | 0.3802 | 0.3802 | 0.9734 | 0 |
| rs2188079 | Imputed | C | ADDITIVE | 1.42E−05 | 1.42E−05 | 1.4883 | 1.4883 | 0.9498 | 0 |
| rs2188079 | Imputed | C | GENOTYPIC | 1.20E−05 | 1.20E−05 | 2.2697 | 2.2697 | 0.9606 | 0 |
| rs2190304 | Imputed | G | RECESSIVE | 2.19E−05 | 9.93E−05 | 0.5028 | 0.5057 | 0.2831 | 13.22 |
| rs2190597 | Imputed | T | DOMINANT | 0.0009376 | 0.007487 | 0.6352 | 0.6427 | 0.2354 | 28.98 |
| rs2190598 | Imputed | T | DOMINANT | 1.37E−05 | 1.37E−05 | 0.5753 | 0.5753 | 0.7855 | 0 |
| rs2190600 | Imputed | A | DOMINANT | 1.57E−05 | 1.57E−05 | 0.5759 | 0.5759 | 0.7904 | 0 |
| rs2218084 | Imputed | T | GENOTYPIC | 0.0004323 | 0.0004323 | 4.066 | 4.066 | 0.7112 | 0 |
| rs2218084 | Imputed | T | RECESSIVE | 0.0006382 | 0.0006382 | 3.8693 | 3.8693 | 0.7945 | 0 |
| rs2236290 | Genotyped | C | GENOTYPIC | 0.001515 | 0.001515 | 0.5241 | 0.5241 | 0.9756 | 0 |
| rs2243860 | Imputed | A | GENOTYPIC | 0.0002795 | 0.0002795 | 2.2455 | 2.2455 | 0.9794 | 0 |
| rs2243860 | Imputed | A | RECESSIVE | 0.000191 | 0.000191 | 2.1324 | 2.1324 | 0.9082 | 0 |
| rs2246564 | Imputed | T | DOMINANT | 7.75E−05 | 7.75E−05 | 0.5093 | 0.5093 | 0.7525 | 0 |
| rs2248236 | Imputed | C | DOMINANT | 0.00556 | 0.00556 | 0.6993 | 0.6993 | 0.7827 | 0 |
| rs2250340 | Imputed | T | DOMINANT | 7.34E−05 | 7.34E−05 | 0.4999 | 0.4999 | 0.8201 | 0 |
| rs2257192 | Imputed | G | DOMINANT | 7.75E−05 | 7.75E−05 | 0.5093 | 0.5093 | 0.7525 | 0 |
| rs2270584 | Imputed | A | DOMINANT | 2.79E−05 | 2.79E−05 | 0.5781 | 0.5781 | 0.841 | 0 |
| rs2270586 | Imputed | A | DOMINANT | 2.34E−05 | 2.34E−05 | 0.5711 | 0.5711 | 0.8905 | 0 |
| rs2270589 | Imputed | A | ADDITIVE | 0.0002129 | 0.0002129 | 0.7047 | 0.7047 | 0.8921 | 0 |
| rs2270589 | Imputed | A | DOMINANT | 4.02E−06 | 4.02E−06 | 0.5172 | 0.5172 | 0.475 | 0 |
| rs2270589 | Imputed | A | GENOTYPIC | 0.0008832 | 0.0008832 | 0.5338 | 0.5338 | 0.9242 | 0 |
| rs2296889 | Imputed | C | DOMINANT | 9.73E−05 | 9.73E−05 | 1.7214 | 1.7214 | 0.635 | 0 |
| rs2301346 | Imputed | C | ADDITIVE | 1.33E−05 | 1.33E−05 | 1.592 | 1.592 | 0.8797 | 0 |
| rs2301346 | Imputed | C | DOMINANT | 8.84E−06 | 8.84E−06 | 1.8528 | 1.8528 | 0.6487 | 0 |
| rs2327929 | Imputed | G | RECESSIVE | 1.47E−05 | 1.47E−05 | 1.9741 | 1.9741 | 0.5579 | 0 |
| rs2357486 | Imputed | C | RECESSIVE | 9.81E−05 | 9.81E−05 | 2.3629 | 2.3629 | 0.3237 | 0 |
| rs2373793 | Imputed | G | DOMINANT | 0.0004772 | 0.0004772 | 1.624 | 1.624 | 0.608 | 0 |
| rs2377622 | Imputed | T | GENOTYPIC | 0.001009 | 0.001009 | 0.4327 | 0.4327 | 0.9416 | 0 |
| rs2377622 | Imputed | T | RECESSIVE | 0.001315 | 0.001315 | 0.4588 | 0.4588 | 0.779 | 0 |
| rs2383903 | Imputed | G | DOMINANT | 6.50E−05 | 6.50E−05 | 0.6039 | 0.6039 | 0.8634 | 0 |
| rs2389866 | Imputed | C | DOMINANT | 0.003524 | 0.003524 | 0.6859 | 0.6859 | 0.8694 | 0 |
| rs2389869 | Imputed | C | DOMINANT | 0.003524 | 0.003524 | 0.6859 | 0.6859 | 0.8694 | 0 |
| rs2418541 | Imputed | A | DOMINANT | 1.10E−05 | 1.10E−05 | 0.5722 | 0.5722 | 0.6924 | 0 |
| rs2418542 | Imputed | A | DOMINANT | 1.10E−05 | 1.10E−05 | 0.5722 | 0.5722 | 0.6924 | 0 |
| rs2418548 | Imputed | C | DOMINANT | 6.29E−05 | 6.29E−05 | 0.5957 | 0.5957 | 0.6795 | 0 |
| rs2476976 | Imputed | C | DOMINANT | 0.0002836 | 0.0002836 | 1.5809 | 1.5809 | 0.3487 | 0 |
| rs2483639 | Imputed | A | DOMINANT | 7.75E−05 | 7.75E−05 | 0.5093 | 0.5093 | 0.7525 | 0 |
| rs2483640 | Imputed | A | DOMINANT | 7.75E−05 | 7.75E−05 | 0.5093 | 0.5093 | 0.7525 | 0 |
| rs2544780 | Imputed | T | RECESSIVE | 0.003543 | 0.003543 | 1.8115 | 1.8115 | 0.7962 | 0 |
| rs2586458 | Imputed | T | DOMINANT | 9.34E−05 | 9.34E−05 | 0.471 | 0.471 | 0.709 | 0 |
| rs2593272 | Imputed | G | ADDITIVE | 7.80E−05 | 7.80E−05 | 0.6664 | 0.6664 | 0.4045 | 0 |
| rs2593273 | Imputed | T | ADDITIVE | 5.67E−05 | 5.67E−05 | 0.658 | 0.658 | 0.4571 | 0 |
| rs2622499 | Imputed | G | DOMINANT | 0.006454 | 0.006454 | 0.7042 | 0.7042 | 0.7526 | 0 |
| rs264126 | Imputed | C | DOMINANT | 0.0009755 | 0.0163 | 0.6364 | 0.6476 | 0.1951 | 40.44 |
| rs264129 | Imputed | T | DOMINANT | 1.71E−05 | 1.71E−05 | 0.5791 | 0.5791 | 0.7456 | 0 |
| rs2656822 | Imputed | T | ADDITIVE | 7.80E−05 | 7.80E−05 | 0.6664 | 0.6664 | 0.4045 | 0 |
| rs2656823 | Imputed | G | ADDITIVE | 7.80E−05 | 7.80E−05 | 0.6664 | 0.6664 | 0.4045 | 0 |
| rs2656825 | Imputed | T | ADDITIVE | 7.13E−05 | 7.13E−05 | 0.6492 | 0.6492 | 0.3189 | 0 |
| rs2764766 | Imputed | C | RECESSIVE | 0.003593 | 0.003593 | 1.7939 | 1.7939 | 0.9717 | 0 |
| rs2793101 | Imputed | T | ADDITIVE | 6.64E−05 | 6.64E−05 | 0.545 | 0.545 | 0.5015 | 0 |
| rs2793101 | Imputed | T | DOMINANT | 9.02E−05 | 9.02E−05 | 0.5344 | 0.5344 | 0.5893 | 0 |
| rs2795871 | Imputed | A | ADDITIVE | 0.0002982 | 0.0014 | 0.504 | 0.4941 | 0.2612 | 20.77 |
| rs2795886 | Imputed | A | ADDITIVE | 0.0002045 | 0.0002045 | 0.4388 | 0.4388 | 0.3702 | 0 |
| rs2795886 | Imputed | A | DOMINANT | 0.0003345 | 0.0003345 | 0.4401 | 0.4401 | 0.3569 | 0 |
| rs2859994 | Imputed | C | GENOTYPIC | 8.11E−05 | 8.11E−05 | 2.2234 | 2.2234 | 0.9879 | 0 |
| rs2870464 | Imputed | G | DOMINANT | 0.007714 | 0.007714 | 1.4837 | 1.4837 | 0.7312 | 0 |
| rs2875528 | Imputed | T | DOMINANT | 5.30E−05 | 8.76E−05 | 1.9326 | 1.9381 | 0.3031 | 5.72 |
| rs2876227 | Imputed | C | ADDITIVE | 0.0003398 | 0.0003398 | 1.3941 | 1.3941 | 0.991 | 0 |
| rs2876227 | Imputed | C | GENOTYPIC | 0.0005058 | 0.0005058 | 1.9894 | 1.9894 | 0.6903 | 0 |
| rs2882097 | Imputed | A | DOMINANT | 0.000146 | 0.000146 | 1.6135 | 1.6135 | 0.3224 | 0 |
| rs2921983 | Imputed | C | ADDITIVE | 3.03E−05 | 3.03E−05 | 0.6367 | 0.6367 | 0.4592 | 0 |
| rs2987537 | Imputed | C | DOMINANT | 5.27E−05 | 5.27E−05 | 0.5308 | 0.5308 | 0.6212 | 0 |
| rs2996416 | Imputed | C | ADDITIVE | 6.90E−05 | 6.90E−05 | 0.5379 | 0.5379 | 0.7323 | 0 |

TABLE 12-continued

| SNP rs # | SOURCE | ALLELE (A1) | MODEL | P | P(R) | OR | OR(R) | Q | I |
|---|---|---|---|---|---|---|---|---|---|
| rs2996416 | Imputed | C | DOMINANT | 4.54E−05 | 4.54E−05 | 0.5019 | 0.5019 | 0.6494 | 0 |
| rs3015527 | Imputed | C | ADDITIVE | 8.85E−05 | 8.85E−05 | 0.5427 | 0.5427 | 0.6864 | 0 |
| rs3015527 | Imputed | C | DOMINANT | 6.15E−05 | 6.15E−05 | 0.5073 | 0.5073 | 0.6044 | 0 |
| rs3015530 | Imputed | C | ADDITIVE | 6.55E−05 | 6.55E−05 | 0.5369 | 0.5369 | 0.7455 | 0 |
| rs3015530 | Imputed | C | DOMINANT | 4.31E−05 | 4.31E−05 | 0.5009 | 0.5009 | 0.6615 | 0 |
| rs3015531 | Imputed | T | ADDITIVE | 6.55E−05 | 6.55E−05 | 0.5369 | 0.5369 | 0.7455 | 0 |
| rs3015531 | Imputed | T | DOMINANT | 4.31E−05 | 4.31E−05 | 0.5009 | 0.5009 | 0.6615 | 0 |
| rs3015535 | Imputed | C | ADDITIVE | 6.55E−05 | 6.55E−05 | 0.5369 | 0.5369 | 0.7455 | 0 |
| rs3015535 | Imputed | C | DOMINANT | 4.31E−05 | 4.31E−05 | 0.5009 | 0.5009 | 0.6615 | 0 |
| rs3019407 | Imputed | A | GENOTYPIC | 3.61E−05 | 3.61E−05 | 0.3507 | 0.3507 | 0.848 | 0 |
| rs3019407 | Imputed | A | RECESSIVE | 5.80E−05 | 5.80E−05 | 0.3753 | 0.3753 | 0.9087 | 0 |
| rs36071725 | Genotyped | C | GENOTYPIC | 2.77E−05 | 2.77E−05 | 2.4392 | 2.4392 | 0.3383 | 0 |
| rs373983 | Imputed | G | DOMINANT | 0.0002104 | 0.02216 | 1.6446 | 1.5957 | 0.1398 | 54.13 |
| rs3756154 | Imputed | C | DOMINANT | 0.003524 | 0.003524 | 0.6859 | 0.6859 | 0.8694 | 0 |
| rs3793044 | Imputed | C | ADDITIVE | 1.34E−05 | 1.34E−05 | 2.303 | 2.303 | 0.9028 | 0 |
| rs3793044 | Imputed | C | DOMINANT | 5.24E−06 | 5.24E−06 | 2.505 | 2.505 | 0.845 | 0 |
| rs3793053 | Imputed | C | ADDITIVE | 2.09E−05 | 2.09E−05 | 2.0984 | 2.0984 | 0.7421 | 0 |
| rs3793053 | Imputed | C | DOMINANT | 4.49E−06 | 4.49E−06 | 2.3534 | 2.3534 | 0.5617 | 0 |
| rs3796246 | Imputed | G | ADDITIVE | 2.47E−06 | 6.16E−06 | 0.4525 | 0.4504 | 0.2993 | 7.17 |
| rs3796246 | Imputed | G | DOMINANT | 2.87E−06 | 2.87E−06 | 0.4415 | 0.4415 | 0.3413 | 0 |
| rs3805996 | Imputed | G | ADDITIVE | 2.67E−05 | 2.67E−05 | 2.2289 | 2.2289 | 0.7845 | 0 |
| rs3805996 | Imputed | G | DOMINANT | 6.94E−06 | 6.94E−06 | 2.4684 | 2.4684 | 0.7822 | 0 |
| rs3806003 | Imputed | A | ADDITIVE | 1.34E−05 | 1.34E−05 | 2.303 | 2.303 | 0.9028 | 0 |
| rs3806003 | Imputed | A | DOMINANT | 5.24E−06 | 5.24E−06 | 2.505 | 2.505 | 0.845 | 0 |
| rs3806004 | Imputed | T | ADDITIVE | 8.98E−06 | 8.98E−06 | 2.1456 | 2.1456 | 0.5726 | 0 |
| rs3806004 | Imputed | T | DOMINANT | 1.26E−06 | 1.26E−06 | 2.4405 | 2.4405 | 0.4411 | 0 |
| rs3806010 | Imputed | T | ADDITIVE | 1.24E−05 | 1.24E−05 | 2.1211 | 2.1211 | 0.6401 | 0 |
| rs3806010 | Imputed | T | DOMINANT | 1.83E−06 | 1.83E−06 | 2.4108 | 2.4108 | 0.5006 | 0 |
| rs3806014 | Imputed | T | ADDITIVE | 1.24E−05 | 1.24E−05 | 2.1211 | 2.1211 | 0.6401 | 0 |
| rs3806014 | Imputed | T | DOMINANT | 1.83E−06 | 1.83E−06 | 2.4108 | 2.4108 | 0.5006 | 0 |
| rs3806015 | Imputed | A | ADDITIVE | 1.24E−05 | 1.24E−05 | 2.1211 | 2.1211 | 0.6401 | 0 |
| rs3806015 | Imputed | A | DOMINANT | 1.83E−06 | 1.83E−06 | 2.4108 | 2.4108 | 0.5006 | 0 |
| rs3806018 | Imputed | A | ADDITIVE | 1.24E−05 | 1.24E−05 | 2.1211 | 2.1211 | 0.6401 | 0 |
| rs3806018 | Imputed | A | DOMINANT | 1.83E−06 | 1.83E−06 | 2.4108 | 2.4108 | 0.5006 | 0 |
| rs3806019 | Imputed | A | ADDITIVE | 4.82E−06 | 4.82E−06 | 2.2211 | 2.2211 | 0.774 | 0 |
| rs3806019 | Imputed | A | DOMINANT | 7.89E−07 | 7.89E−07 | 2.5148 | 2.5148 | 0.6004 | 0 |
| rs3806024 | Imputed | T | ADDITIVE | 2.13E−05 | 2.13E−05 | 2.0967 | 2.0967 | 0.7474 | 0 |
| rs3806024 | Imputed | T | DOMINANT | 4.58E−06 | 4.58E−06 | 2.3513 | 2.3513 | 0.5665 | 0 |
| rs3847825 | Imputed | G | ADDITIVE | 0.0001755 | 0.0001755 | 0.7117 | 0.7117 | 0.6477 | 0 |
| rs3847825 | Imputed | G | GENOTYPIC | 0.0004069 | 0.0004069 | 0.504 | 0.504 | 0.39 | 0 |
| rs3852001 | Genotyped | C | GENOTYPIC | 5.01E−05 | 5.01E−05 | 3.7361 | 3.7361 | 0.4411 | 0 |
| rs3852001 | Genotyped | C | RECESSIVE | 6.81E−05 | 6.81E−05 | 3.6068 | 3.6068 | 0.5248 | 0 |
| rs3852002 | Imputed | G | GENOTYPIC | 6.98E−05 | 6.98E−05 | 3.6551 | 3.6551 | 0.4732 | 0 |
| rs3852002 | Imputed | G | RECESSIVE | 9.73E−05 | 9.73E−05 | 3.5189 | 3.5189 | 0.5652 | 0 |
| rs3852003 | Imputed | A | GENOTYPIC | 6.98E−05 | 6.98E−05 | 3.6551 | 3.6551 | 0.4732 | 0 |
| rs3852003 | Imputed | A | RECESSIVE | 9.73E−05 | 9.73E−05 | 3.5189 | 3.5189 | 0.5652 | 0 |
| rs3942254 | Imputed | T | DOMINANT | 0.0001204 | 0.0001204 | 0.5984 | 0.5984 | 0.9786 | 0 |
| rs3945085 | Imputed | A | DOMINANT | 8.89E−05 | 8.89E−05 | 1.637 | 1.637 | 0.3315 | 0 |
| rs399485 | Imputed | A | DOMINANT | 0.001889 | 0.001889 | 1.4784 | 1.4784 | 0.6793 | 0 |
| rs4029119 | Imputed | G | ADDITIVE | 2.71E−05 | 2.71E−05 | 0.1993 | 0.1993 | 0.5787 | 0 |
| rs4029119 | Imputed | G | DOMINANT | 5.28E−05 | 5.28E−05 | 0.203 | 0.203 | 0.5644 | 0 |
| rs412791 | Imputed | C | GENOTYPIC | 9.99E−05 | 9.99E−05 | 0.4339 | 0.4339 | 0.5099 | 0 |
| rs4146972 | Genotyped | T | DOMINANT | 0.003205 | 0.003205 | 1.4961 | 1.4961 | 0.5773 | 0 |
| rs4259369 | Imputed | C | RECESSIVE | 0.0002939 | 0.00425 | 0.557 | 0.5415 | 0.2009 | 38.87 |
| rs4273613 | Imputed | T | ADDITIVE | 3.41E−05 | 3.41E−05 | 0.2206 | 0.2206 | 0.9267 | 0 |
| rs4273613 | Imputed | T | DOMINANT | 6.55E−05 | 6.55E−05 | 0.2253 | 0.2253 | 0.9509 | 0 |
| rs4294022 | Imputed | C | DOMINANT | 8.50E−05 | 8.50E−05 | 0.6007 | 0.6007 | 0.6113 | 0 |
| rs4310554 | Genotyped | C | DOMINANT | 0.0005487 | 0.0005487 | 1.6987 | 1.6987 | 0.7993 | 0 |
| rs4315598 | Imputed | T | ADDITIVE | 0.0005594 | 0.0005594 | 1.3676 | 1.3676 | 0.7519 | 0 |
| rs4315598 | Imputed | T | GENOTYPIC | 0.0006963 | 0.0006963 | 1.9242 | 1.9242 | 0.8583 | 0 |
| rs4370878 | Imputed | G | DOMINANT | 0.0001382 | 0.0001382 | 1.6143 | 1.6143 | 0.3748 | 0 |
| rs4436200 | Imputed | C | ADDITIVE | 0.00342 | 0.00342 | 0.6695 | 0.6695 | 0.4811 | 0 |
| rs4444612 | Imputed | G | ADDITIVE | 0.0005045 | 0.0005045 | 1.3708 | 1.3708 | 0.7263 | 0 |
| rs4444612 | Imputed | G | GENOTYPIC | 0.0006517 | 0.0006517 | 1.9308 | 1.9308 | 0.8764 | 0 |
| rs4450660 | Imputed | C | DOMINANT | 5.07E−05 | 5.07E−05 | 1.6768 | 1.6768 | 0.885 | 0 |
| rs4463950 | Imputed | C | DOMINANT | 9.57E−05 | 9.57E−05 | 0.5933 | 0.5933 | 0.705 | 0 |
| rs4509702 | Imputed | C | DOMINANT | 0.0001382 | 0.0001382 | 1.6143 | 1.6143 | 0.3748 | 0 |
| rs4533379 | Imputed | G | ADDITIVE | 3.75E−05 | 3.75E−05 | 1.5121 | 1.5121 | 0.6724 | 0 |
| rs4569984 | Imputed | A | DOMINANT | 7.78E−05 | 7.78E−05 | 0.5998 | 0.5998 | 0.4464 | 0 |
| rs4570530 | Imputed | C | DOMINANT | 0.0001225 | 0.0001225 | 1.6207 | 1.6207 | 0.3622 | 0 |
| rs4571583 | Imputed | T | DOMINANT | 9.79E−05 | 9.79E−05 | 0.6041 | 0.6041 | 0.5 | 0 |
| rs4586678 | Imputed | A | DOMINANT | 6.09E−05 | 6.09E−05 | 1.6655 | 1.6655 | 0.8543 | 0 |
| rs4615971 | Imputed | C | DOMINANT | 0.0001283 | 0.0006247 | 1.6223 | 1.612 | 0.275 | 16.09 |
| rs4629229 | Imputed | G | DOMINANT | 6.31E−05 | 6.31E−05 | 0.5711 | 0.5711 | 0.3613 | 0 |
| rs4632512 | Imputed | T | GENOTYPIC | 9.78E−05 | 9.78E−05 | 3.572 | 3.572 | 0.5084 | 0 |
| rs4641552 | Imputed | A | ADDITIVE | 0.0002608 | 0.0002608 | 0.5241 | 0.5241 | 0.9002 | 0 |
| rs4682527 | Imputed | C | DOMINANT | 8.72E−05 | 8.72E−05 | 1.6904 | 1.6904 | 0.7615 | 0 |

TABLE 12-continued

| SNP rs # | SOURCE | ALLELE (A1) | MODEL | P | P(R) | OR | OR(R) | Q | I |
|---|---|---|---|---|---|---|---|---|---|
| rs4688632 | Imputed | G | RECESSIVE | 0.0003309 | 0.0003309 | 0.5825 | 0.5825 | 0.5195 | 0 |
| rs4702720 | Imputed | A | ADDITIVE | 0.0001627 | 0.0001627 | 0.6287 | 0.6287 | 0.5601 | 0 |
| rs4702720 | Imputed | A | DOMINANT | 0.0004444 | 0.0004444 | 0.5961 | 0.5961 | 0.3979 | 0 |
| rs4714484 | Imputed | A | ADDITIVE | 6.98E−05 | 6.98E−05 | 0.6183 | 0.6183 | 0.8333 | 0 |
| rs4714484 | Imputed | A | DOMINANT | 5.02E−05 | 5.02E−05 | 0.5696 | 0.5696 | 0.55 | 0 |
| rs4725142 | Genotyped | G | RECESSIVE | 7.87E−05 | 7.87E−05 | 0.4243 | 0.4243 | 0.7642 | 0 |
| rs4725144 | Imputed | G | RECESSIVE | 6.02E−05 | 6.02E−05 | 0.4125 | 0.4125 | 0.8332 | 0 |
| rs4760785 | Imputed | A | ADDITIVE | 0.0006364 | 0.0006364 | 0.728 | 0.728 | 0.7009 | 0 |
| rs4760785 | Imputed | A | DOMINANT | 0.0001126 | 0.0001126 | 0.5881 | 0.5881 | 0.915 | 0 |
| rs4760894 | Imputed | T | ADDITIVE | 0.0006364 | 0.0006364 | 0.728 | 0.728 | 0.7009 | 0 |
| rs4760894 | Imputed | T | DOMINANT | 0.0001126 | 0.0001126 | 0.5881 | 0.5881 | 0.915 | 0 |
| rs4760895 | Imputed | A | ADDITIVE | 0.0006364 | 0.0006364 | 0.728 | 0.728 | 0.7009 | 0 |
| rs4760895 | Imputed | A | DOMINANT | 0.0001126 | 0.0001126 | 0.5881 | 0.5881 | 0.915 | 0 |
| rs4767184 | Imputed | C | ADDITIVE | 0.0002343 | 0.0002343 | 0.7168 | 0.7168 | 0.7754 | 0 |
| rs4767184 | Imputed | C | GENOTYPIC | 0.0008747 | 0.0008747 | 0.5298 | 0.5298 | 0.5351 | 0 |
| rs4773487 | Imputed | T | ADDITIVE | 9.48E−05 | 9.48E−05 | 0.5543 | 0.5543 | 0.9938 | 0 |
| rs4780547 | Imputed | G | GENOTYPIC | 0.002606 | 0.002606 | 0.3778 | 0.3778 | 0.4518 | 0 |
| rs4780547 | Imputed | G | RECESSIVE | 0.002641 | 0.002641 | 0.3832 | 0.3832 | 0.5083 | 0 |
| rs483159 | Imputed | T | DOMINANT | 0.001618 | 0.01337 | 1.5311 | 1.5114 | 0.2239 | 32.38 |
| rs4836502 | Imputed | T | DOMINANT | 1.37E−05 | 1.37E−05 | 0.5753 | 0.5753 | 0.7855 | 0 |
| rs4836507 | Imputed | C | DOMINANT | 1.68E−05 | 1.68E−05 | 0.5765 | 0.5765 | 0.7813 | 0 |
| rs4851531 | Imputed | T | DOMINANT | 0.00133 | 0.00133 | 0.6585 | 0.6585 | 0.3468 | 0 |
| rs4879931 | Imputed | G | ADDITIVE | 0.0002697 | 0.0002697 | 0.7001 | 0.7001 | 0.5714 | 0 |
| rs489441 | Imputed | G | ADDITIVE | 6.35E−05 | 6.35E−05 | 1.5268 | 1.5268 | 0.8611 | 0 |
| rs489441 | Imputed | G | DOMINANT | 5.90E−05 | 5.90E−05 | 1.6921 | 1.6921 | 0.6161 | 0 |
| rs4976276 | Imputed | T | ADDITIVE | 8.75E−05 | 8.75E−05 | 1.4687 | 1.4687 | 0.8689 | 0 |
| rs4977681 | Imputed | C | RECESSIVE | 9.61E−05 | 9.61E−05 | 2.314 | 2.314 | 0.6823 | 0 |
| rs4986197 | Imputed | G | ADDITIVE | 3.97E−05 | 3.97E−05 | 1.5105 | 1.5105 | 0.6441 | 0 |
| rs4986220 | Imputed | T | ADDITIVE | 5.91E−05 | 5.91E−05 | 1.5005 | 1.5005 | 0.7465 | 0 |
| rs525462 | Imputed | A | GENOTYPIC | 0.0007973 | 0.004961 | 0.5445 | 0.5308 | 0.2306 | 30.4 |
| rs552006 | Imputed | G | GENOTYPIC | 9.06E−05 | 9.06E−05 | 2.4662 | 2.4662 | 0.4679 | 0 |
| rs5756669 | Imputed | C | DOMINANT | 7.71E−05 | 7.71E−05 | 1.7362 | 1.7362 | 0.7477 | 0 |
| rs581905 | Imputed | T | DOMINANT | 0.008112 | 0.008112 | 1.5819 | 1.5819 | 0.4663 | 0 |
| rs6033138 | Imputed | C | ADDITIVE | 0.0005045 | 0.0005045 | 1.3708 | 1.3708 | 0.7263 | 0 |
| rs6033138 | Imputed | C | GENOTYPIC | 0.0006517 | 0.0006517 | 1.9308 | 1.9308 | 0.8764 | 0 |
| rs6040619 | Imputed | C | ADDITIVE | 0.000474 | 0.000474 | 1.3729 | 1.3729 | 0.7285 | 0 |
| rs6040619 | Imputed | C | GENOTYPIC | 0.0005591 | 0.0005591 | 1.9442 | 1.9442 | 0.9167 | 0 |
| rs6040625 | Imputed | T | ADDITIVE | 0.0003079 | 0.0003079 | 1.3859 | 1.3859 | 0.7073 | 0 |
| rs6040625 | Imputed | T | GENOTYPIC | 0.000416 | 0.000416 | 1.9717 | 1.9717 | 0.9604 | 0 |
| rs6040630 | Imputed | A | ADDITIVE | 0.0003026 | 0.0003026 | 1.3874 | 1.3874 | 0.7384 | 0 |
| rs6040630 | Imputed | A | GENOTYPIC | 0.0004609 | 0.0004609 | 1.9676 | 1.9676 | 0.9146 | 0 |
| rs6040633 | Imputed | A | ADDITIVE | 0.0003456 | 0.0003456 | 1.3823 | 1.3823 | 0.78 | 0 |
| rs6040633 | Imputed | A | GENOTYPIC | 0.0005613 | 0.0005613 | 1.945 | 1.945 | 0.8535 | 0 |
| rs6040634 | Imputed | T | ADDITIVE | 0.00085 | 0.00085 | 1.3491 | 1.3491 | 0.6301 | 0 |
| rs6040634 | Imputed | T | GENOTYPIC | 0.001411 | 0.001411 | 1.8378 | 1.8378 | 0.9672 | 0 |
| rs6040636 | Imputed | T | ADDITIVE | 0.0007597 | 0.0007597 | 1.3531 | 1.3531 | 0.6477 | 0 |
| rs6040636 | Imputed | T | GENOTYPIC | 0.001336 | 0.001336 | 1.8436 | 1.8436 | 0.9771 | 0 |
| rs6040638 | Imputed | C | ADDITIVE | 0.0005045 | 0.0005045 | 1.3708 | 1.3708 | 0.7263 | 0 |
| rs6040638 | Imputed | C | GENOTYPIC | 0.0006517 | 0.0006517 | 1.9308 | 1.9308 | 0.8764 | 0 |
| rs6040644 | Imputed | A | ADDITIVE | 0.0005045 | 0.0005045 | 1.3708 | 1.3708 | 0.7263 | 0 |
| rs6040644 | Imputed | A | GENOTYPIC | 0.0006517 | 0.0006517 | 1.9308 | 1.9308 | 0.8764 | 0 |
| rs6040667 | Imputed | T | ADDITIVE | 0.0002261 | 0.0002261 | 1.4034 | 1.4034 | 0.9253 | 0 |
| rs6040667 | Imputed | T | GENOTYPIC | 0.0003915 | 0.0003915 | 2.0113 | 2.0113 | 0.742 | 0 |
| rs6040668 | Imputed | C | ADDITIVE | 0.0002261 | 0.0002261 | 1.4034 | 1.4034 | 0.9253 | 0 |
| rs6040668 | Imputed | C | GENOTYPIC | 0.0003915 | 0.0003915 | 2.0113 | 2.0113 | 0.742 | 0 |
| rs6053005 | Imputed | C | DOMINANT | 0.00111 | 0.01291 | 0.5203 | 0.5059 | 0.1794 | 44.53 |
| rs6054405 | Imputed | A | RECESSIVE | 5.03E−05 | 5.03E−05 | 2.0846 | 2.0846 | 0.5572 | 0 |
| rs6054427 | Genotyped | G | GENOTYPIC | 9.31E−05 | 9.31E−05 | 2.1425 | 2.1425 | 0.5656 | 0 |
| rs6075186 | Imputed | G | DOMINANT | 6.31E−05 | 6.31E−05 | 0.5711 | 0.5711 | 0.3613 | 0 |
| rs608278 | Imputed | A | ADDITIVE | 7.01E−05 | 7.01E−05 | 0.6797 | 0.6797 | 0.6622 | 0 |
| rs6111540 | Imputed | A | ADDITIVE | 8.63E−05 | 8.63E−05 | 0.6872 | 0.6872 | 0.3404 | 0 |
| rs6131206 | Imputed | C | ADDITIVE | 0.001921 | 0.001921 | 1.3434 | 1.3434 | 0.4914 | 0 |
| rs6131208 | Imputed | T | ADDITIVE | 0.0002261 | 0.0002261 | 1.4034 | 1.4034 | 0.9253 | 0 |
| rs6131208 | Imputed | T | GENOTYPIC | 0.0003915 | 0.0003915 | 2.0113 | 2.0113 | 0.742 | 0 |
| rs6131919 | Imputed | G | DOMINANT | 6.31E−05 | 6.31E−05 | 0.5711 | 0.5711 | 0.3613 | 0 |
| rs6134243 | Imputed | C | ADDITIVE | 0.0005045 | 0.0005045 | 1.3708 | 1.3708 | 0.7263 | 0 |
| rs6134243 | Imputed | C | GENOTYPIC | 0.0006517 | 0.0006517 | 1.9308 | 1.9308 | 0.8764 | 0 |
| rs6136020 | Imputed | A | DOMINANT | 4.47E−05 | 4.47E−05 | 0.564 | 0.564 | 0.3277 | 0 |
| rs613799 | Imputed | C | DOMINANT | 0.0002168 | 0.0002168 | 1.6378 | 1.6378 | 0.4057 | 0 |
| rs644041 | Imputed | G | ADDITIVE | 4.10E−05 | 4.10E−05 | 1.5491 | 1.5491 | 0.9018 | 0 |
| rs644041 | Imputed | G | DOMINANT | 6.67E−05 | 6.67E−05 | 1.6947 | 1.6947 | 0.6929 | 0 |
| rs6464377 | Imputed | C | DOMINANT | 8.03E−05 | 8.03E−05 | 2.035 | 2.035 | 0.5161 | 0 |
| rs6474230 | Imputed | T | DOMINANT | 0.0001096 | 0.0001096 | 1.6401 | 1.6401 | 0.5183 | 0 |
| rs6476565 | Imputed | A | DOMINANT | 7.38E−05 | 7.38E−05 | 0.5063 | 0.5063 | 0.7702 | 0 |
| rs6511286 | Imputed | T | ADDITIVE | 8.56E−05 | 8.56E−05 | 1.4548 | 1.4548 | 0.3238 | 0 |
| rs6541829 | Genotyped | C | RECESSIVE | 0.0008971 | 0.0008971 | 2.3027 | 2.3027 | 0.4111 | 0 |
| rs6544721 | Imputed | G | DOMINANT | 4.51E−05 | 4.51E−05 | 1.6786 | 1.6786 | 0.7237 | 0 |

TABLE 12-continued

| SNP rs # | SOURCE | ALLELE (A1) | MODEL | P | P(R) | OR | OR(R) | Q | I |
|---|---|---|---|---|---|---|---|---|---|
| rs6544728 | Imputed | T | DOMINANT | 3.81E−05 | 3.81E−05 | 1.6924 | 1.6924 | 0.7254 | 0 |
| rs6565910 | Imputed | G | DOMINANT | 6.35E−05 | 6.35E−05 | 0.596 | 0.596 | 0.7271 | 0 |
| rs6581985 | Imputed | G | GENOTYPIC | 0.0008728 | 0.0008728 | 2.1776 | 2.1776 | 0.7023 | 0 |
| rs6581985 | Imputed | G | RECESSIVE | 0.0003781 | 0.0003781 | 2.2212 | 2.2212 | 0.8679 | 0 |
| rs6685186 | Imputed | T | ADDITIVE | 4.04E−05 | 4.04E−05 | 1.4552 | 1.4552 | 0.5991 | 0 |
| rs6685186 | Imputed | T | GENOTYPIC | 7.87E−05 | 7.87E−05 | 2.1208 | 2.1208 | 0.5157 | 0 |
| rs670593 | Imputed | A | RECESSIVE | 0.004705 | 0.004705 | 0.6026 | 0.6026 | 0.9153 | 0 |
| rs6722640 | Imputed | T | DOMINANT | 0.0009277 | 0.0009277 | 0.6505 | 0.6505 | 0.4929 | 0 |
| rs6746170 | Imputed | A | DOMINANT | 3.13E−05 | 3.13E−05 | 1.7022 | 1.7022 | 0.7235 | 0 |
| rs6757316 | Imputed | A | GENOTYPIC | 0.0002411 | 0.0002411 | 1.9498 | 1.9498 | 0.7316 | 0 |
| rs6805139 | Imputed | G | DOMINANT | 0.000179 | 0.000179 | 1.7522 | 1.7522 | 0.7218 | 0 |
| rs6808571 | Imputed | G | ADDITIVE | 5.06E−05 | 5.06E−05 | 1.6529 | 1.6529 | 0.3901 | 0 |
| rs6816479 | Imputed | A | RECESSIVE | 8.91E−05 | 8.91E−05 | 2.0191 | 2.0191 | 0.6804 | 0 |
| rs6865976 | Imputed | C | DOMINANT | 1.69E−05 | 1.69E−05 | 0.5245 | 0.5245 | 0.8417 | 0 |
| rs687047 | Imputed | C | ADDITIVE | 0.002064 | 0.002064 | 0.6519 | 0.6519 | 0.6436 | 0 |
| rs6871041 | Imputed | G | DOMINANT | 1.86E−05 | 1.86E−05 | 0.571 | 0.571 | 0.7023 | 0 |
| rs688358 | Imputed | A | ADDITIVE | 0.001723 | 0.001723 | 0.6472 | 0.6472 | 0.7547 | 0 |
| rs6908481 | Imputed | C | RECESSIVE | 2.93E−05 | 2.93E−05 | 1.9907 | 1.9907 | 0.715 | 0 |
| rs6917224 | Imputed | A | ADDITIVE | 8.07E−05 | 8.07E−05 | 1.4126 | 1.4126 | 0.6894 | 0 |
| rs6917224 | Imputed | A | GENOTYPIC | 6.12E−05 | 6.12E−05 | 2.0516 | 2.0516 | 0.8021 | 0 |
| rs6920677 | Imputed | G | DOMINANT | 9.74E−05 | 9.74E−05 | 0.6022 | 0.6022 | 0.3637 | 0 |
| rs6994498 | Imputed | G | DOMINANT | 0.0001214 | 0.0001214 | 1.6355 | 1.6355 | 0.5075 | 0 |
| rs6998772 | Imputed | T | DOMINANT | 3.05E−05 | 3.05E−05 | 2.6244 | 2.6244 | 0.9125 | 0 |
| rs7022281 | Imputed | C | ADDITIVE | 0.0008616 | 0.0008616 | 0.7327 | 0.7327 | 0.9461 | 0 |
| rs7022281 | Imputed | C | GENOTYPIC | 0.0008065 | 0.0008065 | 0.5109 | 0.5109 | 0.8632 | 0 |
| rs7022281 | Imputed | C | RECESSIVE | 0.003772 | 0.003772 | 0.5858 | 0.5858 | 0.653 | 0 |
| rs7043983 | Imputed | T | DOMINANT | 7.81E−05 | 7.81E−05 | 0.5075 | 0.5075 | 0.763 | 0 |
| rs7077799 | Imputed | A | DOMINANT | 0.0001618 | 0.0002489 | 1.6085 | 1.6059 | 0.3065 | 4.35 |
| rs7088947 | Imputed | A | ADDITIVE | 0.0002561 | 0.002122 | 0.5006 | 0.4865 | 0.237 | 28.49 |
| rs7089661 | Imputed | C | DOMINANT | 0.0001402 | 0.0004442 | 1.6153 | 1.6079 | 0.2874 | 11.66 |
| rs7102072 | Imputed | A | DOMINANT | 2.00E−05 | 2.00E−05 | 0.5832 | 0.5832 | 0.7992 | 0 |
| rs710832 | Genotyped | A | RECESSIVE | 0.0003556 | 0.0003556 | 0.3515 | 0.3515 | 0.5598 | 0 |
| rs712531 | Imputed | A | DOMINANT | 4.12E−05 | 4.12E−05 | 1.7164 | 1.7164 | 0.821 | 0 |
| rs7129817 | Imputed | T | ADDITIVE | 8.64E−05 | 8.64E−05 | 0.6917 | 0.6917 | 0.9871 | 0 |
| rs7134262 | Imputed | T | GENOTYPIC | 0.000667 | 0.000667 | 2.0059 | 2.0059 | 0.482 | 0 |
| rs7134262 | Imputed | T | RECESSIVE | 1.92E−05 | 0.0001342 | 2.2604 | 2.2418 | 0.2719 | 17.17 |
| rs7138300 | Imputed | C | ADDITIVE | 0.0006364 | 0.0006364 | 0.728 | 0.728 | 0.7009 | 0 |
| rs7138300 | Imputed | C | DOMINANT | 0.0001126 | 0.0001126 | 0.5881 | 0.5881 | 0.915 | 0 |
| rs722927 | Imputed | G | ADDITIVE | 5.34E−05 | 5.34E−05 | 0.4718 | 0.4718 | 0.7351 | 0 |
| rs722927 | Imputed | G | DOMINANT | 5.76E−05 | 5.76E−05 | 0.4589 | 0.4589 | 0.8222 | 0 |
| rs726424 | Genotyped | G | ADDITIVE | 0.0002921 | 0.0002921 | 0.7216 | 0.7216 | 0.7796 | 0 |
| rs726424 | Genotyped | G | GENOTYPIC | 0.0006575 | 0.0006575 | 0.5204 | 0.5204 | 0.4936 | 0 |
| rs7295817 | Imputed | C | ADDITIVE | 4.33E−05 | 4.33E−05 | 0.6912 | 0.6912 | 0.586 | 0 |
| rs7295817 | Imputed | C | GENOTYPIC | 6.93E−05 | 6.93E−05 | 0.4694 | 0.4694 | 0.3851 | 0 |
| rs7295817 | Imputed | C | RECESSIVE | 0.001037 | 0.01025 | 0.5648 | 0.5757 | 0.2268 | 31.55 |
| rs7297372 | Imputed | A | ADDITIVE | 0.0002771 | 0.0002771 | 0.7072 | 0.7072 | 0.6868 | 0 |
| rs7297372 | Imputed | A | GENOTYPIC | 0.0002766 | 0.0002766 | 0.4963 | 0.4963 | 0.7085 | 0 |
| rs7298255 | Imputed | A | ADDITIVE | 0.0006976 | 0.0006976 | 0.7332 | 0.7332 | 0.8654 | 0 |
| rs7298255 | Imputed | A | DOMINANT | 6.68E−05 | 6.68E−05 | 0.5792 | 0.5792 | 0.9355 | 0 |
| rs7305832 | Imputed | C | GENOTYPIC | 0.000667 | 0.000667 | 2.0059 | 2.0059 | 0.482 | 0 |
| rs7305832 | Imputed | C | RECESSIVE | 1.92E−05 | 0.0001342 | 2.2604 | 2.2418 | 0.2719 | 17.17 |
| rs737542 | Imputed | A | RECESSIVE | 0.0006435 | 0.0007974 | 2.3828 | 2.3899 | 0.3091 | 3.32 |
| rs742827 | Imputed | A | ADDITIVE | 0.0002216 | 0.0002216 | 1.411 | 1.411 | 0.9765 | 0 |
| rs742827 | Imputed | A | GENOTYPIC | 0.0004335 | 0.0004335 | 2.0079 | 2.0079 | 0.73 | 0 |
| rs7446891 | Imputed | G | DOMINANT | 1.34E−05 | 1.34E−05 | 0.5737 | 0.5737 | 0.819 | 0 |
| rs7448641 | Imputed | C | ADDITIVE | 2.13E−05 | 2.13E−05 | 0.1976 | 0.1976 | 0.798 | 0 |
| rs7448641 | Imputed | C | DOMINANT | 3.85E−05 | 3.85E−05 | 0.2007 | 0.2007 | 0.8145 | 0 |
| rs7460605 | Imputed | G | DOMINANT | 0.0004965 | 0.0004965 | 1.5998 | 1.5998 | 0.8118 | 0 |
| rs7468898 | Imputed | T | ADDITIVE | 4.70E−05 | 4.70E−05 | 1.4562 | 1.4562 | 0.6548 | 0 |
| rs7468898 | Imputed | T | GENOTYPIC | 5.27E−05 | 5.27E−05 | 2.1254 | 2.1254 | 0.7376 | 0 |
| rs7501186 | Imputed | A | DOMINANT | 0.009359 | 0.009359 | 1.4572 | 1.4572 | 0.5108 | 0 |
| rs755117 | Imputed | A | DOMINANT | 8.93E−05 | 8.93E−05 | 1.6937 | 1.6937 | 0.8341 | 0 |
| rs7557560 | Imputed | T | GENOTYPIC | 1.52E−05 | 1.52E−05 | 4.8002 | 4.8002 | 0.5006 | 0 |
| rs7557560 | Imputed | T | RECESSIVE | 1.73E−05 | 1.73E−05 | 4.6869 | 4.6869 | 0.4673 | 0 |
| rs7562462 | Imputed | T | DOMINANT | 3.98E−05 | 3.98E−05 | 1.7863 | 1.7863 | 0.5531 | 0 |
| rs757173 | Genotyped | G | DOMINANT | 3.67E−05 | 3.67E−05 | 0.5903 | 0.5903 | 0.3929 | 0 |
| rs7607447 | Imputed | T | RECESSIVE | 0.004354 | 0.004354 | 1.9039 | 1.9039 | 0.9167 | 0 |
| rs7639053 | Imputed | A | ADDITIVE | 6.32E−05 | 6.32E−05 | 1.5389 | 1.5389 | 0.7877 | 0 |
| rs7648163 | Imputed | C | RECESSIVE | 4.30E−05 | 4.30E−05 | 2.2905 | 2.2905 | 0.3422 | 0 |
| rs7651273 | Imputed | A | GENOTYPIC | 7.69E−05 | 7.69E−05 | 3.6491 | 3.6491 | 0.3606 | 0 |
| rs7653190 | Imputed | C | ADDITIVE | 5.88E−05 | 5.88E−05 | 1.5431 | 1.5431 | 0.7499 | 0 |
| rs7653685 | Genotyped | C | DOMINANT | 5.30E−05 | 8.76E−05 | 1.9326 | 1.9381 | 0.3031 | 5.72 |
| rs7684899 | Imputed | C | DOMINANT | 0.005003 | 0.005003 | 0.6963 | 0.6963 | 0.8023 | 0 |
| rs7701604 | Imputed | G | ADDITIVE | 2.13E−05 | 2.13E−05 | 0.1976 | 0.1976 | 0.798 | 0 |
| rs7701604 | Imputed | G | DOMINANT | 3.85E−05 | 3.85E−05 | 0.2007 | 0.2007 | 0.8145 | 0 |
| rs7703676 | Imputed | C | ADDITIVE | 2.13E−05 | 2.13E−05 | 0.1976 | 0.1976 | 0.798 | 0 |
| rs7703676 | Imputed | C | DOMINANT | 3.85E−05 | 3.85E−05 | 0.2007 | 0.2007 | 0.8145 | 0 |

TABLE 12-continued

| SNP rs # | SOURCE | ALLELE (A1) | MODEL | P | P(R) | OR | OR(R) | Q | I |
|---|---|---|---|---|---|---|---|---|---|
| rs7711358 | Imputed | A | DOMINANT | 2.03E-05 | 2.03E-05 | 0.5813 | 0.5813 | 0.7623 | 0 |
| rs7713251 | Imputed | C | RECESSIVE | 7.07E-05 | 7.07E-05 | 2.2563 | 2.2563 | 0.6403 | 0 |
| rs7737608 | Imputed | G | DOMINANT | 2.24E-05 | 2.24E-05 | 1.7514 | 1.7514 | 0.3895 | 0 |
| rs7755903 | Imputed | A | GENOTYPIC | 9.90E-05 | 9.90E-05 | 0.4763 | 0.4763 | 0.3374 | 0 |
| rs7762993 | Imputed | A | ADDITIVE | 3.64E-05 | 3.64E-05 | 1.5999 | 1.5999 | 0.3438 | 0 |
| rs7762993 | Imputed | A | DOMINANT | 5.71E-06 | 5.71E-06 | 1.8249 | 1.8249 | 0.3301 | 0 |
| rs7767265 | Imputed | G | DOMINANT | 1.54E-06 | 9.09E-05 | 1.8708 | 1.8488 | 0.2364 | 28.66 |
| rs7769415 | Imputed | C | GENOTYPIC | 0.01222 | 0.01222 | 1.7102 | 1.7102 | 0.8943 | 0 |
| rs7771264 | Imputed | T | DOMINANT | 9.73E-05 | 9.73E-05 | 0.6028 | 0.6028 | 0.5969 | 0 |
| rs7795792 | Imputed | T | RECESSIVE | 0.0002939 | 0.00425 | 0.557 | 0.5415 | 0.2009 | 38.87 |
| rs7806481 | Imputed | G | RECESSIVE | 2.19E-05 | 9.93E-05 | 0.5028 | 0.5057 | 0.2831 | 13.22 |
| rs7808536 | Imputed | G | DOMINANT | 0.0002294 | 0.00065 | 1.6124 | 1.6227 | 0.2799 | 14.36 |
| rs7814819 | Imputed | G | ADDITIVE | 0.000435 | 0.000435 | 2.1517 | 2.1517 | 0.4796 | 0 |
| rs7814819 | Imputed | G | DOMINANT | 0.0002065 | 0.0002065 | 2.333 | 2.333 | 0.5524 | 0 |
| rs7815952 | Imputed | T | DOMINANT | 3.05E-05 | 3.05E-05 | 2.6244 | 2.6244 | 0.9125 | 0 |
| rs7834090 | Imputed | T | DOMINANT | 3.05E-05 | 3.05E-05 | 2.6244 | 2.6244 | 0.9125 | 0 |
| rs7859250 | Imputed | C | DOMINANT | 6.27E-05 | 6.27E-05 | 0.5033 | 0.5033 | 0.7889 | 0 |
| rs7863577 | Genotyped | A | ADDITIVE | 5.37E-05 | 5.37E-05 | 0.5145 | 0.5145 | 0.5515 | 0 |
| rs7863577 | Genotyped | A | DOMINANT | 8.32E-05 | 8.32E-05 | 0.5032 | 0.5032 | 0.6829 | 0 |
| rs7902140 | Imputed | C | ADDITIVE | 8.00E-05 | 8.00E-05 | 0.6274 | 0.6274 | 0.9605 | 0 |
| rs7921834 | Imputed | C | DOMINANT | 0.0001402 | 0.0004442 | 1.6153 | 1.6079 | 0.2874 | 11.66 |
| rs7939893 | Imputed | C | ADDITIVE | 0.001509 | 0.001509 | 0.7466 | 0.7466 | 0.4075 | 0 |
| rs7939893 | Imputed | C | DOMINANT | 0.0007741 | 0.0007741 | 0.6536 | 0.6536 | 0.8293 | 0 |
| rs7955901 | Imputed | C | ADDITIVE | 0.0008458 | 0.0008458 | 0.7371 | 0.7371 | 0.7791 | 0 |
| rs7955901 | Imputed | C | DOMINANT | 7.14E-05 | 7.14E-05 | 0.5799 | 0.5799 | 0.9786 | 0 |
| rs7956274 | Imputed | T | ADDITIVE | 0.001224 | 0.001224 | 0.7429 | 0.7429 | 0.9488 | 0 |
| rs7956274 | Imputed | T | DOMINANT | 0.0001094 | 0.0001094 | 0.5876 | 0.5876 | 0.8703 | 0 |
| rs7957932 | Imputed | G | ADDITIVE | 0.001498 | 0.001498 | 0.7467 | 0.7467 | 0.8677 | 0 |
| rs7957932 | Imputed | G | DOMINANT | 5.69E-05 | 5.69E-05 | 0.5706 | 0.5706 | 0.9859 | 0 |
| rs7984294 | Imputed | A | DOMINANT | 0.00858 | 0.00858 | 1.5738 | 1.5738 | 0.5291 | 0 |
| rs7994286 | Imputed | A | ADDITIVE | 9.63E-05 | 9.63E-05 | 0.549 | 0.549 | 0.854 | 0 |
| rs7994286 | Imputed | A | DOMINANT | 7.82E-05 | 7.82E-05 | 0.5161 | 0.5161 | 0.7893 | 0 |
| rs8038229 | Genotyped | A | ADDITIVE | 0.001259 | 0.01927 | 0.7324 | 0.7157 | 0.155 | 50.55 |
| rs8038229 | Genotyped | A | DOMINANT | 0.0009849 | 0.007544 | 0.6614 | 0.6497 | 0.2113 | 36.01 |
| rs8043336 | Imputed | C | GENOTYPIC | 7.96E-05 | 7.96E-05 | 0.3958 | 0.3958 | 0.4455 | 0 |
| rs8043336 | Imputed | C | RECESSIVE | 8.36E-05 | 8.36E-05 | 0.4142 | 0.4142 | 0.5943 | 0 |
| rs8054431 | Imputed | T | DOMINANT | 2.45E-05 | 2.45E-05 | 1.7571 | 1.7571 | 0.4329 | 0 |
| rs8066502 | Imputed | T | DOMINANT | 0.006801 | 0.006801 | 0.683 | 0.683 | 0.9956 | 0 |
| rs8068714 | Imputed | T | DOMINANT | 0.006941 | 0.006941 | 0.6836 | 0.6836 | 0.8713 | 0 |
| rs892575 | Imputed | T | ADDITIVE | 5.64E-05 | 5.64E-05 | 1.4995 | 1.4995 | 0.67 | 0 |
| rs892583 | Imputed | G | ADDITIVE | 5.66E-05 | 5.66E-05 | 1.5024 | 1.5024 | 0.7396 | 0 |
| rs915494 | Imputed | A | ADDITIVE | 0.0008012 | 0.008128 | 1.402 | 1.3898 | 0.223 | 32.66 |
| rs915494 | Imputed | A | DOMINANT | 0.0001453 | 0.01549 | 1.6314 | 1.5891 | 0.1486 | 52.08 |
| rs917295 | Imputed | G | DOMINANT | 1.41E-05 | 1.41E-05 | 0.5759 | 0.5759 | 0.7897 | 0 |
| rs922594 | Imputed | T | DOMINANT | 0.00224 | 0.00224 | 0.6774 | 0.6774 | 0.3822 | 0 |
| rs9301653 | Imputed | T | ADDITIVE | 6.55E-05 | 6.55E-05 | 0.5369 | 0.5369 | 0.7455 | 0 |
| rs9301653 | Imputed | T | DOMINANT | 4.31E-05 | 4.31E-05 | 0.5009 | 0.5009 | 0.6615 | 0 |
| rs9309988 | Imputed | G | DOMINANT | 5.30E-05 | 8.76E-05 | 1.9326 | 1.9381 | 0.3031 | 5.72 |
| rs9309989 | Genotyped | C | DOMINANT | 3.87E-05 | 3.87E-05 | 1.9491 | 1.9491 | 0.3231 | 0 |
| rs9310221 | Imputed | A | DOMINANT | 9.78E-06 | 3.80E-05 | 1.86 | 1.8519 | 0.2901 | 10.65 |
| rs9327555 | Imputed | T | DOMINANT | 1.37E-05 | 1.37E-05 | 0.5753 | 0.5753 | 0.7855 | 0 |
| rs937890 | Imputed | G | DOMINANT | 0.005817 | 0.005817 | 0.6731 | 0.6731 | 0.8017 | 0 |
| rs9454967 | Imputed | G | ADDITIVE | 7.03E-06 | 7.03E-06 | 2.1926 | 2.1926 | 0.7348 | 0 |
| rs9454967 | Imputed | G | DOMINANT | 1.21E-06 | 1.21E-06 | 2.4795 | 2.4795 | 0.5648 | 0 |
| rs9471295 | Imputed | T | DOMINANT | 0.002076 | 0.002076 | 1.5391 | 1.5391 | 0.8556 | 0 |
| rs9477007 | Imputed | A | ADDITIVE | 5.88E-05 | 5.88E-05 | 1.429 | 1.429 | 0.6453 | 0 |
| rs9477007 | Imputed | A | GENOTYPIC | 5.42E-05 | 5.42E-05 | 2.0759 | 2.0759 | 0.7341 | 0 |
| rs9487279 | Imputed | T | DOMINANT | 9.53E-05 | 9.53E-05 | 0.5948 | 0.5948 | 0.7903 | 0 |
| rs949016 | Imputed | C | ADDITIVE | 4.61E-05 | 4.61E-05 | 1.5082 | 1.5082 | 0.7183 | 0 |
| rs9555973 | Imputed | G | ADDITIVE | 9.09E-05 | 9.09E-05 | 0.5479 | 0.5479 | 0.8574 | 0 |
| rs9555973 | Imputed | G | DOMINANT | 7.60E-05 | 7.60E-05 | 0.5157 | 0.5157 | 0.808 | 0 |
| rs9557510 | Imputed | G | ADDITIVE | 0.0001379 | 0.0001379 | 1.6102 | 1.6102 | 0.9088 | 0 |
| rs9557510 | Imputed | G | DOMINANT | 4.86E-05 | 4.86E-05 | 1.7706 | 1.7706 | 0.9892 | 0 |
| rs9560584 | Imputed | T | DOMINANT | 8.00E-05 | 8.00E-05 | 0.512 | 0.512 | 0.7127 | 0 |
| rs9588770 | Imputed | T | DOMINANT | 8.97E-05 | 8.97E-05 | 0.5187 | 0.5187 | 0.86 | 0 |
| rs9588848 | Imputed | C | ADDITIVE | 6.55E-05 | 6.55E-05 | 0.5369 | 0.5369 | 0.7455 | 0 |
| rs9588848 | Imputed | C | DOMINANT | 4.31E-05 | 4.31E-05 | 0.5009 | 0.5009 | 0.6615 | 0 |
| rs966583 | Imputed | A | ADDITIVE | 0.00064 | 0.00064 | 0.7272 | 0.7272 | 0.9721 | 0 |
| rs966583 | Imputed | A | DOMINANT | 6.94E-05 | 6.94E-05 | 0.5916 | 0.5916 | 0.8081 | 0 |
| rs974130 | Genotyped | A | RECESSIVE | 9.67E-05 | 9.67E-05 | 2.0112 | 2.0112 | 0.6677 | 0 |
| rs977160 | Imputed | T | ADDITIVE | 1.90E-05 | 1.90E-05 | 1.5465 | 1.5465 | 0.3814 | 0 |
| rs9812206 | Imputed | G | ADDITIVE | 1.27E-06 | 1.27E-06 | 0.4469 | 0.4469 | 0.5437 | 0 |
| rs9812206 | Imputed | G | DOMINANT | 1.72E-06 | 1.72E-06 | 0.4369 | 0.4369 | 0.61 | 0 |
| rs9813552 | Imputed | G | ADDITIVE | 2.01E-06 | 2.01E-06 | 0.4493 | 0.4493 | 0.4991 | 0 |
| rs9813552 | Imputed | G | DOMINANT | 2.40E-06 | 2.40E-06 | 0.4387 | 0.4387 | 0.5642 | 0 |
| rs9815037 | Imputed | T | ADDITIVE | 1.57E-06 | 1.57E-06 | 0.4461 | 0.4461 | 0.5119 | 0 |
| rs9815037 | Imputed | T | DOMINANT | 1.83E-06 | 1.83E-06 | 0.4354 | 0.4354 | 0.5792 | 0 |

TABLE 12-continued

| SNP rs # | SOURCE | ALLELE (A1) | MODEL | P | P(R) | OR | OR(R) | Q | I |
|---|---|---|---|---|---|---|---|---|---|
| rs9825349 | Imputed | A | ADDITIVE | 1.57E−06 | 1.57E−06 | 0.4461 | 0.4461 | 0.5119 | 0 |
| rs9825349 | Imputed | A | DOMINANT | 1.83E−06 | 1.83E−06 | 0.4354 | 0.4354 | 0.5792 | 0 |
| rs9834217 | Imputed | T | ADDITIVE | 1.61E−06 | 1.61E−06 | 0.4466 | 0.4466 | 0.5093 | 0 |
| rs9834217 | Imputed | T | DOMINANT | 1.89E−06 | 1.89E−06 | 0.4359 | 0.4359 | 0.5761 | 0 |
| rs9840460 | Imputed | T | ADDITIVE | 1.57E−06 | 1.57E−06 | 0.4461 | 0.4461 | 0.5119 | 0 |
| rs9840460 | Imputed | T | DOMINANT | 1.83E−06 | 1.83E−06 | 0.4354 | 0.4354 | 0.5792 | 0 |
| rs9840756 | Imputed | A | ADDITIVE | 1.55E−06 | 1.55E−06 | 0.4458 | 0.4458 | 0.5071 | 0 |
| rs9840756 | Imputed | A | DOMINANT | 1.81E−06 | 1.81E−06 | 0.435 | 0.435 | 0.5742 | 0 |
| rs9844801 | Imputed | C | DOMINANT | 5.30E−05 | 8.76E−05 | 1.9326 | 1.9381 | 0.3031 | 5.72 |
| rs985375 | Imputed | A | GENOTYPIC | 6.39E−05 | 6.39E−05 | 2.8891 | 2.8891 | 0.9861 | 0 |
| rs9869187 | Imputed | C | ADDITIVE | 7.35E−06 | 7.35E−06 | 0.4651 | 0.4651 | 0.7004 | 0 |
| rs9869187 | Imputed | C | DOMINANT | 2.02E−05 | 2.02E−05 | 0.4704 | 0.4704 | 0.6809 | 0 |
| rs9872327 | Imputed | T | DOMINANT | 5.30E−05 | 8.76E−05 | 1.9326 | 1.9381 | 0.3031 | 5.72 |
| rs9881685 | Imputed | A | ADDITIVE | 1.31E−06 | 1.31E−06 | 0.4438 | 0.4438 | 0.4978 | 0 |
| rs9881685 | Imputed | A | DOMINANT | 1.61E−06 | 1.61E−06 | 0.4332 | 0.4332 | 0.5585 | 0 |
| rs9909499 | Imputed | C | DOMINANT | 0.002624 | 0.002624 | 1.4669 | 1.4669 | 0.7269 | 0 |
| rs9911847 | Imputed | G | DOMINANT | 0.00547 | 0.00547 | 0.6755 | 0.6755 | 0.9212 | 0 |
| rs9946886 | Imputed | G | RECESSIVE | 5.84E−05 | 5.84E−05 | 0.3084 | 0.3084 | 0.8937 | 0 |
| rs9958823 | Imputed | A | ADDITIVE | 2.61E−05 | 2.61E−05 | 1.5292 | 1.5292 | 0.6713 | 0 |
| rs9965248 | Imputed | T | ADDITIVE | 6.66E−05 | 6.66E−05 | 1.4965 | 1.4965 | 0.6122 | 0 |

TABLE 13

| SNP rs # | SOURCE | ALLELE (A1) | MODEL | P | P(R) | OR | OR(R) | Q | I |
|---|---|---|---|---|---|---|---|---|---|
| rs198460 | Genotyped | G | RECESSIVE | 2.05E−06 | 2.05E−06 | 1.8108 | 1.8108 | 0.5587 | 0 |
| rs603940 | Genotyped | G | RECESSIVE | 7.32E−05 | 7.32E−05 | 0.5405 | 0.5405 | 0.4588 | 0 |
| rs10021016 | Genotyped | G | GENOTYPIC | 5.48E−05 | 5.48E−05 | 2.3945 | 2.3945 | 0.8903 | 0 |
| rs1003148 | Imputed | C | ADDITIVE | 1.19E−05 | 1.19E−05 | 0.7154 | 0.7154 | 0.9106 | 0 |
| rs1003148 | Imputed | C | GENOTYPIC | 8.14E−06 | 8.14E−06 | 0.4872 | 0.4872 | 0.8101 | 0 |
| rs1003148 | Imputed | C | RECESSIVE | 5.89E−05 | 5.89E−05 | 0.5541 | 0.5541 | 0.5169 | 0 |
| rs10046799 | Imputed | C | ADDITIVE | 8.59E−05 | 8.59E−05 | 0.7444 | 0.7444 | 0.3859 | 0 |
| rs10046799 | Imputed | C | GENOTYPIC | 6.10E−05 | 6.10E−05 | 0.5427 | 0.5427 | 0.4931 | 0 |
| rs10051148 | Imputed | C | DOMINANT | 1.16E−06 | 1.16E−06 | 0.596 | 0.596 | 0.8669 | 0 |
| rs10054055 | Imputed | T | DOMINANT | 4.36E−07 | 4.36E−07 | 0.5814 | 0.5814 | 0.9471 | 0 |
| rs10067895 | Imputed | A | DOMINANT | 3.37E−07 | 3.37E−07 | 0.5762 | 0.5762 | 0.9653 | 0 |
| rs1008705 | Imputed | C | DOMINANT | 9.36E−05 | 9.36E−05 | 1.6202 | 1.6202 | 0.516 | 0 |
| rs10105871 | Imputed | C | DOMINANT | 9.54E−05 | 9.54E−05 | 1.5752 | 1.5752 | 0.7598 | 0 |
| rs10116807 | Imputed | A | GENOTYPIC | 2.35E−05 | 2.35E−05 | 3.1548 | 3.1548 | 0.994 | 0 |
| rs10116807 | Imputed | A | RECESSIVE | 4.72E−05 | 4.72E−05 | 2.9802 | 2.9802 | 0.9943 | 0 |
| rs10121941 | Imputed | C | DOMINANT | 3.10E−03 | 1.47E−01 | 0.6558 | 0.6652 | 0.0252 | 72.84 |
| rs10128638 | Genotyped | G | DOMINANT | 7.89E−05 | 7.89E−05 | 0.6196 | 0.6196 | 0.8513 | 0 |
| rs1012924 | Imputed | G | ADDITIVE | 6.22E−02 | 5.77E−01 | 0.7882 | 0.8017 | 0.0001 | 89.23 |
| rs1012924 | Imputed | G | DOMINANT | 6.06E−02 | 0.5529 | 0.7739 | 0.7744 | 0.0001 | 89.62 |
| rs1016030 | Genotyped | G | ADDITIVE | 9.82E−05 | 9.82E−05 | 1.3592 | 1.3592 | 0.3844 | 0 |
| rs1016030 | Genotyped | G | GENOTYPIC | 0.0001503 | 0.0001808 | 1.8631 | 1.8624 | 0.3605 | 1.98 |
| rs1017558 | Imputed | A | RECESSIVE | 3.63E−03 | 0.1741 | 1.5611 | 1.5084 | 0.0227 | 73.6 |
| rs10183431 | Imputed | T | DOMINANT | 1.18E−04 | 0.0001179 | 1.5094 | 1.5094 | 0.452 | 0 |
| rs10195401 | Imputed | C | DOMINANT | 5.75E−04 | 0.01653 | 1.4645 | 1.4526 | 0.1484 | 47.59 |
| rs10239416 | Imputed | A | DOMINANT | 8.79E−03 | 0.3403 | 0.7512 | 0.7725 | 0.0026 | 83.15 |
| rs10032188 | Imputed | G | GENOTYPIC | 3.23E−05 | 3.23E−05 | 0.415 | 0.415 | 0.4549 | 0 |
| rs10032188 | Imputed | G | RECESSIVE | 4.57E−05 | 4.57E−05 | 0.4331 | 0.4331 | 0.3757 | 0 |
| rs10468988 | Imputed | G | ADDITIVE | 1.19E−04 | 0.005354 | 1.3915 | 1.3736 | 0.1822 | 41.27 |
| rs10478919 | Imputed | G | DOMINANT | 3.36E−07 | 3.36E−07 | 0.5781 | 0.5781 | 0.9145 | 0 |
| rs10506623 | Imputed | C | DOMINANT | 4.11E−05 | 4.11E−05 | 0.6355 | 0.6355 | 0.7566 | 0 |
| rs10506626 | Imputed | A | DOMINANT | 4.77E−06 | 4.77E−06 | 0.6029 | 0.6029 | 0.7652 | 0 |
| rs10509477 | Imputed | T | DOMINANT | 5.09E−05 | 5.09E−05 | 1.5361 | 1.5361 | 0.4725 | 0 |
| rs10511071 | Imputed | C | DOMINANT | 0.003653 | 0.1786 | 1.4802 | 1.4969 | 0.0084 | 79.08 |
| rs10511072 | Imputed | G | DOMINANT | 3.65E−03 | 1.79E−01 | 1.4802 | 1.4969 | 0.0084 | 79.08 |
| rs10511199 | Imputed | C | ADDITIVE | 9.12E−05 | 2.82E−02 | 1.348 | 1.3411 | 0.1188 | 53.05 |
| rs10513283 | Imputed | G | GENOTYPIC | 3.27E−04 | 1.14E−02 | 2.7233 | 2.5889 | 0.1701 | 43.55 |
| rs10520072 | Imputed | T | DOMINANT | 4.33E−07 | 4.33E−07 | 0.5808 | 0.5808 | 0.9574 | 0 |
| rs1065639 | Imputed | C | DOMINANT | 5.13E−05 | 5.13E−05 | 1.7169 | 1.7169 | 0.8785 | 0 |
| rs10733846 | Imputed | G | ADDITIVE | 1.71E−05 | 5.53E−04 | 0.6464 | 0.6552 | 0.2454 | 28.81 |
| rs10733846 | Imputed | G | DOMINANT | 5.14E−05 | 5.14E−05 | 0.6265 | 0.6265 | 0.543 | 0 |
| rs10737390 | Imputed | T | DOMINANT | 1.70E−03 | 0.1499 | 0.7059 | 0.7364 | 0.0305 | 71.34 |
| rs10749293 | Imputed | G | DOMINANT | 1.78E−05 | 1.78E−05 | 1.5736 | 1.5736 | 0.524 | 0 |
| rs10752159 | Imputed | G | DOMINANT | 7.32E−05 | 7.32E−05 | 1.5394 | 1.5394 | 0.5089 | 0 |
| rs10753760 | Imputed | T | ADDITIVE | 3.60E−03 | 0.1365 | 1.2495 | 1.2446 | 0.0275 | 72.17 |
| rs10753760 | Imputed | T | GENOTYPIC | 3.73E−03 | 0.1448 | 1.579 | 1.5661 | 0.0247 | 72.99 |
| rs10757887 | Imputed | C | DOMINANT | 2.10E−03 | 0.09341 | 0.7185 | 0.7262 | 0.048 | 67.07 |
| rs10758326 | Imputed | A | ADDITIVE | 3.12E−05 | 3.12E−05 | 0.7205 | 0.7205 | 0.9344 | 0 |
| rs10758326 | Imputed | A | GENOTYPIC | 1.46E−05 | 1.46E−05 | 0.4748 | 0.4748 | 0.6437 | 0 |

TABLE 13-continued

| SNP rs # | SOURCE | ALLELE (A1) | MODEL | P | P(R) | OR | OR(R) | Q | I |
|---|---|---|---|---|---|---|---|---|---|
| rs10758326 | Imputed | A | RECESSIVE | 9.28E−05 | 9.28E−05 | 0.5372 | 0.5372 | 0.3903 | 0 |
| rs10762236 | Genotyped | G | ADDITIVE | 1.41E−04 | 1.36E−02 | 0.6866 | 0.7015 | 0.1342 | 50.22 |
| rs10765769 | Imputed | C | ADDITIVE | 1.89E−05 | 1.89E−05 | 1.3977 | 1.3977 | 0.5396 | 0 |
| rs10765769 | Imputed | C | GENOTYPIC | 4.04E−05 | 4.04E−05 | 1.9329 | 1.9329 | 0.5283 | 0 |
| rs10784891 | Imputed | C | ADDITIVE | 3.30E−05 | 3.30E−05 | 0.7221 | 0.7221 | 0.8883 | 0 |
| rs10784891 | Imputed | C | DOMINANT | 3.17E−05 | 3.17E−05 | 0.6171 | 0.6171 | 0.6062 | 0 |
| rs10787923 | Imputed | G | DOMINANT | 1.17E−05 | 1.17E−05 | 1.5929 | 1.5929 | 0.4856 | 0 |
| rs10787949 | Imputed | A | DOMINANT | 6.84E−05 | 6.84E−05 | 1.5282 | 1.5282 | 0.4028 | 0 |
| rs10787951 | Imputed | G | DOMINANT | 7.02E−05 | 7.02E−05 | 1.5272 | 1.5272 | 0.4 | 0 |
| rs10787983 | Imputed | C | DOMINANT | 5.52E−05 | 5.52E−05 | 1.5334 | 1.5334 | 0.4235 | 0 |
| rs10788380 | Imputed | C | ADDITIVE | 7.51E−05 | 7.51E−05 | 1.3528 | 1.3528 | 0.8856 | 0 |
| rs10788380 | Imputed | C | DOMINANT | 3.53E−05 | 3.53E−05 | 1.6982 | 1.6982 | 0.9632 | 0 |
| rs10788380 | Imputed | C | GENOTYPIC | 6.34E−05 | 6.34E−05 | 1.8532 | 1.8532 | 0.9102 | 0 |
| rs10814418 | Imputed | G | DOMINANT | 3.49E−03 | 1.53E−01 | 0.6592 | 0.6683 | 0.0249 | 72.93 |
| rs10831417 | Imputed | A | ADDITIVE | 3.85E−05 | 3.11E−04 | 1.3868 | 1.3856 | 0.2831 | 20.76 |
| rs10831417 | Imputed | A | GENOTYPIC | 4.55E−05 | 6.53E−04 | 1.9715 | 1.9609 | 0.2571 | 26.37 |
| rs10831422 | Imputed | C | ADDITIVE | 8.06E−05 | 8.06E−05 | 1.366 | 1.366 | 0.4125 | 0 |
| rs10831422 | Imputed | C | GENOTYPIC | 6.96E−05 | 6.96E−05 | 1.9315 | 1.9315 | 0.3829 | 0 |
| rs10862931 | Imputed | C | GENOTYPIC | 5.74E−02 | 0.5627 | 0.7112 | 0.7348 | 0.0002 | 88.45 |
| rs10865197 | Imputed | C | DOMINANT | 1.16E−04 | 0.0001158 | 1.5096 | 1.5096 | 0.4518 | 0 |
| rs10871302 | Imputed | A | DOMINANT | 1.00E−04 | 0.0001 | 1.6031 | 1.6031 | 0.379 | 0 |
| rs10877463 | Imputed | C | DOMINANT | 6.35E−05 | 6.35E−05 | 0.6518 | 0.6518 | 0.5839 | 0 |
| rs10877468 | Imputed | C | DOMINANT | 7.07E−05 | 7.07E−05 | 0.653 | 0.653 | 0.5247 | 0 |
| rs10879240 | Imputed | C | ADDITIVE | 3.80E−05 | 3.80E−05 | 0.6993 | 0.6993 | 0.5299 | 0 |
| rs10879242 | Imputed | A | DOMINANT | 1.18E−05 | 1.18E−05 | 0.6 | 0.6 | 0.4258 | 0 |
| rs10879245 | Imputed | G | DOMINANT | 1.18E−05 | 1.18E−05 | 0.6 | 0.6 | 0.4258 | 0 |
| rs10879249 | Imputed | T | DOMINANT | 4.34E−05 | 4.34E−05 | 0.6359 | 0.6359 | 0.7079 | 0 |
| rs10886452 | Imputed | A | DOMINANT | 5.56E−05 | 5.56E−05 | 1.5358 | 1.5358 | 0.4242 | 0 |
| rs10886463 | Imputed | C | DOMINANT | 6.07E−05 | 6.07E−05 | 1.533 | 1.533 | 0.4181 | 0 |
| rs10886465 | Imputed | A | DOMINANT | 7.14E−05 | 7.14E−05 | 1.5271 | 1.5271 | 0.4344 | 0 |
| rs10886526 | Imputed | C | DOMINANT | 6.05E−05 | 6.05E−05 | 1.5311 | 1.5311 | 0.4839 | 0 |
| rs10902437 | Imputed | G | ADDITIVE | 6.85E−05 | 6.85E−05 | 1.3724 | 1.3724 | 0.531 | 0 |
| rs10941126 | Imputed | G | ADDITIVE | 8.37E−03 | 1.24E−01 | 0.5451 | 0.3771 | 0.0037 | 82.12 |
| rs10941126 | Imputed | G | DOMINANT | 1.51E−02 | 1.69E−01 | 0.5356 | 0.3959 | 0.0036 | 82.2 |
| rs10947871 | Imputed | A | DOMINANT | 2.83E−05 | 2.83E−05 | 1.6668 | 1.6668 | 0.5021 | 0 |
| rs10972978 | Imputed | G | DOMINANT | 4.09E−03 | 0.1884 | 0.6606 | 0.6715 | 0.0152 | 76.11 |
| rs10973012 | Imputed | A | DOMINANT | 3.10E−03 | 0.1472 | 0.6558 | 0.6652 | 0.0252 | 72.84 |
| rs10974028 | Genotyped | G | ADDITIVE | 6.17E−03 | 2.38E−01 | 0.7519 | 0.7698 | 0.0127 | 77.08 |
| rs10974028 | Genotyped | G | DOMINANT | 1.85E−03 | 2.16E−01 | 0.6916 | 0.7096 | 0.0051 | 81.08 |
| rs11021302 | Imputed | A | ADDITIVE | 9.21E−05 | 9.21E−05 | 1.3623 | 1.3623 | 0.4193 | 0 |
| rs11021302 | Imputed | A | GENOTYPIC | 7.34E−05 | 7.34E−05 | 1.9274 | 1.9274 | 0.3854 | 0 |
| rs11099644 | Imputed | G | RECESSIVE | 3.63E−03 | 1.74E−01 | 1.5611 | 1.5084 | 0.0227 | 73.6 |
| rs11138315 | Imputed | G | ADDITIVE | 5.97E−05 | 5.97E−05 | 0.6045 | 0.6045 | 0.6837 | 0 |
| rs11149802 | Imputed | T | DOMINANT | 1.00E−04 | 1.00E−04 | 1.6031 | 1.6031 | 0.379 | 0 |
| rs1116596 | Imputed | T | DOMINANT | 3.36E−07 | 3.36E−07 | 0.5781 | 0.5781 | 0.9145 | 0 |
| rs11178531 | Imputed | A | ADDITIVE | 5.04E−05 | 5.04E−05 | 0.7345 | 0.7345 | 0.9113 | 0 |
| rs11178531 | Imputed | A | DOMINANT | 1.62E−05 | 1.62E−05 | 0.6062 | 0.6062 | 0.7273 | 0 |
| rs11178575 | Imputed | C | GENOTYPIC | 7.77E−05 | 7.77E−05 | 2.0518 | 2.0518 | 0.4613 | 0 |
| rs11178575 | Imputed | C | RECESSIVE | 8.55E−05 | 8.55E−05 | 1.9633 | 1.9633 | 0.6307 | 0 |
| rs11178577 | Imputed | T | GENOTYPIC | 8.19E−05 | 8.19E−05 | 2.0467 | 2.0467 | 0.4668 | 0 |
| rs11178577 | Imputed | T | RECESSIVE | 8.45E−05 | 8.45E−05 | 1.9643 | 1.9643 | 0.6423 | 0 |
| rs11178583 | Imputed | A | DOMINANT | 3.48E−05 | 3.48E−05 | 0.6311 | 0.6311 | 0.6157 | 0 |
| rs11178589 | Imputed | T | DOMINANT | 6.58E−05 | 6.58E−05 | 0.6416 | 0.6416 | 0.759 | 0 |
| rs11178594 | Imputed | C | DOMINANT | 2.21E−05 | 2.21E−05 | 0.6259 | 0.6259 | 0.7529 | 0 |
| rs11178602 | Imputed | T | DOMINANT | 1.96E−05 | 1.96E−05 | 0.6239 | 0.6239 | 0.7278 | 0 |
| rs11178648 | Imputed | T | DOMINANT | 4.60E−06 | 4.60E−06 | 0.6044 | 0.6044 | 0.7746 | 0 |
| rs11198877 | Imputed | T | DOMINANT | 5.89E−05 | 5.89E−05 | 1.5335 | 1.5335 | 0.418 | 0 |
| rs11198942 | Imputed | T | DOMINANT | 4.04E−05 | 4.04E−05 | 1.5455 | 1.5455 | 0.4358 | 0 |
| rs11221075 | Imputed | A | ADDITIVE | 4.74E−05 | 4.74E−05 | 0.6113 | 0.6113 | 0.5392 | 0 |
| rs11242020 | Imputed | T | DOMINANT | 2.55E−07 | 2.55E−07 | 0.5746 | 0.5746 | 0.9225 | 0 |
| rs11242021 | Imputed | T | DOMINANT | 4.26E−07 | 4.26E−07 | 0.5804 | 0.5804 | 0.9558 | 0 |
| rs11242022 | Imputed | T | DOMINANT | 5.79E−07 | 5.79E−07 | 0.5841 | 0.5841 | 0.9318 | 0 |
| rs11242023 | Imputed | T | DOMINANT | 5.92E−07 | 5.92E−07 | 0.5843 | 0.5843 | 0.9496 | 0 |
| rs1149350 | Imputed | A | DOMINANT | 2.45E−03 | 1.30E−01 | 1.3997 | 1.3907 | 0.0257 | 72.68 |
| rs1150143 | Imputed | G | DOMINANT | 6.34E−04 | 3.31E−02 | 1.4503 | 1.4366 | 0.0937 | 57.77 |
| rs11576627 | Imputed | T | ADDITIVE | 4.22E−05 | 4.22E−05 | 1.5665 | 1.5665 | 0.6281 | 0 |
| rs11576627 | Imputed | T | DOMINANT | 3.05E−05 | 3.05E−05 | 1.6676 | 1.6676 | 0.7461 | 0 |
| rs11602189 | Imputed | A | DOMINANT | 1.82E−04 | 0.001317 | 0.6717 | 0.6744 | 0.2718 | 23.24 |
| rs11605163 | Imputed | A | DOMINANT | 0.000708 | 0.02749 | 1.6562 | 1.6712 | 0.0948 | 57.56 |
| rs11615214 | Imputed | G | ADDITIVE | 5.75E−06 | 5.75E−06 | 0.7047 | 0.7047 | 0.5765 | 0 |
| rs11615214 | Imputed | G | GENOTYPIC | 2.91E−06 | 2.91E−06 | 0.4566 | 0.4566 | 0.4781 | 0 |
| rs11642394 | Imputed | C | DOMINANT | 9.69E−05 | 9.69E−05 | 1.6046 | 1.6046 | 0.3847 | 0 |
| rs11644943 | Imputed | A | ADDITIVE | 6.34E−05 | 6.34E−05 | 1.4362 | 1.4362 | 0.687 | 0 |
| rs11656608 | Imputed | T | DOMINANT | 5.19E−05 | 5.19E−05 | 0.6191 | 0.6191 | 0.5685 | 0 |
| rs11661309 | Imputed | A | ADDITIVE | 3.44E−05 | 3.44E−05 | 0.6656 | 0.6656 | 0.471 | 0 |
| rs11661309 | Imputed | A | DOMINANT | 2.13E−04 | 8.96E−04 | 0.6556 | 0.657 | 0.2991 | 17.16 |
| rs11666131 | Imputed | A | ADDITIVE | 3.25E−04 | 6.19E−03 | 1.3849 | 1.3772 | 0.1964 | 38.55 |

TABLE 13-continued

| SNP rs # | SOURCE | ALLELE (A1) | MODEL | P | P(R) | OR | OR(R) | Q | I |
|---|---|---|---|---|---|---|---|---|---|
| rs11743355 | Imputed | C | ADDITIVE | 1.07E-02 | 1.27E-01 | 0.5495 | 0.3573 | 0.0028 | 82.99 |
| rs11743355 | Imputed | C | DOMINANT | 1.87E-02 | 1.70E-01 | 0.5389 | 0.3746 | 0.0027 | 83.11 |
| rs11746806 | Imputed | T | ADDITIVE | 8.22E-03 | 0.1202 | 0.5498 | 0.3996 | 0.0061 | 80.4 |
| rs11746806 | Imputed | T | DOMINANT | 1.56E-02 | 1.68E-01 | 0.5436 | 0.4204 | 0.006 | 80.44 |
| rs11746959 | Imputed | T | ADDITIVE | 8.37E-03 | 1.24E-01 | 0.5451 | 0.3771 | 0.0037 | 82.12 |
| rs11746959 | Imputed | T | DOMINANT | 1.51E-02 | 1.69E-01 | 0.5356 | 0.3959 | 0.0036 | 82.2 |
| rs11749272 | Imputed | T | DOMINANT | 3.75E-07 | 3.75E-07 | 0.5789 | 0.5789 | 0.9197 | 0 |
| rs11901899 | Imputed | A | DOMINANT | 5.05E-05 | 5.05E-05 | 1.5436 | 1.5436 | 0.6491 | 0 |
| rs11926319 | Imputed | G | ADDITIVE | 2.62E-05 | 3.51E-02 | 0.5502 | 0.5519 | 0.0242 | 73.13 |
| rs11926319 | Imputed | G | DOMINANT | 4.50E-05 | 0.04527 | 0.5488 | 0.5505 | 0.0199 | 74.48 |
| rs11956952 | Imputed | C | DOMINANT | 8.97E-05 | 8.97E-05 | 0.6544 | 0.6544 | 0.9288 | 0 |
| rs12025826 | Imputed | G | DOMINANT | 9.61E-05 | 9.61E-05 | 1.5444 | 1.5444 | 0.6337 | 0 |
| rs1204522 | Imputed | C | GENOTYPIC | 1.76E-03 | 0.09323 | 0.5754 | 0.5955 | 0.0532 | 65.92 |
| rs1204524 | Imputed | A | GENOTYPIC | 1.75E-03 | 0.09548 | 0.5752 | 0.5962 | 0.0519 | 66.2 |
| rs12153185 | Imputed | T | DOMINANT | 3.02E-07 | 3.02E-07 | 0.575 | 0.575 | 0.965 | 0 |
| rs12182651 | Imputed | T | ADDITIVE | 4.03E-04 | 6.63E-02 | 1.6379 | 1.6775 | 0.0204 | 74.32 |
| rs12182651 | Imputed | T | DOMINANT | 9.90E-05 | 0.06125 | 1.8091 | 1.8433 | 0.0126 | 77.13 |
| rs12193568 | Imputed | G | DOMINANT | 5.33E-05 | 5.33E-05 | 1.7043 | 1.7043 | 0.4515 | 0 |
| rs12264914 | Imputed | C | DOMINANT | 9.89E-05 | 9.89E-05 | 0.5796 | 0.5796 | 0.4664 | 0 |
| rs12307767 | Imputed | C | DOMINANT | 7.20E-05 | 7.20E-05 | 0.6476 | 0.6476 | 0.5868 | 0 |
| rs1232298 | Imputed | G | RECESSIVE | 4.05E-05 | 4.05E-05 | 2.0359 | 2.0359 | 0.4524 | 0 |
| rs12407412 | Imputed | C | ADDITIVE | 4.22E-05 | 4.22E-05 | 1.5665 | 1.5665 | 0.6281 | 0 |
| rs12407412 | Imputed | C | DOMINANT | 3.05E-05 | 3.05E-05 | 1.6676 | 1.6676 | 0.7461 | 0 |
| rs12420184 | Imputed | G | DOMINANT | 1.51E-02 | 0.4077 | 0.7481 | 0.7745 | 0.0016 | 84.53 |
| rs12422750 | Imputed | A | DOMINANT | 9.60E-05 | 9.60E-05 | 0.6598 | 0.6598 | 0.5137 | 0 |
| rs12446951 | Imputed | A | ADDITIVE | 3.93E-05 | 1.09E-04 | 2.0253 | 2.0349 | 0.3226 | 11.62 |
| rs12446951 | Imputed | A | DOMINANT | 4.82E-05 | 4.82E-05 | 2.049 | 2.049 | 0.3973 | 0 |
| rs12457400 | Imputed | G | DOMINANT | 7.89E-05 | 7.89E-05 | 0.5854 | 0.5854 | 0.8723 | 0 |
| rs1247340 | Imputed | C | DOMINANT | 2.05E-03 | 0.1157 | 1.4086 | 1.4002 | 0.0296 | 71.6 |
| rs1247341 | Imputed | C | DOMINANT | 1.57E-03 | 1.02E-01 | 1.4213 | 1.4156 | 0.0312 | 71.17 |
| rs12521291 | Imputed | G | ADDITIVE | 1.87E-03 | 1.09E-01 | 0.7805 | 0.7921 | 0.04 | 68.92 |
| rs12526849 | Imputed | T | ADDITIVE | 7.17E-04 | 0.03214 | 1.2878 | 1.2722 | 0.1105 | 54.59 |
| rs12526849 | Imputed | T | GENOTYPIC | 3.38E-04 | 5.04E-03 | 1.7306 | 1.7075 | 0.2173 | 34.49 |
| rs12543110 | Imputed | G | DOMINANT | 5.89E-05 | 5.89E-05 | 1.5358 | 1.5358 | 0.5248 | 0 |
| rs12678600 | Imputed | A | DOMINANT | 1.00E-04 | 1.00E-04 | 0.6602 | 0.6602 | 0.5151 | 0 |
| rs12719415 | Imputed | T | DOMINANT | 2.53E-07 | 2.53E-07 | 0.5739 | 0.5739 | 0.9166 | 0 |
| rs12831292 | Imputed | G | DOMINANT | 2.63E-05 | 2.63E-05 | 0.6278 | 0.6278 | 0.7312 | 0 |
| rs12923993 | Imputed | C | DOMINANT | 9.69E-05 | 9.69E-05 | 1.6046 | 1.6046 | 0.3847 | 0 |
| rs12936964 | Imputed | T | DOMINANT | 3.11E-04 | 2.93E-03 | 1.4884 | 1.4756 | 0.2539 | 27.04 |
| rs12960663 | Imputed | G | ADDITIVE | 4.89E-05 | 4.89E-05 | 0.6695 | 0.6695 | 0.515 | 0 |
| rs13038146 | Imputed | C | ADDITIVE | 3.11E-05 | 3.11E-05 | 1.376 | 1.376 | 0.9378 | 0 |
| rs13038146 | Imputed | C | GENOTYPIC | 2.11E-05 | 2.11E-05 | 2.0071 | 2.0071 | 0.9192 | 0 |
| rs13134222 | Imputed | A | GENOTYPIC | 1.96E-02 | 3.26E-01 | 0.5583 | 0.5463 | 0.0028 | 82.95 |
| rs13172910 | Imputed | A | DOMINANT | 7.00E-05 | 7.00E-05 | 0.6505 | 0.6505 | 0.9366 | 0 |
| rs13194907 | Imputed | A | ADDITIVE | 0.0002176 | 0.02467 | 1.7666 | 1.7835 | 0.0668 | 63.04 |
| rs13194907 | Imputed | A | DOMINANT | 6.05E-05 | 0.01168 | 1.9281 | 1.9369 | 0.0827 | 59.88 |
| rs13195745 | Imputed | A | ADDITIVE | 2.18E-04 | 2.47E-02 | 1.7666 | 1.7835 | 0.0668 | 63.04 |
| rs13195745 | Imputed | A | DOMINANT | 6.05E-05 | 1.17E-02 | 1.9281 | 1.9369 | 0.0827 | 59.88 |
| rs1321432 | Imputed | A | RECESSIVE | 8.48E-04 | 0.08213 | 1.6508 | 1.6057 | 0.0423 | 68.39 |
| rs1321457 | Imputed | G | RECESSIVE | 0.001376 | 0.1001 | 1.6314 | 1.5668 | 0.0465 | 67.4 |
| rs13265054 | Imputed | T | DOMINANT | 6.52E-05 | 6.52E-05 | 0.6518 | 0.6518 | 0.6806 | 0 |
| rs13282131 | Imputed | C | GENOTYPIC | 6.27E-05 | 6.27E-05 | 1.8345 | 1.8345 | 0.9895 | 0 |
| rs13353526 | Imputed | C | DOMINANT | 0.004081 | 0.1849 | 1.4667 | 1.4829 | 0.0079 | 79.32 |
| rs1336382 | Imputed | T | DOMINANT | 5.09E-05 | 5.09E-05 | 1.5361 | 1.5361 | 0.4725 | 0 |
| rs1336383 | Imputed | T | DOMINANT | 5.09E-05 | 5.09E-05 | 1.5361 | 1.5361 | 0.4725 | 0 |
| rs1336407 | Imputed | T | DOMINANT | 5.93E-05 | 5.93E-05 | 1.5308 | 1.5308 | 0.4544 | 0 |
| rs1336409 | Imputed | T | DOMINANT | 6.50E-05 | 6.50E-05 | 1.5274 | 1.5274 | 0.444 | 0 |
| rs1336596 | Imputed | A | DOMINANT | 5.26E-04 | 3.65E-02 | 0.6858 | 0.7027 | 0.0985 | 56.85 |
| rs1343560 | Imputed | T | ADDITIVE | 6.41E-02 | 5.75E-01 | 0.7895 | 0.8024 | 0.0001 | 89.05 |
| rs1343560 | Imputed | T | DOMINANT | 6.21E-02 | 5.51E-01 | 0.775 | 0.7751 | 0.0001 | 89.44 |
| rs1361987 | Imputed | T | GENOTYPIC | 2.87E-03 | 1.52E-01 | 0.5945 | 0.6201 | 0.0307 | 71.3 |
| rs1386153 | Imputed | T | ADDITIVE | 0.0001163 | 0.0001163 | 0.7313 | 0.7313 | 0.4314 | 0 |
| rs1386153 | Imputed | T | DOMINANT | 0.0001226 | 0.0004692 | 0.6655 | 0.6672 | 0.3089 | 14.88 |
| rs1394015 | Imputed | C | DOMINANT | 4.04E-05 | 4.04E-05 | 1.7398 | 1.7398 | 0.8288 | 0 |
| rs1407038 | Imputed | A | RECESSIVE | 1.15E-03 | 0.09526 | 1.6392 | 1.5778 | 0.0445 | 67.86 |
| rs1407039 | Imputed | A | RECESSIVE | 1.54E-03 | 0.08002 | 1.6009 | 1.5561 | 0.0626 | 63.92 |
| rs1412802 | Imputed | T | GENOTYPIC | 9.49E-05 | 9.49E-05 | 0.4269 | 0.4269 | 0.9393 | 0 |
| rs1414865 | Imputed | T | DOMINANT | 6.84E-05 | 6.84E-05 | 1.5282 | 1.5282 | 0.4028 | 0 |
| rs1414873 | Imputed | A | DOMINANT | 5.05E-05 | 5.05E-05 | 1.5365 | 1.5365 | 0.433 | 0 |
| rs1414876 | Imputed | C | DOMINANT | 5.05E-05 | 5.05E-05 | 1.5365 | 1.5365 | 0.433 | 0 |
| rs1418671 | Imputed | C | RECESSIVE | 8.77E-05 | 1.17E-02 | 1.79 | 1.752 | 0.1097 | 54.76 |
| rs1419490 | Genotyped | T | GENOTYPIC | 1.69E-03 | 1.04E-01 | 0.5757 | 0.6036 | 0.051 | 66.41 |
| rs1434507 | Imputed | A | ADDITIVE | 3.80E-04 | 1.15E-02 | 1.3574 | 1.3388 | 0.175 | 42.63 |
| rs1434508 | Imputed | T | ADDITIVE | 4.60E-04 | 1.09E-02 | 1.3515 | 1.3341 | 0.1863 | 40.49 |
| rs1435205 | Imputed | A | ADDITIVE | 9.12E-04 | 2.82E-02 | 1.348 | 1.3411 | 0.1188 | 53.05 |
| rs1443928 | Imputed | C | RECESSIVE | 9.45E-04 | 4.30E-02 | 0.6717 | 0.6702 | 0.0739 | 61.62 |
| rs1452235 | Imputed | G | GENOTYPIC | 5.06E-02 | 5.71E-01 | 0.7054 | 0.7381 | 0.0001 | 88.72 |

TABLE 13-continued

| SNP rs # | SOURCE | ALLELE (A1) | MODEL | P | P(R) | OR | OR(R) | Q | I |
|---|---|---|---|---|---|---|---|---|---|
| rs1452236 | Imputed | G | GENOTYPIC | 4.94E-02 | 5.70E-01 | 0.7041 | 0.7369 | 0.0001 | 88.77 |
| rs1452237 | Imputed | G | GENOTYPIC | 5.06E-02 | 5.71E-01 | 0.7054 | 0.7381 | 0.0001 | 88.72 |
| rs1452243 | Genotyped | T | GENOTYPIC | 5.39E-02 | 5.77E-01 | 0.7092 | 0.7402 | 0.0001 | 88.89 |
| rs1463768 | Genotyped | G | RECESSIVE | 2.87E-05 | 3.63E-05 | 1.813 | 1.8163 | 0.3578 | 2.71 |
| rs1463769 | Imputed | G | RECESSIVE | 2.08E-05 | 2.08E-05 | 1.8336 | 1.8336 | 0.3916 | 0 |
| rs1472435 | Imputed | A | ADDITIVE | 4.20E-05 | 4.20E-05 | 0.5101 | 0.5101 | 0.5038 | 0 |
| rs1472435 | Imputed | A | DOMINANT | 8.16E-05 | 8.16E-05 | 0.5146 | 0.5146 | 0.4725 | 0 |
| rs1476714 | Imputed | A | DOMINANT | 3.69E-07 | 3.69E-07 | 0.5781 | 0.5781 | 0.9536 | 0 |
| rs1495159 | Imputed | G | ADDITIVE | 0.009749 | 0.3924 | 0.8068 | 0.8189 | 0.0005 | 86.97 |
| rs1495159 | Imputed | G | GENOTYPIC | 3.08E-03 | 1.34E-01 | 0.5615 | 0.5708 | 0.0278 | 72.1 |
| rs1495375 | Imputed | A | DOMINANT | 3.20E-05 | 3.20E-05 | 0.6273 | 0.6273 | 0.709 | 0 |
| rs1495376 | Imputed | T | DOMINANT | 2.76E-05 | 3.75E-04 | 0.5966 | 0.5952 | 0.2528 | 27.28 |
| rs1495377 | Imputed | G | DOMINANT | 5.28E-05 | 0.0006669 | 0.6086 | 0.6065 | 0.2463 | 28.63 |
| rs1495381 | Imputed | T | GENOTYPIC | 1.97E-05 | 1.97E-05 | 1.9868 | 1.9868 | 0.6544 | 0 |
| rs1495381 | Imputed | T | RECESSIVE | 3.14E-06 | 3.14E-06 | 1.9704 | 1.9704 | 0.904 | 0 |
| rs1498992 | Imputed | G | DOMINANT | 4.91E-05 | 4.91E-05 | 0.6496 | 0.6496 | 0.6335 | 0 |
| rs1499001 | Imputed | T | DOMINANT | 9.99E-05 | 9.99E-05 | 0.6588 | 0.6588 | 0.5929 | 0 |
| rs1512988 | Imputed | A | DOMINANT | 3.15E-05 | 3.15E-05 | 0.6309 | 0.6309 | 0.7406 | 0 |
| rs1512989 | Imputed | T | DOMINANT | 3.15E-05 | 3.15E-05 | 0.6309 | 0.6309 | 0.7406 | 0 |
| rs1512991 | Imputed | T | ADDITIVE | 4.36E-05 | 4.36E-05 | 0.7304 | 0.7304 | 0.9674 | 0 |
| rs1512991 | Imputed | T | DOMINANT | 2.35E-05 | 2.35E-05 | 0.6133 | 0.6133 | 0.7725 | 0 |
| rs1516855 | Imputed | G | RECESSIVE | 2.16E-04 | 3.15E-03 | 1.8266 | 1.832 | 0.214 | 35.15 |
| rs1527450 | Imputed | T | ADDITIVE | 4.98E-05 | 0.0004174 | 1.3805 | 1.3796 | 0.2782 | 21.84 |
| rs1527450 | Imputed | T | GENOTYPIC | 5.39E-05 | 0.0005959 | 1.9591 | 1.9507 | 0.2671 | 24.24 |
| rs1567740 | Imputed | T | DOMINANT | 3.10E-05 | 3.10E-05 | 0.6303 | 0.6303 | 0.7208 | 0 |
| rs1572573 | Imputed | A | ADDITIVE | 2.29E-04 | 4.0251 | 1.4476 | 1.3911 | 0.0856 | 59.31 |
| rs1572573 | Imputed | A | DOMINANT | 9.40E-05 | 4.64E-02 | 1.562 | 1.5083 | 0.0429 | 68.24 |
| rs1584003 | Imputed | C | DOMINANT | 3.34E-02 | 0.561 | 1.2949 | 1.2466 | 0.0001 | 89.29 |
| rs1584005 | Imputed | C | DOMINANT | 4.02E-02 | 5.68E-01 | 1.2838 | 1.2385 | 0.0001 | 89 |
| rs1585771 | Imputed | G | ADDITIVE | 1.04E-03 | 4.0355 | 1.3199 | 1.3042 | 0.0982 | 56.91 |
| rs1592015 | Imputed | G | DOMINANT | 0.002751 | 0.1964 | 0.7042 | 0.7334 | 0.018 | 75.11 |
| rs1594885 | Imputed | A | ADDITIVE | 0.000164 | 0.004814 | 1.3801 | 1.3638 | 0.201 | 37.68 |
| rs1603232 | Imputed | A | DOMINANT | 6.82E-05 | 7.72E-05 | 0.6125 | 0.6124 | 0.3627 | 1.4 |
| rs1614565 | Imputed | C | DOMINANT | 1.67E-05 | 2.91E-05 | 0.5932 | 0.5932 | 0.3482 | 5.22 |
| rs1648200 | Imputed | G | ADDITIVE | 9.92E-05 | 9.92E-05 | 1.428 | 1.428 | 0.791 | 0 |
| rs16877387 | Imputed | C | GENOTYPIC | 5.85E-04 | 2.88E-02 | 1.7999 | 1.7462 | 0.1152 | 53.73 |
| rs16877387 | Imputed | C | RECESSIVE | 1.06E-04 | 0.00243 | 1.8666 | 1.8409 | 0.2165 | 34.65 |
| rs16938626 | Imputed | G | DOMINANT | 6.97E-05 | 6.97E-05 | 0.6537 | 0.6537 | 0.5901 | 0 |
| rs1694334 | Imputed | G | ADDITIVE | 3.41E-03 | 1.76E-01 | 0.7552 | 0.7708 | 0.0228 | 73.54 |
| rs16998821 | Imputed | C | DOMINANT | 2.75E-03 | 1.96E-01 | 0.7042 | 0.7334 | 0.018 | 75.11 |
| rs1700400 | Imputed | T | ADDITIVE | 2.87E-04 | 1.62E-02 | 0.7267 | 0.7259 | 0.1095 | 54.78 |
| rs17007620 | Imputed | G | ADDITIVE | 0.0002711 | 0.02062 | 1.4055 | 1.3946 | 0.0989 | 56.78 |
| rs17007620 | Imputed | G | DOMINANT | 0.0001384 | 0.003404 | 1.5358 | 1.5258 | 0.1998 | 37.9 |
| rs17023290 | Imputed | C | DOMINANT | 0.003653 | 0.1786 | 1.4802 | 1.4969 | 0.0084 | 79.08 |
| rs17047957 | Imputed | C | DOMINANT | 2.41E-05 | 2.41E-05 | 1.6313 | 1.6313 | 0.7603 | 0 |
| rs1705237 | Imputed | A | DOMINANT | 1.23E-05 | 3.98E-05 | 0.5877 | 0.5877 | 0.326 | 10.78 |
| rs1705261 | Imputed | A | GENOTYPIC | 2.16E-05 | 2.16E-05 | 1.9729 | 1.9729 | 0.7039 | 0 |
| rs1705261 | Imputed | A | RECESSIVE | 3.71E-06 | 3.71E-06 | 1.9521 | 1.9521 | 0.9207 | 0 |
| rs17076972 | Imputed | C | ADDITIVE | 0.0005241 | 0.01788 | 1.2997 | 1.2903 | 0.1408 | 48.99 |
| rs17076972 | Imputed | C | GENOTYPIC | 0.0004395 | 0.02097 | 1.7025 | 1.6732 | 0.1233 | 52.23 |
| rs17076972 | Imputed | C | RECESSIVE | 7.62E-04 | 4.50E-02 | 1.5342 | 1.5023 | 0.0868 | 59.08 |
| rs17189710 | Imputed | T | ADDITIVE | 3.68E-05 | 3.68E-05 | 1.3739 | 1.3739 | 0.9395 | 0 |
| rs17189710 | Imputed | T | GENOTYPIC | 2.19E-05 | 2.19E-05 | 2.0119 | 2.0119 | 0.9089 | 0 |
| rs17196143 | Imputed | A | ADDITIVE | 1.68E-02 | 4.65E-01 | 1.2599 | 1.2043 | 0.0013 | 84.9 |
| rs17353809 | Imputed | G | ADDITIVE | 7.94E-03 | 4.73E-02 | 1.3563 | 1.3441 | 0.0746 | 61.48 |
| rs17368986 | Imputed | A | GENOTYPIC | 0.0003311 | 0.01194 | 2.721 | 2.5843 | 0.1676 | 44.02 |
| rs17369097 | Imputed | A | GENOTYPIC | 2.42E-04 | 1.85E-03 | 2.7571 | 2.7036 | 0.2673 | 24.2 |
| rs17434511 | Imputed | C | GENOTYPIC | 0.0003164 | 0.0117 | 2.7302 | 2.5932 | 0.1672 | 44.1 |
| rs17434589 | Imputed | C | GENOTYPIC | 0.0002946 | 0.01171 | 2.7449 | 2.6054 | 0.1643 | 44.62 |
| rs17434603 | Imputed | G | GENOTYPIC | 0.0003271 | 0.01143 | 2.7233 | 2.5889 | 0.1701 | 43.55 |
| rs17434840 | Imputed | C | GENOTYPIC | 0.0002417 | 0.001846 | 2.7571 | 2.7036 | 0.2673 | 24.2 |
| rs17446418 | Imputed | G | DOMINANT | 0.0005194 | 0.08804 | 0.6822 | 0.714 | 0.0469 | 67.33 |
| rs17530747 | Imputed | T | DOMINANT | 0.0003577 | 0.0827 | 0.6735 | 0.7062 | 0.0438 | 68.03 |
| rs17604285 | Imputed | C | ADDITIVE | 0.0001077 | 0.01983 | 0.5857 | 0.5921 | 0.0823 | 59.95 |
| rs17604285 | Imputed | C | DOMINANT | 0.0001272 | 0.02188 | 0.5769 | 0.5823 | 0.0746 | 61.48 |
| rs17662322 | Imputed | T | DOMINANT | 8.83E-05 | 8.83E-05 | 0.6424 | 0.6424 | 0.4888 | 0 |
| rs17769826 | Imputed | T | ADDITIVE | 0.0008578 | 0.04731 | 1.3535 | 1.3419 | 0.0766 | 61.08 |
| rs17821641 | Imputed | T | ADDITIVE | 0.0009123 | 0.02815 | 1.348 | 1.3411 | 0.1188 | 53.05 |
| rs17782328 | Imputed | A | ADDITIVE | 0.0002285 | 0.0184 | 0.687 | 0.6954 | 0.116 | 53.58 |
| rs1796337 | Imputed | T | DOMINANT | 5.74E-05 | 5.74E-05 | 0.6075 | 0.6075 | 0.7452 | 0 |
| rs1798083 | Imputed | C | DOMINANT | 2.91E-05 | 2.91E-05 | 0.602 | 0.602 | 0.3963 | 0 |
| rs1798085 | Imputed | T | DOMINANT | 1.95E-05 | 3.15E-05 | 0.5952 | 0.5951 | 0.3506 | 4.59 |
| rs1798086 | Imputed | T | DOMINANT | 8.08E-06 | 1.64E-05 | 0.5778 | 0.5781 | 0.3453 | 5.95 |
| rs1798089 | Imputed | C | GENOTYPIC | 9.52E-05 | 9.52E-05 | 2.0099 | 2.0099 | 0.7968 | 0 |
| rs1798089 | Imputed | C | RECESSIVE | 1.73E-05 | 1.73E-05 | 1.9885 | 1.9885 | 0.8721 | 0 |
| rs1798090 | Imputed | C | GENOTYPIC | 8.44E-05 | 8.44E-05 | 2.0204 | 2.0204 | 0.8325 | 0 |
| rs1798090 | Imputed | C | RECESSIVE | 2.27E-05 | 2.27E-05 | 1.9652 | 1.9652 | 0.894 | 0 |

TABLE 13-continued

| SNP rs # | SOURCE | ALLELE (A1) | MODEL | P | P(R) | OR | OR(R) | Q | I |
|---|---|---|---|---|---|---|---|---|---|
| rs1832222 | Imputed | G | DOMINANT | 5.87E−05 | 5.87E−05 | 1.5311 | 1.5311 | 0.4163 | 0 |
| rs1838104 | Imputed | A | ADDITIVE | 0.0002117 | 0.003729 | 0.7525 | 0.7527 | 0.2031 | 37.26 |
| rs1838104 | Imputed | A | GENOTYPIC | 0.0002138 | 0.002807 | 0.5646 | 0.5645 | 0.2213 | 33.7 |
| rs1868616 | Imputed | G | ADDITIVE | 7.48E−05 | 0.0004629 | 0.6753 | 0.6791 | 0.2929 | 18.56 |
| rs1874313 | Imputed | A | DOMINANT | 3.30E−05 | 3.30E−05 | 0.6312 | 0.6312 | 0.6562 | 0 |
| rs1884902 | Imputed | C | RECESSIVE | 0.001151 | 0.07621 | 1.6251 | 1.5839 | 0.0555 | 65.41 |
| rs1913201 | Imputed | G | ADDITIVE | 1.89E−05 | 1.89E−05 | 0.7164 | 0.7164 | 0.8808 | 0 |
| rs1913201 | Imputed | G | DOMINANT | 2.91E−05 | 2.91E−05 | 0.6172 | 0.6172 | 0.7641 | 0 |
| rs1913201 | Imputed | G | GENOTYPIC | 7.80E−05 | 7.80E−05 | 0.5351 | 0.5351 | 0.6861 | 0 |
| rs1944279 | Imputed | A | ADDITIVE | 0.0001257 | 0.005478 | 1.3904 | 1.3724 | 0.1829 | 41.13 |
| rs198461 | Imputed | C | DOMINANT | 1.66E−06 | 1.66E−06 | 0.5498 | 0.5498 | 0.6534 | 0 |
| rs1987179 | Imputed | T | DOMINANT | 7.08E−05 | 7.08E−05 | 0.641 | 0.641 | 0.5343 | 0 |
| rs1990023 | Imputed | T | DOMINANT | 2.55E−07 | 2.55E−07 | 0.5746 | 0.5746 | 0.9225 | 0 |
| rs2016194 | Imputed | G | DOMINANT | 4.26E−07 | 4.26E−07 | 0.5804 | 0.5804 | 0.9558 | 0 |
| rs2024789 | Imputed | C | ADDITIVE | 0.0008551 | 0.04722 | 0.7786 | 0.789 | 0.0866 | 59.13 |
| rs2024789 | Imputed | C | GENOTYPIC | 0.001077 | 0.04627 | 0.6104 | 0.625 | 0.0938 | 57.75 |
| rs2024902 | Imputed | A | ADDITIVE | 0.0004002 | 0.02334 | 1.7111 | 1.7273 | 0.0887 | 58.72 |
| rs2024902 | Imputed | A | DOMINANT | 9.43E−05 | 0.01112 | 1.8804 | 1.8895 | 0.0981 | 56.93 |
| rs2025107 | Imputed | A | ADDITIVE | 0.0005021 | 0.06161 | 1.6166 | 1.6531 | 0.0272 | 72.27 |
| rs2025107 | Imputed | A | DOMINANT | 0.0001126 | 0.05784 | 1.7901 | 1.8228 | 0.0156 | 75.95 |
| rs2025108 | Imputed | T | ADDITIVE | 0.0005021 | 0.06161 | 1.6166 | 1.6531 | 0.0272 | 72.27 |
| rs2025108 | Imputed | T | DOMINANT | 0.0001126 | 0.05784 | 1.7901 | 1.8228 | 0.0156 | 75.95 |
| rs2062448 | Imputed | T | ADDITIVE | 0.0001197 | 0.0124 | 0.5855 | 0.5897 | 0.1132 | 54.1 |
| rs2062448 | Imputed | T | DOMINANT | 0.0001438 | 0.01375 | 0.5765 | 0.5801 | 0.1057 | 55.5 |
| rs2063591 | Imputed | C | ADDITIVE | 6.31E−05 | 6.31E−05 | 0.7382 | 0.7382 | 0.9476 | 0 |
| rs2063591 | Imputed | C | DOMINANT | 1.50E−05 | 1.50E−05 | 0.6047 | 0.6047 | 0.7317 | 0 |
| rs2065604 | Imputed | C | DOMINANT | 0.003098 | 0.1472 | 0.6558 | 0.6652 | 0.0252 | 72.84 |
| rs2066238 | Imputed | T | DOMINANT | 0.00258 | 0.1967 | 0.7027 | 0.7323 | 0.0172 | 75.39 |
| rs2068051 | Imputed | G | ADDITIVE | 0.0001657 | 0.004859 | 0.6917 | 0.7008 | 0.2023 | 37.41 |
| rs2068051 | Imputed | G | GENOTYPIC | 0.0002673 | 0.007654 | 0.4817 | 0.4968 | 0.1931 | 39.2 |
| rs2077702 | Genotyped | G | GENOTYPIC | 9.79E−05 | 9.79E−05 | 2.0248 | 2.0248 | 0.5151 | 0 |
| rs208757 | Imputed | G | ADDITIVE | 4.49E−05 | 4.49E−05 | 1.5013 | 1.5013 | 0.8401 | 0 |
| rs208757 | Imputed | G | DOMINANT | 9.41E−06 | 9.41E−06 | 1.6603 | 1.6603 | 0.7321 | 0 |
| rs2095586 | Imputed | A | DOMINANT | 5.72E−05 | 5.72E−05 | 1.532 | 1.532 | 0.4194 | 0 |
| rs2108426 | Imputed | C | DOMINANT | 4.02E−07 | 4.02E−07 | 0.5797 | 0.5797 | 0.9591 | 0 |
| rs2110664 | Imputed | A | DOMINANT | 8.67E−05 | 8.67E−05 | 1.5394 | 1.5394 | 0.8744 | 0 |
| rs2132242 | Imputed | A | DOMINANT | 2.72E−05 | 2.72E−05 | 0.6282 | 0.6282 | 0.7958 | 0 |
| rs2151644 | Imputed | T | DOMINANT | 0.003131 | 0.1517 | 0.656 | 0.6657 | 0.0236 | 73.31 |
| rs2157752 | Genotyped | A | GENOTYPIC | 0.0009168 | 0.05016 | 0.5431 | 0.5628 | 0.0902 | 58.44 |
| rs2158958 | Imputed | A | DOMINANT | 4.20E−07 | 4.20E−07 | 0.5804 | 0.5804 | 0.9556 | 0 |
| rs2158961 | Imputed | G | DOMINANT | 1.33E−06 | 1.33E−06 | 0.5977 | 0.5977 | 0.8737 | 0 |
| rs2164099 | Imputed | G | ADDITIVE | 0.0001863 | 0.006344 | 1.376 | 1.3584 | 0.1883 | 40.11 |
| rs2173254 | Imputed | G | GENOTYPIC | 0.002362 | 0.118 | 0.5447 | 0.533 | 0.0217 | 73.89 |
| rs2173254 | Imputed | G | RECESSIVE | 0.002217 | 0.0789 | 0.5578 | 0.5403 | 0.042 | 68.46 |
| rs2188079 | Imputed | C | ADDITIVE | 0.0001838 | 0.02268 | 1.3319 | 1.321 | 0.0862 | 59.19 |
| rs2188079 | Imputed | C | GENOTYPIC | 0.0001122 | 0.0128 | 1.8273 | 1.7987 | 0.1109 | 54.53 |
| rs2190304 | Imputed | G | RECESSIVE | 0.01058 | 0.4116 | 0.7116 | 0.7366 | 0.0005 | 86.94 |
| rs2190597 | Imputed | T | DOMINANT | 9.78E−05 | 9.78E−05 | 0.6395 | 0.6395 | 0.4926 | 0 |
| rs2190598 | Imputed | T | DOMINANT | 4.20E−07 | 4.20E−07 | 0.5804 | 0.5804 | 0.9556 | 0 |
| rs2190600 | Imputed | A | DOMINANT | 3.37E−07 | 3.37E−07 | 0.5762 | 0.5762 | 0.9653 | 0 |
| rs2218084 | Imputed | T | GENOTYPIC | 9.58E−05 | 9.58E−05 | 3.531 | 3.531 | 0.7772 | 0 |
| rs2218084 | Imputed | T | RECESSIVE | 8.93E−05 | 8.93E−05 | 3.5234 | 3.5234 | 0.8908 | 0 |
| rs2236290 | Genotyped | C | GENOTYPIC | 6.42E−05 | 6.42E−05 | 0.4993 | 0.4993 | 0.9011 | 0 |
| rs2243860 | Imputed | A | GENOTYPIC | 7.41E−05 | 7.41E−05 | 2.0648 | 2.0648 | 0.8032 | 0 |
| rs2243860 | Imputed | A | RECESSIVE | 8.56E−05 | 8.56E−05 | 1.9204 | 1.9204 | 0.6639 | 0 |
| rs2246564 | Imputed | T | DOMINANT | 0.003098 | 0.1472 | 0.6558 | 0.6652 | 0.0252 | 72.84 |
| rs2248236 | Imputed | C | DOMINANT | 7.76E−05 | 7.76E−05 | 0.6498 | 0.6498 | 0.545 | 0 |
| rs2250340 | Imputed | T | DOMINANT | 0.003303 | 0.1528 | 0.6523 | 0.6609 | 0.0229 | 73.54 |
| rs2257192 | Imputed | G | DOMINANT | 0.003098 | 0.1472 | 0.6558 | 0.6652 | 0.0252 | 72.84 |
| rs2270584 | Imputed | A | DOMINANT | 4.80E−06 | 4.80E−06 | 0.605 | 0.605 | 0.7982 | 0 |
| rs2270586 | Imputed | A | DOMINANT | 5.31E−06 | 5.31E−06 | 0.6041 | 0.6041 | 0.7347 | 0 |
| rs2270589 | Imputed | A | ADDITIVE | 2.81E−06 | 2.81E−06 | 0.6877 | 0.6877 | 0.8813 | 0 |
| rs2270589 | Imputed | A | DOMINANT | 2.60E−07 | 2.60E−07 | 0.5336 | 0.5336 | 0.71 | 0 |
| rs2270589 | Imputed | A | GENOTYPIC | 1.28E−05 | 1.28E−05 | 0.4977 | 0.4977 | 0.7794 | 0 |
| rs2296889 | Imputed | C | DOMINANT | 0.002588 | 0.1138 | 1.4232 | 1.4076 | 0.0374 | 69.56 |
| rs2301346 | Imputed | C | ADDITIVE | 0.0002178 | 0.0338 | 1.3978 | 1.3772 | 0.0701 | 62.37 |
| rs2301346 | Imputed | C | DOMINANT | 0.0001352 | 0.02587 | 1.5644 | 1.5455 | 0.0672 | 62.97 |
| rs2327929 | Imputed | G | RECESSIVE | 1.06E−05 | 1.06E−05 | 1.7928 | 1.7928 | 0.4369 | 0 |
| rs2357486 | Imputed | C | RECESSIVE | 0.00295 | 0.1854 | 1.7126 | 1.6148 | 0.024 | 73.18 |
| rs2373793 | Imputed | G | DOMINANT | 4.57E−05 | 4.57E−05 | 1.617 | 1.617 | 0.8752 | 0 |
| rs2377622 | Imputed | T | GENOTYPIC | 2.11E−05 | 2.11E−05 | 0.3896 | 0.3896 | 0.7037 | 0 |
| rs2377622 | Imputed | T | RECESSIVE | 2.44E−05 | 2.44E−05 | 0.4115 | 0.4115 | 0.6397 | 0 |
| rs2383903 | Imputed | G | DOMINANT | 3.69E−05 | 3.69E−05 | 0.645 | 0.645 | 0.6185 | 0 |
| rs2389866 | Imputed | C | DOMINANT | 4.60E−05 | 4.60E−05 | 0.6408 | 0.6408 | 0.6066 | 0 |
| rs2389869 | Imputed | C | DOMINANT | 4.60E−05 | 4.60E−05 | 0.6408 | 0.6408 | 0.6066 | 0 |
| rs2418541 | Imputed | A | DOMINANT | 3.36E−07 | 3.36E−07 | 0.5781 | 0.5781 | 0.9145 | 0 |
| rs2418542 | Imputed | A | DOMINANT | 3.36E−07 | 3.36E−07 | 0.5781 | 0.5781 | 0.9145 | 0 |

TABLE 13-continued

| SNP rs # | SOURCE | ALLELE (A1) | MODEL | P | P(R) | OR | OR(R) | Q | I |
|---|---|---|---|---|---|---|---|---|---|
| rs2418548 | Imputed | C | DOMINANT | 2.36E-06 | 2.36E-06 | 0.598 | 0.598 | 0.9168 | 0 |
| rs2476976 | Imputed | C | DOMINANT | 7.42E-05 | 7.42E-05 | 1.5229 | 1.5229 | 0.5546 | 0 |
| rs2483639 | Imputed | A | DOMINANT | 0.003098 | 0.1472 | 0.6558 | 0.6652 | 0.0252 | 72.84 |
| rs2483640 | Imputed | A | DOMINANT | 0.003098 | 0.1472 | 0.6558 | 0.6652 | 0.0252 | 72.84 |
| rs2544780 | Imputed | T | RECESSIVE | 7.90E-05 | 7.90E-05 | 2.0334 | 2.0334 | 0.4674 | 0 |
| rs2586458 | Imputed | T | DOMINANT | 0.03011 | 0.336 | 0.7195 | 0.6895 | 0.0016 | 84.47 |
| rs2593272 | Imputed | G | ADDITIVE | 0.0002545 | 0.004989 | 0.7307 | 0.7296 | 0.1874 | 40.27 |
| rs2593273 | Imputed | T | ADDITIVE | 0.0005623 | 0.03 | 0.7408 | 0.7417 | 0.0868 | 59.09 |
| rs2622499 | Imputed | G | DOMINANT | 9.25E-05 | 9.25E-05 | 0.6531 | 0.6531 | 0.5221 | 0 |
| rs264126 | Imputed | C | DOMINANT | 8.31E-05 | 8.31E-05 | 0.6369 | 0.6369 | 0.4319 | 0 |
| rs264129 | Imputed | T | DOMINANT | 1.21E-06 | 1.21E-06 | 0.5966 | 0.5966 | 0.8652 | 0 |
| rs2656822 | Imputed | T | ADDITIVE | 0.0002545 | 0.004989 | 0.7307 | 0.7296 | 0.1874 | 40.27 |
| rs2656823 | Imputed | G | ADDITIVE | 0.0002545 | 0.004989 | 0.7307 | 0.7296 | 0.1874 | 40.27 |
| rs2656825 | Imputed | T | ADDITIVE | 0.0008702 | 0.04621 | 0.7415 | 0.7347 | 0.0581 | 64.86 |
| rs2764766 | Imputed | C | RECESSIVE | 8.08E-05 | 8.08E-05 | 2.0146 | 2.0146 | 0.461 | 0 |
| rs2793101 | Imputed | T | ADDITIVE | 0.001506 | 0.1134 | 0.6664 | 0.691 | 0.0408 | 68.75 |
| rs2793101 | Imputed | T | DOMINANT | 0.001377 | 0.07663 | 0.6498 | 0.6704 | 0.0666 | 63.09 |
| rs2795871 | Imputed | A | ADDITIVE | 7.48E-05 | 7.48E-05 | 0.5195 | 0.5195 | 0.5044 | 0 |
| rs2795886 | Imputed | A | ADDITIVE | 4.74E-05 | 4.74E-05 | 0.4603 | 0.4603 | 0.6122 | 0 |
| rs2795886 | Imputed | A | DOMINANT | 7.68E-05 | 7.68E-05 | 0.4623 | 0.4623 | 0.6008 | 0 |
| rs2859994 | Imputed | C | GENOTYPIC | 0.001111 | 0.04898 | 1.7472 | 1.7054 | 0.0857 | 59.3 |
| rs2870464 | Imputed | G | DOMINANT | 9.42E-05 | 9.42E-05 | 1.6183 | 1.6183 | 0.5381 | 0 |
| rs2875528 | Imputed | T | DOMINANT | 0.00249 | 0.1329 | 1.4996 | 1.5256 | 0.0141 | 76.54 |
| rs2876227 | Imputed | C | ADDITIVE | 2.20E-05 | 2.20E-05 | 1.3926 | 1.3926 | 0.9997 | 0 |
| rs2876227 | Imputed | C | GENOTYPIC | 1.68E-05 | 1.68E-05 | 2.0556 | 2.0556 | 0.8801 | 0 |
| rs2882097 | Imputed | A | DOMINANT | 5.09E-05 | 5.09E-05 | 1.5361 | 1.5361 | 0.4725 | 0 |
| rs2921983 | Imputed | C | ADDITIVE | 0.0001118 | 0.003732 | 0.7041 | 0.7047 | 0.1767 | 42.31 |
| rs2987537 | Imputed | C | DOMINANT | 0.03897 | 0.4969 | 0.7689 | 0.776 | 0.0002 | 88.03 |
| rs2996416 | Imputed | C | ADDITIVE | 0.0637 | 0.5796 | 0.7893 | 0.8032 | 0.0001 | 89.2 |
| rs2996416 | Imputed | C | DOMINANT | 0.06194 | 0.5554 | 0.775 | 0.7758 | 0.0001 | 89.6 |
| rs3015527 | Imputed | C | ADDITIVE | 0.07495 | 0.6564 | 0.7934 | 0.8312 | 0.0001 | 89.8 |
| rs3015527 | Imputed | C | DOMINANT | 0.07947 | 0.6402 | 0.7832 | 0.8084 | 0 | 90.3 |
| rs3015530 | Imputed | C | ADDITIVE | 0.06224 | 0.577 | 0.7882 | 0.8017 | 0.0001 | 89.23 |
| rs3015530 | Imputed | C | DOMINANT | 0.06057 | 0.5529 | 0.7739 | 0.7744 | 0.0001 | 89.62 |
| rs3015531 | Imputed | T | ADDITIVE | 0.06224 | 0.577 | 0.7882 | 0.8017 | 0.0001 | 89.23 |
| rs3015531 | Imputed | T | DOMINANT | 0.06057 | 0.5529 | 0.7739 | 0.7744 | 0.0001 | 89.62 |
| rs3015535 | Imputed | C | ADDITIVE | 0.06224 | 0.577 | 0.7882 | 0.8017 | 0.0001 | 89.23 |
| rs3015535 | Imputed | C | DOMINANT | 0.06057 | 0.5529 | 0.7739 | 0.7744 | 0.0001 | 89.62 |
| rs3019407 | Imputed | A | GENOTYPIC | 0.002403 | 0.1245 | 0.5457 | 0.5319 | 0.0182 | 75.03 |
| rs3019407 | Imputed | A | RECESSIVE | 0.001969 | 0.0794 | 0.5543 | 0.5343 | 0.0367 | 69.74 |
| rs36071725 | Genotyped | C | GENOTYPIC | 0.0009841 | 0.1525 | 1.8209 | 1.6916 | 0.0188 | 74.82 |
| rs373983 | Imputed | G | DOMINANT | 1.77E-06 | 4.87E-05 | 1.7251 | 1.7129 | 0.2675 | 24.16 |
| rs3756154 | Imputed | C | DOMINANT | 5.58E-05 | 5.58E-05 | 0.638 | 0.638 | 0.5323 | 0 |
| rs3793044 | Imputed | C | ADDITIVE | 0.0002176 | 0.02467 | 1.7666 | 1.7835 | 0.0668 | 63.04 |
| rs3793044 | Imputed | C | DOMINANT | 6.05E-05 | 0.01168 | 1.9281 | 1.9369 | 0.0827 | 59.88 |
| rs3793053 | Imputed | C | ADDITIVE | 0.0006473 | 0.05829 | 1.6129 | 1.6372 | 0.0373 | 69.61 |
| rs3793053 | Imputed | C | DOMINANT | 0.0001802 | 0.05295 | 1.7738 | 1.7934 | 0.0253 | 72.81 |
| rs3796246 | Imputed | G | ADDITIVE | 4.93E-05 | 0.03123 | 0.5626 | 0.5598 | 0.033 | 70.67 |
| rs3796246 | Imputed | G | DOMINANT | 7.61E-05 | 0.03997 | 0.5604 | 0.5582 | 0.0279 | 72.06 |
| rs3805996 | Imputed | G | ADDITIVE | 0.0004631 | 0.03555 | 1.7203 | 1.7316 | 0.0645 | 63.52 |
| rs3805996 | Imputed | G | DOMINANT | 0.0001039 | 0.01905 | 1.8935 | 1.8966 | 0.069 | 62.59 |
| rs3806003 | Imputed | A | ADDITIVE | 0.0002176 | 0.02467 | 1.7666 | 1.7835 | 0.0668 | 63.04 |
| rs3806003 | Imputed | A | DOMINANT | 6.05E-05 | 0.01168 | 1.9281 | 1.9369 | 0.0827 | 59.88 |
| rs3806004 | Imputed | T | ADDITIVE | 0.0004046 | 0.06127 | 1.629 | 1.6716 | 0.0232 | 73.43 |
| rs3806004 | Imputed | T | DOMINANT | 8.69E-05 | 0.05774 | 1.806 | 1.8451 | 0.013 | 76.96 |
| rs3806010 | Imputed | T | ADDITIVE | 0.0005021 | 0.06161 | 1.6166 | 1.6531 | 0.0272 | 72.27 |
| rs3806010 | Imputed | T | DOMINANT | 0.0001126 | 0.05784 | 1.7901 | 1.8228 | 0.0156 | 75.95 |
| rs3806014 | Imputed | T | ADDITIVE | 0.0003765 | 0.04916 | 1.6371 | 1.6672 | 0.0355 | 70.04 |
| rs3806014 | Imputed | T | DOMINANT | 8.67E-05 | 0.04874 | 1.8125 | 1.8369 | 0.0201 | 74.42 |
| rs3806015 | Imputed | A | ADDITIVE | 0.0004101 | 0.05336 | 1.6326 | 1.6624 | 0.0328 | 70.72 |
| rs3806015 | Imputed | A | DOMINANT | 9.18E-05 | 0.05129 | 1.8094 | 1.8329 | 0.019 | 74.77 |
| rs3806018 | Imputed | A | ADDITIVE | 0.0005021 | 0.06161 | 1.6166 | 1.6531 | 0.0272 | 72.27 |
| rs3806018 | Imputed | A | DOMINANT | 0.0001126 | 0.05784 | 1.7901 | 1.8228 | 0.0156 | 75.95 |
| rs3806019 | Imputed | A | ADDITIVE | 0.0003369 | 0.06994 | 1.6486 | 1.6857 | 0.017 | 75.46 |
| rs3806019 | Imputed | A | DOMINANT | 7.78E-05 | 0.06342 | 1.8244 | 1.854 | 0.0108 | 77.94 |
| rs3806024 | Imputed | T | ADDITIVE | 0.0005633 | 0.04683 | 1.6102 | 1.6476 | 0.0429 | 68.25 |
| rs3806024 | Imputed | T | DOMINANT | 0.0001927 | 0.05215 | 1.7603 | 1.7924 | 0.0243 | 73.09 |
| rs3847825 | Imputed | G | ADDITIVE | 2.82E-05 | 2.82E-05 | 0.7256 | 0.7256 | 0.8316 | 0 |
| rs3847825 | Imputed | G | GENOTYPIC | 1.92E-05 | 1.92E-05 | 0.492 | 0.492 | 0.6711 | 0 |
| rs3852001 | Genotyped | C | GENOTYPIC | 0.0001464 | 0.003339 | 2.8436 | 2.7528 | 0.2138 | 35.18 |
| rs3852001 | Genotyped | C | RECESSIVE | 0.0002312 | 0.004125 | 2.7294 | 2.6501 | 0.2177 | 34.41 |
| rs3852002 | Imputed | G | GENOTYPIC | 0.0001829 | 0.002345 | 2.8057 | 2.7354 | 0.2427 | 29.38 |
| rs3852002 | Imputed | G | RECESSIVE | 0.0003087 | 0.003378 | 2.6791 | 2.6162 | 0.2416 | 29.6 |
| rs3852003 | Imputed | A | GENOTYPIC | 0.0001804 | 0.002239 | 2.8085 | 2.7392 | 0.2448 | 28.95 |
| rs3852003 | Imputed | A | RECESSIVE | 0.0003059 | 0.003283 | 2.6808 | 2.6185 | 0.243 | 29.31 |
| rs3942254 | Imputed | T | DOMINANT | 1.57E-05 | 1.57E-05 | 0.6155 | 0.6155 | 0.9263 | 0 |
| rs3945085 | Imputed | A | DOMINANT | 4.70E-05 | 4.70E-05 | 1.5394 | 1.5394 | 0.4131 | 0 |

TABLE 13-continued

| SNP rs # | SOURCE | ALLELE (A1) | MODEL | P | P(R) | OR | OR(R) | Q | I |
|---|---|---|---|---|---|---|---|---|---|
| rs399485 | Imputed | A | DOMINANT | 6.74E-05 | 6.74E-05 | 1.5257 | 1.5257 | 0.824 | 0 |
| rs4029119 | Imputed | G | ADDITIVE | 0.009526 | 0.1165 | 0.5497 | 0.3516 | 0.0037 | 82.15 |
| rs4029119 | Imputed | G | DOMINANT | 0.01808 | 0.1591 | 0.5432 | 0.3678 | 0.0036 | 82.19 |
| rs412791 | Imputed | C | GENOTYPIC | 0.001957 | 0.1114 | 0.5748 | 0.6018 | 0.0485 | 66.96 |
| rs4146972 | Genotyped | T | DOMINANT | 5.77E-05 | 5.77E-05 | 1.5876 | 1.5876 | 0.6206 | 0 |
| rs4259369 | Imputed | C | RECESSIVE | 8.16E-05 | 8.16E-05 | 0.5849 | 0.5849 | 0.3771 | 0 |
| rs4273613 | Imputed | T | ADDITIVE | 0.008222 | 0.1202 | 0.5498 | 0.3996 | 0.0061 | 80.4 |
| rs4273613 | Imputed | T | DOMINANT | 0.01557 | 0.1677 | 0.5436 | 0.4204 | 0.006 | 80.44 |
| rs4294022 | Imputed | C | DOMINANT | 0.001643 | 0.075 | 0.7108 | 0.7149 | 0.0535 | 65.84 |
| rs4310554 | Genotyped | C | DOMINANT | 8.90E-05 | 8.90E-05 | 1.6571 | 1.6571 | 0.9259 | 0 |
| rs4315598 | Imputed | T | ADDITIVE | 3.44E-05 | 3.44E-05 | 1.3737 | 1.3737 | 0.9473 | 0 |
| rs4315598 | Imputed | T | GENOTYPIC | 2.26E-05 | 2.26E-05 | 2.0022 | 2.0022 | 0.9124 | 0 |
| rs4370878 | Imputed | G | DOMINANT | 7.67E-05 | 7.67E-05 | 1.5204 | 1.5204 | 0.455 | 0 |
| rs4436200 | Imputed | C | ADDITIVE | 9.10E-05 | 9.10E-05 | 0.6326 | 0.6326 | 0.5686 | 0 |
| rs4444612 | Imputed | G | ADDITIVE | 3.11E-05 | 3.11E-05 | 1.376 | 1.376 | 0.9378 | 0 |
| rs4444612 | Imputed | G | GENOTYPIC | 2.11E-05 | 2.11E-05 | 2.0071 | 2.0071 | 0.9192 | 0 |
| rs4450660 | Imputed | C | DOMINANT | 4.65E-05 | 4.65E-05 | 1.546 | 1.546 | 0.4995 | 0 |
| rs4463950 | Imputed | C | DOMINANT | 0.0001125 | 0.0001125 | 0.6464 | 0.6464 | 0.456 | 0 |
| rs4509702 | Imputed | C | DOMINANT | 7.67E-05 | 7.67E-05 | 1.5204 | 1.5204 | 0.455 | 0 |
| rs4533379 | Imputed | G | ADDITIVE | 0.0001806 | 0.006299 | 1.3772 | 1.3597 | 0.1875 | 40.27 |
| rs4569984 | Imputed | A | DOMINANT | 0.001158 | 0.06124 | 0.7017 | 0.7047 | 0.0591 | 64.65 |
| rs4570530 | Imputed | C | DOMINANT | 6.91E-05 | 6.91E-05 | 1.5246 | 1.5246 | 0.4388 | 0 |
| rs4571583 | Imputed | T | DOMINANT | 0.001089 | 0.04319 | 0.7015 | 0.7036 | 0.0837 | 59.69 |
| rs4586678 | Imputed | A | DOMINANT | 7.84E-05 | 7.84E-05 | 1.5241 | 1.5241 | 0.4333 | 0 |
| rs4615971 | Imputed | C | DOMINANT | 5.32E-05 | 5.32E-05 | 1.5364 | 1.5364 | 0.4014 | 0 |
| rs4629229 | Imputed | G | DOMINANT | 0.00258 | 0.1967 | 0.7027 | 0.7323 | 0.0172 | 75.39 |
| rs4632512 | Imputed | T | GENOTYPIC | 0.0002417 | 0.001846 | 2.7571 | 2.7036 | 0.2673 | 24.2 |
| rs4641552 | Imputed | A | ADDITIVE | 6.42E-05 | 6.42E-05 | 0.5503 | 0.5503 | 0.8687 | 0 |
| rs4682527 | Imputed | C | DOMINANT | 6.46E-05 | 6.46E-05 | 1.7014 | 1.7014 | 0.8635 | 0 |
| rs4688632 | Imputed | G | RECESSIVE | 9.44E-05 | 9.44E-05 | 0.6102 | 0.6102 | 0.6914 | 0 |
| rs4702720 | Imputed | A | ADDITIVE | 6.79E-05 | 6.79E-05 | 0.6668 | 0.6668 | 0.5886 | 0 |
| rs4702720 | Imputed | A | DOMINANT | 5.81E-05 | 5.81E-05 | 0.6111 | 0.6111 | 0.6679 | 0 |
| rs4714484 | Imputed | A | ADDITIVE | 0.0001156 | 0.0001156 | 0.6714 | 0.6714 | 0.4129 | 0 |
| rs4714484 | Imputed | A | DOMINANT | 0.0001018 | 0.0005019 | 0.6342 | 0.6347 | 0.2947 | 18.15 |
| rs4725142 | Genotyped | G | RECESSIVE | 0.006009 | 0.1578 | 0.6241 | 0.5998 | 0.0142 | 76.48 |
| rs4725144 | Imputed | G | RECESSIVE | 0.003615 | 0.1263 | 0.601 | 0.5821 | 0.0196 | 74.58 |
| rs4760785 | Imputed | A | ADDITIVE | 2.89E-05 | 2.89E-05 | 0.7236 | 0.7236 | 0.9224 | 0 |
| rs4760785 | Imputed | A | DOMINANT | 3.37E-05 | 3.37E-05 | 0.6199 | 0.6199 | 0.7756 | 0 |
| rs4760894 | Imputed | T | ADDITIVE | 2.89E-05 | 2.89E-05 | 0.7236 | 0.7236 | 0.9224 | 0 |
| rs4760894 | Imputed | T | DOMINANT | 3.37E-05 | 3.37E-05 | 0.6199 | 0.6199 | 0.7756 | 0 |
| rs4760895 | Imputed | A | ADDITIVE | 2.89E-05 | 2.89E-05 | 0.7236 | 0.7236 | 0.9224 | 0 |
| rs4760895 | Imputed | A | DOMINANT | 3.37E-05 | 3.37E-05 | 0.6199 | 0.6199 | 0.7756 | 0 |
| rs4767184 | Imputed | C | ADDITIVE | 5.36E-05 | 5.36E-05 | 0.7326 | 0.7326 | 0.8638 | 0 |
| rs4767184 | Imputed | C | GENOTYPIC | 4.89E-05 | 4.89E-05 | 0.5118 | 0.5118 | 0.7734 | 0 |
| rs4773487 | Imputed | T | ADDITIVE | 0.06464 | 0.5842 | 0.7937 | 0.8107 | 0.0001 | 88.81 |
| rs4780547 | Imputed | G | GENOTYPIC | 5.45E-05 | 5.45E-05 | 0.3432 | 0.3432 | 0.6588 | 0 |
| rs4780547 | Imputed | G | RECESSIVE | 5.24E-05 | 5.24E-05 | 0.3485 | 0.3485 | 0.7035 | 0 |
| rs483159 | Imputed | T | DOMINANT | 1.80E-05 | 9.87E-05 | 1.6374 | 1.6337 | 0.3052 | 15.73 |
| rs4836502 | Imputed | T | DOMINANT | 4.20E-07 | 4.20E-07 | 0.5804 | 0.5804 | 0.9556 | 0 |
| rs4836507 | Imputed | C | DOMINANT | 3.81E-07 | 3.81E-07 | 0.5776 | 0.5776 | 0.9618 | 0 |
| rs4851531 | Imputed | T | DOMINANT | 6.05E-05 | 6.05E-05 | 0.6433 | 0.6433 | 0.6076 | 0 |
| rs4879931 | Imputed | G | ADDITIVE | 4.07E-05 | 4.07E-05 | 0.7128 | 0.7128 | 0.8034 | 0 |
| rs489441 | Imputed | G | ADDITIVE | 5.61E-05 | 5.61E-05 | 1.4311 | 1.4311 | 0.5197 | 0 |
| rs489441 | Imputed | G | DOMINANT | 2.23E-05 | 2.23E-05 | 1.5959 | 1.5959 | 0.6258 | 0 |
| rs4976276 | Imputed | T | ADDITIVE | 0.001258 | 0.05097 | 1.303 | 1.2929 | 0.0811 | 60.2 |
| rs4977681 | Imputed | C | RECESSIVE | 0.00128 | 0.05237 | 1.78 | 1.7408 | 0.0817 | 60.08 |
| rs4986197 | Imputed | G | ADDITIVE | 0.0001721 | 0.0051 | 1.3789 | 1.3622 | 0.1995 | 37.96 |
| rs4986220 | Imputed | T | ADDITIVE | 0.0002571 | 0.00494 | 1.3704 | 1.3563 | 0.2157 | 34.81 |
| rs525462 | Imputed | A | GENOTYPIC | 8.63E-05 | 8.63E-05 | 0.5509 | 0.5509 | 0.4841 | 0 |
| rs552006 | Imputed | G | GENOTYPIC | 0.001362 | 0.0951 | 1.9014 | 1.8396 | 0.056 | 65.31 |
| rs5756669 | Imputed | C | DOMINANT | 0.0005154 | 0.01565 | 1.5032 | 1.4817 | 0.1536 | 46.63 |
| rs581905 | Imputed | T | DOMINANT | 9.62E-05 | 9.62E-05 | 1.7493 | 1.7493 | 0.4492 | 0 |
| rs6033138 | Imputed | C | ADDITIVE | 3.11E-05 | 3.11E-05 | 1.376 | 1.376 | 0.9378 | 0 |
| rs6033138 | Imputed | C | GENOTYPIC | 2.11E-05 | 2.11E-05 | 2.0071 | 2.0071 | 0.9192 | 0 |
| rs6040619 | Imputed | C | ADDITIVE | 1.85E-05 | 1.85E-05 | 1.3887 | 1.3887 | 0.9157 | 0 |
| rs6040619 | Imputed | C | GENOTYPIC | 1.34E-05 | 1.34E-05 | 2.0393 | 2.0393 | 0.8907 | 0 |
| rs6040625 | Imputed | T | ADDITIVE | 1.40E-05 | 1.40E-05 | 1.3939 | 1.3939 | 0.9254 | 0 |
| rs6040625 | Imputed | T | GENOTYPIC | 1.13E-05 | 1.13E-05 | 2.049 | 2.049 | 0.9295 | 0 |
| rs6040630 | Imputed | A | ADDITIVE | 1.64E-05 | 1.64E-05 | 1.3913 | 1.3913 | 0.9442 | 0 |
| rs6040630 | Imputed | A | GENOTYPIC | 1.40E-05 | 1.40E-05 | 2.0387 | 2.0387 | 0.936 | 0 |
| rs6040633 | Imputed | A | ADDITIVE | 2.09E-05 | 2.09E-05 | 1.3848 | 1.3848 | 0.9611 | 0 |
| rs6040633 | Imputed | A | GENOTYPIC | 1.80E-05 | 1.80E-05 | 2.0179 | 2.0179 | 0.921 | 0 |
| rs6040634 | Imputed | T | ADDITIVE | 4.42E-05 | 4.42E-05 | 1.3644 | 1.3644 | 0.8661 | 0 |
| rs6040634 | Imputed | T | GENOTYPIC | 4.35E-05 | 4.35E-05 | 1.9421 | 1.9421 | 0.8577 | 0 |
| rs6040636 | Imputed | T | ADDITIVE | 5.80E-05 | 5.80E-05 | 1.3581 | 1.3581 | 0.8982 | 0 |
| rs6040636 | Imputed | T | GENOTYPIC | 5.08E-05 | 5.08E-05 | 1.9311 | 1.9311 | 0.8975 | 0 |
| rs6040638 | Imputed | C | ADDITIVE | 3.11E-05 | 3.11E-05 | 1.376 | 1.376 | 0.9378 | 0 |

TABLE 13-continued

| SNP rs # | SOURCE | ALLELE (A1) | MODEL | P | P(R) | OR | OR(R) | Q | I |
|---|---|---|---|---|---|---|---|---|---|
| rs6040638 | Imputed | C | GENOTYPIC | 2.11E-05 | 2.11E-05 | 2.0071 | 2.0071 | 0.9192 | 0 |
| rs6040644 | Imputed | A | ADDITIVE | 3.11E-05 | 3.11E-05 | 1.376 | 1.376 | 0.9378 | 0 |
| rs6040644 | Imputed | A | GENOTYPIC | 2.11E-05 | 2.11E-05 | 2.0071 | 2.0071 | 0.9192 | 0 |
| rs6040667 | Imputed | T | ADDITIVE | 9.98E-06 | 9.98E-06 | 1.4087 | 1.4087 | 0.9927 | 0 |
| rs6040667 | Imputed | T | GENOTYPIC | 9.55E-06 | 9.55E-06 | 2.0887 | 2.0887 | 0.8885 | 0 |
| rs6040668 | Imputed | C | ADDITIVE | 1.34E-05 | 1.34E-05 | 1.4018 | 1.4018 | 0.9954 | 0 |
| rs6040668 | Imputed | C | GENOTYPIC | 1.18E-05 | 1.18E-05 | 2.0792 | 2.0792 | 0.9007 | 0 |
| rs6053005 | Imputed | C | DOMINANT | 3.48E-05 | 3.48E-05 | 0.4986 | 0.4986 | 0.3762 | 0 |
| rs6054405 | Imputed | A | RECESSIVE | 0.0009988 | 0.07764 | 1.6353 | 1.5918 | 0.0508 | 66.45 |
| rs6054427 | Genotyped | G | GENOTYPIC | 0.002955 | 0.1457 | 1.6159 | 1.564 | 0.0304 | 71.38 |
| rs6075186 | Imputed | G | DOMINANT | 0.00258 | 0.1967 | 0.7027 | 0.7323 | 0.0172 | 75.39 |
| rs608278 | Imputed | A | ADDITIVE | 0.004256 | 0.2162 | 0.7899 | 0.8041 | 0.0123 | 77.26 |
| rs6111540 | Imputed | A | ADDITIVE | 0.0006805 | 0.04588 | 0.7626 | 0.7772 | 0.0894 | 58.58 |
| rs6131206 | Imputed | C | ADDITIVE | 6.54E-05 | 6.54E-05 | 1.3826 | 1.3826 | 0.6671 | 0 |
| rs6131208 | Imputed | T | ADDITIVE | 1.51E-05 | 1.51E-05 | 1.3987 | 1.3987 | 0.9933 | 0 |
| rs6131208 | Imputed | T | GENOTYPIC | 1.23E-05 | 1.23E-05 | 2.0749 | 2.0749 | 0.9062 | 0 |
| rs6131919 | Imputed | G | DOMINANT | 0.00258 | 0.1967 | 0.7027 | 0.7323 | 0.0172 | 75.39 |
| rs6134243 | Imputed | C | ADDITIVE | 3.11E-05 | 3.11E-05 | 1.376 | 1.376 | 0.9378 | 0 |
| rs6134243 | Imputed | C | GENOTYPIC | 2.11E-05 | 2.11E-05 | 2.0071 | 2.0071 | 0.9192 | 0 |
| rs6136020 | Imputed | A | DOMINANT | 0.001123 | 0.128 | 0.6825 | 0.7095 | 0.029 | 71.76 |
| rs613799 | Imputed | C | DOMINANT | 6.64E-05 | 6.64E-05 | 1.5582 | 1.5582 | 0.563 | 0 |
| rs644041 | Imputed | G | ADDITIVE | 5.13E-05 | 5.13E-05 | 1.4383 | 1.4383 | 0.434 | 0 |
| rs644041 | Imputed | G | DOMINANT | 3.43E-05 | 3.43E-05 | 1.5867 | 1.5867 | 0.604 | 0 |
| rs6464377 | Imputed | C | DOMINANT | 0.0006889 | 0.03533 | 1.6713 | 1.6228 | 0.1067 | 55.32 |
| rs6474230 | Imputed | T | DOMINANT | 5.89E-05 | 5.89E-05 | 1.5358 | 1.5358 | 0.5248 | 0 |
| rs6476565 | Imputed | A | DOMINANT | 0.003196 | 0.152 | 0.6555 | 0.6646 | 0.0232 | 73.43 |
| rs6511286 | Imputed | T | ADDITIVE | 0.0002903 | 0.007727 | 1.3303 | 1.3382 | 0.1549 | 46.38 |
| rs6541829 | Genotyped | C | RECESSIVE | 9.75E-05 | 9.75E-05 | 2.1906 | 2.1906 | 0.675 | 0 |
| rs6544721 | Imputed | G | DOMINANT | 6.03E-05 | 6.03E-05 | 1.5337 | 1.5337 | 0.3986 | 0 |
| rs6544728 | Imputed | T | DOMINANT | 2.14E-05 | 2.14E-05 | 1.5769 | 1.5769 | 0.5608 | 0 |
| rs6565910 | Imputed | G | DOMINANT | 0.001296 | 0.07989 | 0.7061 | 0.72 | 0.0544 | 65.66 |
| rs6581985 | Imputed | G | GENOTYPIC | 2.27E-05 | 2.27E-05 | 2.3281 | 2.3281 | 0.8 | 0 |
| rs6581985 | Imputed | G | RECESSIVE | 1.65E-05 | 1.65E-05 | 2.2816 | 2.2816 | 0.9608 | 0 |
| rs6685186 | Imputed | T | ADDITIVE | 0.0003893 | 0.03193 | 1.3177 | 1.2933 | 0.1024 | 56.12 |
| rs6685186 | Imputed | T | GENOTYPIC | 0.0003148 | 0.008032 | 1.8077 | 1.753 | 0.2038 | 37.13 |
| rs670593 | Imputed | A | RECESSIVE | 9.20E-05 | 9.20E-05 | 0.5443 | 0.5443 | 0.5165 | 0 |
| rs6722640 | Imputed | T | DOMINANT | 3.75E-05 | 3.75E-05 | 0.6354 | 0.6354 | 0.7462 | 0 |
| rs6746170 | Imputed | A | DOMINANT | 1.59E-05 | 1.59E-05 | 1.5871 | 1.5871 | 0.5677 | 0 |
| rs6757316 | Imputed | A | GENOTYPIC | 7.94E-05 | 7.94E-05 | 1.8639 | 1.8639 | 0.8329 | 0 |
| rs6805139 | Imputed | G | DOMINANT | 6.87E-05 | 6.87E-05 | 1.6408 | 1.6408 | 0.6877 | 0 |
| rs6808571 | Imputed | G | ADDITIVE | 0.0001557 | 0.005296 | 1.488 | 1.4637 | 0.1931 | 39.2 |
| rs6816479 | Imputed | A | RECESSIVE | 0.003461 | 0.1734 | 1.5638 | 1.5108 | 0.0221 | 73.76 |
| rs6865976 | Imputed | C | DOMINANT | 0.000638 | 0.09658 | 0.6509 | 0.6693 | 0.03 | 71.48 |
| rs687047 | Imputed | C | ADDITIVE | 8.99E-05 | 8.99E-05 | 0.6274 | 0.6274 | 0.7784 | 0 |
| rs6871041 | Imputed | G | DOMINANT | 1.95E-06 | 1.95E-06 | 0.5936 | 0.5936 | 0.8021 | 0 |
| rs688358 | Imputed | A | ADDITIVE | 9.13E-05 | 9.13E-05 | 0.6275 | 0.6275 | 0.8668 | 0 |
| rs6908481 | Imputed | C | RECESSIVE | 2.63E-05 | 2.63E-05 | 1.8066 | 1.8066 | 0.4929 | 0 |
| rs6917224 | Imputed | A | ADDITIVE | 0.001611 | 0.08952 | 1.2619 | 1.2426 | 0.0537 | 65.81 |
| rs6917224 | Imputed | A | GENOTYPIC | 0.0004783 | 0.01846 | 1.6983 | 1.6636 | 0.1376 | 49.58 |
| rs6920677 | Imputed | G | DOMINANT | 0.0006978 | 0.02695 | 0.6902 | 0.689 | 0.1022 | 56.16 |
| rs6994498 | Imputed | G | DOMINANT | 6.45E-05 | 6.45E-05 | 1.5326 | 1.5326 | 0.525 | 0 |
| rs6998772 | Imputed | T | DOMINANT | 0.0001667 | 0.007582 | 2.0855 | 2.0402 | 0.1794 | 41.79 |
| rs7022281 | Imputed | C | ADDITIVE | 3.37E-05 | 3.37E-05 | 0.7208 | 0.7208 | 0.9446 | 0 |
| rs7022281 | Imputed | C | GENOTYPIC | 1.15E-05 | 1.15E-05 | 0.4698 | 0.4698 | 0.7053 | 0 |
| rs7022281 | Imputed | C | RECESSIVE | 5.13E-05 | 5.13E-05 | 0.5256 | 0.5256 | 0.4654 | 0 |
| rs7043983 | Imputed | T | DOMINANT | 0.002465 | 0.1237 | 0.6468 | 0.6573 | 0.0334 | 70.58 |
| rs7077799 | Imputed | A | DOMINANT | 6.50E-05 | 6.50E-05 | 1.5274 | 1.5274 | 0.444 | 0 |
| rs7088947 | Imputed | A | ADDITIVE | 6.35E-05 | 6.35E-05 | 0.5164 | 0.5164 | 0.4696 | 0 |
| rs7089661 | Imputed | C | DOMINANT | 5.72E-05 | 5.72E-05 | 1.532 | 1.532 | 0.4194 | 0 |
| rs7102072 | Imputed | A | DOMINANT | 0.0002045 | 0.02025 | 0.6732 | 0.6851 | 0.1048 | 55.66 |
| rs710832 | Genotyped | A | RECESSIVE | 9.58E-05 | 9.58E-05 | 0.3757 | 0.3757 | 0.7653 | 0 |
| rs712531 | Imputed | A | DOMINANT | 3.11E-05 | 3.11E-05 | 1.7258 | 1.7258 | 0.9033 | 0 |
| rs7129817 | Imputed | T | ADDITIVE | 0.0004049 | 0.005979 | 0.7557 | 0.7602 | 0.2144 | 35.05 |
| rs7134262 | Imputed | T | GENOTYPIC | 3.73E-05 | 3.73E-05 | 2.0446 | 2.0446 | 0.769 | 0 |
| rs7134262 | Imputed | T | RECESSIVE | 1.57E-06 | 1.57E-06 | 2.1811 | 2.1811 | 0.5132 | 0 |
| rs7138300 | Imputed | C | ADDITIVE | 2.89E-05 | 2.89E-05 | 0.7236 | 0.7236 | 0.9224 | 0 |
| rs7138300 | Imputed | C | DOMINANT | 3.37E-05 | 3.37E-05 | 0.6199 | 0.6199 | 0.7756 | 0 |
| rs722927 | Imputed | G | ADDITIVE | 0.0002059 | 0.003095 | 0.5581 | 0.5621 | 0.2265 | 32.66 |
| rs722927 | Imputed | G | DOMINANT | 0.0002882 | 0.006064 | 0.554 | 0.5592 | 0.1936 | 39.11 |
| rs726424 | Genotyped | G | ADDITIVE | 6.99E-05 | 6.99E-05 | 0.7384 | 0.7384 | 0.8568 | 0 |
| rs726424 | Genotyped | G | GENOTYPIC | 4.04E-05 | 4.04E-05 | 0.5084 | 0.5084 | 0.769 | 0 |
| rs7295817 | Imputed | C | ADDITIVE | 3.56E-06 | 3.56E-06 | 0.701 | 0.701 | 0.8251 | 0 |
| rs7295817 | Imputed | C | GENOTYPIC | 2.94E-06 | 2.94E-06 | 0.4697 | 0.4697 | 0.6858 | 0 |
| rs7295817 | Imputed | C | RECESSIVE | 3.56E-05 | 3.56E-05 | 0.5434 | 0.5434 | 0.4419 | 0 |
| rs7297372 | Imputed | A | ADDITIVE | 2.15E-05 | 2.15E-05 | 0.7143 | 0.7143 | 0.9056 | 0 |
| rs7297372 | Imputed | A | GENOTYPIC | 2.33E-05 | 2.33E-05 | 0.5078 | 0.5078 | 0.9111 | 0 |
| rs7298255 | Imputed | A | ADDITIVE | 5.48E-05 | 5.48E-05 | 0.7363 | 0.7363 | 0.9823 | 0 |

TABLE 13-continued

| SNP rs # | SOURCE | ALLELE (A1) | MODEL | P | P(R) | OR | OR(R) | Q | I |
|---|---|---|---|---|---|---|---|---|---|
| rs7298255 | Imputed | A | DOMINANT | 3.71E−05 | 3.71E−05 | 0.6235 | 0.6235 | 0.616 | 0 |
| rs7305832 | Imputed | C | GENOTYPIC | 3.46E−05 | 3.46E−05 | 2.0496 | 2.0496 | 0.7658 | 0 |
| rs7305832 | Imputed | C | RECESSIVE | 1.42E−06 | 1.42E−06 | 2.1877 | 2.1877 | 0.5185 | 0 |
| rs737542 | Imputed | A | RECESSIVE | 6.40E−05 | 6.40E−05 | 2.2711 | 2.2711 | 0.5666 | 0 |
| rs742827 | Imputed | A | ADDITIVE | 1.36E−05 | 1.36E−05 | 1.4066 | 1.4066 | 0.9977 | 0 |
| rs742827 | Imputed | A | GENOTYPIC | 1.47E−05 | 1.47E−05 | 2.0678 | 2.0678 | 0.9063 | 0 |
| rs7446891 | Imputed | G | DOMINANT | 4.14E−07 | 4.14E−07 | 0.5792 | 0.5792 | 0.9644 | 0 |
| rs7448641 | Imputed | C | ADDITIVE | 0.008373 | 0.1243 | 0.5451 | 0.3771 | 0.0037 | 82.12 |
| rs7448641 | Imputed | C | DOMINANT | 0.0151 | 0.1693 | 0.5356 | 0.3959 | 0.0036 | 82.2 |
| rs7460605 | Imputed | G | DOMINANT | 9.83E−05 | 9.83E−05 | 1.5669 | 1.5669 | 0.9301 | 0 |
| rs7468898 | Imputed | T | ADDITIVE | 0.0003194 | 0.01248 | 1.3212 | 1.3172 | 0.1401 | 49.12 |
| rs7468898 | Imputed | T | GENOTYPIC | 0.0002964 | 0.008259 | 1.7563 | 1.7465 | 0.1684 | 43.86 |
| rs7501186 | Imputed | A | DOMINANT | 9.69E−05 | 9.69E−05 | 1.6046 | 1.6046 | 0.3847 | 0 |
| rs755117 | Imputed | A | DOMINANT | 0.01024 | 0.3598 | 1.3434 | 1.288 | 0.0039 | 81.94 |
| rs7557560 | Imputed | T | GENOTYPIC | 0.0001246 | 0.01108 | 2.8561 | 3.1286 | 0.074 | 61.59 |
| rs7557560 | Imputed | T | RECESSIVE | 6.13E−05 | 0.00416 | 2.9547 | 3.1843 | 0.1154 | 53.69 |
| rs7562462 | Imputed | T | DOMINANT | 0.01544 | 0.4455 | 1.3282 | 1.2791 | 0.0007 | 86.22 |
| rs757173 | Genotyped | G | DOMINANT | 0.0006476 | 0.08534 | 0.6914 | 0.7167 | 0.0461 | 67.51 |
| rs7607447 | Imputed | T | RECESSIVE | 9.84E−05 | 9.84E−05 | 2.0418 | 2.0418 | 0.8641 | 0 |
| rs7639053 | Imputed | A | ADDITIVE | 0.00063 | 0.02671 | 1.3617 | 1.3527 | 0.1105 | 54.61 |
| rs7648163 | Imputed | C | RECESSIVE | 0.001045 | 0.07747 | 1.7344 | 1.7565 | 0.0313 | 71.14 |
| rs7651273 | Imputed | A | GENOTYPIC | 0.0003041 | 0.01221 | 2.7407 | 2.6004 | 0.1624 | 44.99 |
| rs7653190 | Imputed | C | ADDITIVE | 0.0008578 | 0.04731 | 1.3535 | 1.3419 | 0.0766 | 61.08 |
| rs7653685 | Genotyped | C | DOMINANT | 0.003653 | 0.1786 | 1.4802 | 1.4969 | 0.0084 | 79.08 |
| rs7684899 | Imputed | C | DOMINANT | 9.54E−05 | 9.54E−05 | 0.6466 | 0.6466 | 0.5013 | 0 |
| rs7701604 | Imputed | G | ADDITIVE | 0.008373 | 0.1243 | 0.5451 | 0.3771 | 0.0037 | 82.12 |
| rs7701604 | Imputed | G | DOMINANT | 0.0151 | 0.1693 | 0.5356 | 0.3959 | 0.0036 | 82.2 |
| rs7703676 | Imputed | C | ADDITIVE | 0.008373 | 0.1243 | 0.5451 | 0.3771 | 0.0037 | 82.12 |
| rs7703676 | Imputed | C | DOMINANT | 0.0151 | 0.1693 | 0.5356 | 0.3959 | 0.0036 | 82.2 |
| rs7711358 | Imputed | A | DOMINANT | 6.11E−07 | 6.11E−07 | 0.5846 | 0.5846 | 0.9519 | 0 |
| rs7713251 | Imputed | C | RECESSIVE | 0.0004673 | 0.01381 | 1.817 | 1.8103 | 0.1436 | 48.48 |
| rs7737608 | Imputed | G | DOMINANT | 0.004374 | 0.3589 | 1.3752 | 1.2994 | 0.0019 | 83.98 |
| rs7755903 | Imputed | A | GENOTYPIC | 0.000545 | 0.01934 | 0.5737 | 0.5711 | 0.1208 | 52.69 |
| rs7762993 | Imputed | A | ADDITIVE | 0.0001907 | 0.02185 | 1.4428 | 1.3966 | 0.1265 | 51.63 |
| rs7762993 | Imputed | A | DOMINANT | 5.98E−05 | 0.0279 | 1.5641 | 1.5155 | 0.0621 | 64.02 |
| rs7767265 | Imputed | G | DOMINANT | 1.02E−05 | 0.01409 | 1.6165 | 1.5706 | 0.0624 | 63.96 |
| rs7769415 | Imputed | C | GENOTYPIC | 8.18E−05 | 8.18E−05 | 2.0029 | 2.0029 | 0.4259 | 0 |
| rs7771264 | Imputed | T | DOMINANT | 0.001814 | 0.07578 | 0.7128 | 0.7164 | 0.055 | 65.53 |
| rs7795792 | Imputed | T | RECESSIVE | 8.16E−05 | 8.16E−05 | 0.5849 | 0.5849 | 0.3771 | 0 |
| rs7806481 | Imputed | G | RECESSIVE | 0.01058 | 0.4116 | 0.7116 | 0.7366 | 0.0005 | 86.94 |
| rs7808536 | Imputed | G | DOMINANT | 8.83E−05 | 8.83E−05 | 1.5445 | 1.5445 | 0.4545 | 0 |
| rs7814819 | Imputed | G | ADDITIVE | 1.73E−05 | 1.73E−05 | 2.1934 | 2.1934 | 0.7688 | 0 |
| rs7814819 | Imputed | G | DOMINANT | 5.48E−06 | 5.48E−06 | 2.3941 | 2.3941 | 0.8199 | 0 |
| rs7815952 | Imputed | T | DOMINANT | 0.0001667 | 0.007582 | 2.0855 | 2.0402 | 0.1794 | 41.79 |
| rs7834090 | Imputed | T | DOMINANT | 0.0001667 | 0.007582 | 2.0855 | 2.0402 | 0.1794 | 41.79 |
| rs7859250 | Imputed | C | DOMINANT | 0.002865 | 0.1511 | 0.6526 | 0.6624 | 0.0221 | 73.76 |
| rs7863577 | Genotyped | A | ADDITIVE | 0.001489 | 0.09537 | 0.6564 | 0.6635 | 0.037 | 69.66 |
| rs7863577 | Genotyped | A | DOMINANT | 0.0007401 | 0.03086 | 0.6143 | 0.6263 | 0.1159 | 53.59 |
| rs7902140 | Imputed | C | ADDITIVE | 0.0004487 | 0.01039 | 0.7037 | 0.7112 | 0.1881 | 40.15 |
| rs7921834 | Imputed | C | DOMINANT | 5.72E−05 | 5.72E−05 | 1.5321 | 1.5321 | 0.4195 | 0 |
| rs7939893 | Imputed | C | ADDITIVE | 6.01E−05 | 6.01E−05 | 0.7308 | 0.7308 | 0.6443 | 0 |
| rs7939893 | Imputed | C | DOMINANT | 2.83E−06 | 2.83E−06 | 0.607 | 0.607 | 0.54 | 0 |
| rs7955901 | Imputed | C | ADDITIVE | 4.86E−05 | 4.86E−05 | 0.7344 | 0.7344 | 0.959 | 0 |
| rs7955901 | Imputed | C | DOMINANT | 2.65E−05 | 2.65E−05 | 0.617 | 0.617 | 0.71 | 0 |
| rs7956274 | Imputed | T | ADDITIVE | 5.90E−05 | 5.90E−05 | 0.7346 | 0.7346 | 0.9732 | 0 |
| rs7956274 | Imputed | T | DOMINANT | 3.36E−05 | 3.36E−05 | 0.6194 | 0.6194 | 0.7678 | 0 |
| rs7957932 | Imputed | G | ADDITIVE | 7.64E−05 | 7.64E−05 | 0.7393 | 0.7393 | 0.9682 | 0 |
| rs7957932 | Imputed | G | DOMINANT | 1.49E−05 | 1.49E−05 | 0.604 | 0.604 | 0.7593 | 0 |
| rs7984294 | Imputed | A | DOMINANT | 9.75E−05 | 9.75E−05 | 1.7346 | 1.7346 | 0.5063 | 0 |
| rs7994286 | Imputed | A | ADDITIVE | 0.07908 | 0.6072 | 0.8008 | 0.8163 | 0.0001 | 89.29 |
| rs7994286 | Imputed | A | DOMINANT | 0.08583 | 0.5854 | 0.7921 | 0.7921 | 0.0001 | 89.54 |
| rs8038229 | Genotyped | A | ADDITIVE | 6.08E−05 | 9.60E−05 | 0.7204 | 0.7188 | 0.3455 | 5.89 |
| rs8038229 | Genotyped | A | DOMINANT | 9.63E−05 | 9.63E−05 | 0.6627 | 0.6627 | 0.4576 | 0 |
| rs8043336 | Imputed | C | GENOTYPIC | 0.00137 | 0.05581 | 0.5451 | 0.5279 | 0.0522 | 66.13 |
| rs8043336 | Imputed | C | RECESSIVE | 0.001089 | 0.03846 | 0.5559 | 0.5432 | 0.0772 | 60.96 |
| rs8054431 | Imputed | T | DOMINANT | 8.98E−05 | 0.00368 | 1.557 | 1.5551 | 0.1739 | 42.83 |
| rs8066502 | Imputed | T | DOMINANT | 8.43E−05 | 8.43E−05 | 0.6277 | 0.6277 | 0.5424 | 0 |
| rs8068714 | Imputed | T | DOMINANT | 8.71E−05 | 8.71E−05 | 0.6283 | 0.6283 | 0.5356 | 0 |
| rs892575 | Imputed | T | ADDITIVE | 0.0003596 | 0.01472 | 1.3576 | 1.3374 | 0.1542 | 46.51 |
| rs892583 | Imputed | G | ADDITIVE | 0.0002367 | 0.004322 | 1.3734 | 1.3595 | 0.2211 | 33.74 |
| rs915494 | Imputed | A | ADDITIVE | 5.04E−05 | 5.04E−05 | 1.401 | 1.401 | 0.4759 | 0 |
| rs915494 | Imputed | A | DOMINANT | 1.99E−05 | 7.05E−05 | 1.5873 | 1.5804 | 0.3261 | 10.76 |
| rs917295 | Imputed | G | DOMINANT | 4.33E−07 | 4.33E−07 | 0.5808 | 0.5808 | 0.9574 | 0 |
| rs922594 | Imputed | T | DOMINANT | 5.29E−05 | 5.29E−05 | 0.6483 | 0.6483 | 0.5564 | 0 |
| rs9301653 | Imputed | T | ADDITIVE | 0.06224 | 0.577 | 0.7882 | 0.8017 | 0.0001 | 89.23 |
| rs9301653 | Imputed | T | DOMINANT | 0.06057 | 0.5529 | 0.7739 | 0.7744 | 0.0001 | 89.62 |
| rs9309988 | Imputed | G | DOMINANT | 0.003653 | 0.1786 | 1.4802 | 1.4969 | 0.0084 | 79.08 |

TABLE 13-continued

| SNP rs # | SOURCE | ALLELE (A1) | MODEL | P | P(R) | OR | OR(R) | Q | I |
|---|---|---|---|---|---|---|---|---|---|
| rs9309989 | Genotyped | C | DOMINANT | 0.005145 | 0.2346 | 1.4559 | 1.4701 | 0.0036 | 82.24 |
| rs9310221 | Imputed | A | DOMINANT | 0.0004892 | 0.152 | 1.5136 | 1.4374 | 0.0126 | 77.16 |
| rs9327555 | Imputed | T | DOMINANT | 4.20E−07 | 4.20E−07 | 0.5804 | 0.5804 | 0.9556 | 0 |
| rs937890 | Imputed | G | DOMINANT | 6.84E−05 | 6.84E−05 | 0.6201 | 0.6201 | 0.5639 | 0 |
| rs9454967 | Imputed | G | ADDITIVE | 0.000403 | 0.06626 | 1.6379 | 1.6775 | 0.0204 | 74.32 |
| rs9454967 | Imputed | G | DOMINANT | 9.90E−05 | 0.06125 | 1.8091 | 1.8433 | 0.0126 | 77.13 |
| rs9471295 | Imputed | T | DOMINANT | 5.22E−05 | 5.22E−05 | 1.6081 | 1.6081 | 0.834 | 0 |
| rs9477007 | Imputed | A | ADDITIVE | 0.0006021 | 0.03371 | 1.2928 | 1.2761 | 0.1007 | 56.44 |
| rs9477007 | Imputed | A | GENOTYPIC | 0.0002564 | 0.005808 | 1.7495 | 1.7219 | 0.1967 | 38.49 |
| rs9487279 | Imputed | T | DOMINANT | 0.002105 | 0.09969 | 0.7072 | 0.7196 | 0.0492 | 66.8 |
| rs949016 | Imputed | C | ADDITIVE | 0.0002405 | 0.007834 | 1.372 | 1.3542 | 0.1841 | 40.91 |
| rs9555973 | Imputed | G | ADDITIVE | 0.07024 | 0.5911 | 0.7954 | 0.8108 | 0.0001 | 89 |
| rs9555973 | Imputed | G | DOMINANT | 0.07631 | 0.5694 | 0.7863 | 0.7867 | 0.0001 | 89.22 |
| rs9557510 | Imputed | G | ADDITIVE | 5.36E−05 | 5.36E−05 | 1.5231 | 1.5231 | 0.7181 | 0 |
| rs9557510 | Imputed | G | DOMINANT | 4.27E−05 | 4.27E−05 | 1.6282 | 1.6282 | 0.5332 | 0 |
| rs9560584 | Imputed | T | DOMINANT | 0.0887 | 0.5829 | 0.792 | 0.7896 | 0.0001 | 89.53 |
| rs9588770 | Imputed | T | DOMINANT | 0.07854 | 0.5309 | 0.7885 | 0.772 | 0.0001 | 88.8 |
| rs9588848 | Imputed | C | ADDITIVE | 0.06224 | 0.577 | 0.7882 | 0.8017 | 0.0001 | 89.23 |
| rs9588848 | Imputed | C | DOMINANT | 0.06057 | 0.5529 | 0.7739 | 0.7744 | 0.0001 | 89.62 |
| rs966583 | Imputed | A | ADDITIVE | 9.26E−05 | 9.26E−05 | 0.7367 | 0.7367 | 0.9674 | 0 |
| rs966583 | Imputed | A | DOMINANT | 1.20E−05 | 1.20E−05 | 0.6161 | 0.6161 | 0.8284 | 0 |
| rs974130 | Genotyped | A | RECESSIVE | 0.002277 | 0.101 | 1.5851 | 1.5579 | 0.0437 | 68.05 |
| rs977160 | Imputed | T | ADDITIVE | 0.0002651 | 0.05569 | 1.3742 | 1.3339 | 0.0564 | 65.23 |
| rs9812206 | Imputed | G | ADDITIVE | 5.56E−05 | 0.05202 | 0.5663 | 0.5775 | 0.0221 | 73.76 |
| rs9812206 | Imputed | G | DOMINANT | 8.50E−05 | 0.05567 | 0.5652 | 0.5728 | 0.021 | 74.13 |
| rs9813552 | Imputed | G | ADDITIVE | 9.05E−05 | 0.0567 | 0.5743 | 0.5799 | 0.0208 | 74.16 |
| rs9813552 | Imputed | G | DOMINANT | 0.0001441 | 0.07188 | 0.5733 | 0.5795 | 0.0165 | 75.64 |
| rs9815037 | Imputed | T | ADDITIVE | 7.92E−05 | 0.0586 | 0.5721 | 0.5786 | 0.0188 | 74.84 |
| rs9815037 | Imputed | T | DOMINANT | 0.0001241 | 0.07373 | 0.5708 | 0.5779 | 0.0148 | 76.27 |
| rs9825349 | Imputed | A | ADDITIVE | 7.92E−05 | 0.0586 | 0.5721 | 0.5786 | 0.0188 | 74.84 |
| rs9825349 | Imputed | A | DOMINANT | 0.0001241 | 0.07373 | 0.5708 | 0.5779 | 0.0148 | 76.27 |
| rs9834217 | Imputed | T | ADDITIVE | 6.37E−05 | 0.04695 | 0.5683 | 0.5735 | 0.024 | 73.19 |
| rs9834217 | Imputed | T | DOMINANT | 9.99E−05 | 0.05997 | 0.5668 | 0.5725 | 0.0192 | 74.7 |
| rs9840460 | Imputed | T | ADDITIVE | 6.24E−05 | 0.0469 | 0.5679 | 0.5732 | 0.0239 | 73.23 |
| rs9840460 | Imputed | T | DOMINANT | 9.77E−05 | 0.05992 | 0.5664 | 0.5721 | 0.0191 | 74.75 |
| rs9840756 | Imputed | A | ADDITIVE | 5.29E−05 | 0.04056 | 0.5646 | 0.5694 | 0.0275 | 72.18 |
| rs9840756 | Imputed | A | DOMINANT | 8.32E−05 | 0.05269 | 0.563 | 0.5684 | 0.022 | 73.8 |
| rs9844801 | Imputed | C | DOMINANT | 0.003653 | 0.1786 | 1.4802 | 1.4969 | 0.0084 | 79.08 |
| rs985375 | Imputed | A | GENOTYPIC | 0.0005024 | 0.0184 | 2.1795 | 2.1225 | 0.1411 | 48.93 |
| rs9869187 | Imputed | C | ADDITIVE | 0.0002129 | 0.05227 | 0.587 | 0.5974 | 0.0378 | 69.48 |
| rs9869187 | Imputed | C | DOMINANT | 0.0005049 | 0.05719 | 0.5988 | 0.6038 | 0.0436 | 68.07 |
| rs9872327 | Imputed | T | DOMINANT | 0.003653 | 0.1786 | 1.4802 | 1.4969 | 0.0084 | 79.08 |
| rs9881685 | Imputed | A | ADDITIVE | 5.96E−05 | 0.0538 | 0.5653 | 0.5735 | 0.0205 | 74.27 |
| rs9881685 | Imputed | A | DOMINANT | 8.36E−05 | 0.0568 | 0.5632 | 0.5683 | 0.0192 | 74.71 |
| rs9909499 | Imputed | C | DOMINANT | 6.59E−05 | 6.59E−05 | 1.5349 | 1.5349 | 0.7556 | 0 |
| rs9911847 | Imputed | G | DOMINANT | 6.59E−05 | 6.59E−05 | 0.6229 | 0.6229 | 0.5677 | 0 |
| rs9946886 | Imputed | G | RECESSIVE | 5.84E−05 | 5.84E−05 | 0.3084 | 0.3084 | 0.8937 | 0 |
| rs9958823 | Imputed | A | ADDITIVE | 0.0001257 | 0.005478 | 1.3904 | 1.3724 | 0.1829 | 41.13 |
| rs9965248 | Imputed | T | ADDITIVE | 0.0006176 | 0.03664 | 1.3453 | 1.3168 | 0.1086 | 54.95 |

TABLE 14

| SNP rs # | SOURCE | AL-LELE (A1) | MOD-EL | NMISS | OR | SE | L95 | U95 | STAT | P | HW_PVA-LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs577638540 | Genotyped | T | DOM | 800 | 0.3686 | 0.3223 | 0.196 | 0.6931 | -3.097 | 0.001952 | 0.3047 | 0.0375 | 0.021008 | 0.05079 | 1 | 13 | 343 | 1 | 43 | 399 |
| rs72746987 | Genotyped | A | DOM | 800 | 0.3351 | 0.3134 | 0.1813 | 0.6195 | -3.488 | 0.000487 | 1 | 0.04 | 0.019608 | 0.056433 | 0 | 14 | 343 | 1 | 48 | 394 |
| rs10021016 | Genotyped | G | GEN | 800 | | | | | 7.997 | 0.01834 | 0.8563 | 0.26563 | 0.294118 | 0.242664 | 35 | 140 | 182 | 20 | 175 | 248 |
| rs10021016 | Genotyped | G | REC | 800 | 2.242 | 0.2913 | 1.266 | 3.967 | 2.771 | 0.005589 | 0.8563 | 0.26563 | 0.294118 | 0.242664 | 35 | 140 | 182 | 20 | 175 | 248 |
| rs10051148 | Imputed | C | DOM | 796 | 0.6544 | 0.1465 | 0.491 | 0.8722 | -2.893 | 0.003813 | 0.8139 | 0.34296 | 0.315493 | 0.365079 | 44 | 136 | 175 | 51 | 220 | 170 |
| rs10054055 | Imputed | T | DOM | 800 | 0.6617 | 0.1466 | 0.4964 | 0.882 | -2.816 | 0.004859 | 0.9376 | 0.345 | 0.317927 | 0.366817 | 44 | 139 | 174 | 52 | 221 | 170 |
| rs10067895 | Imputed | A | DOM | 791 | 0.6716 | 0.1473 | 0.5032 | 0.8964 | -2.703 | 0.006933 | 0.6933 | 0.34324 | 0.316901 | 0.364679 | 44 | 137 | 174 | 52 | 214 | 170 |
| rs10100725 | Imputed | C | DOM | 800 | 0.5483 | 0.1594 | 0.4011 | 0.7494 | -3.769 | 0.000164 | 0.2765 | 0.17813 | 0.141457 | 0.207675 | 12 | 77 | 268 | 18 | 148 | 277 |
| rs10128531 | Imputed | T | ADD | 742 | 1.482 | 0.1557 | 1.092 | 2.011 | 2.526 | 0.01154 | 0.7542 | 0.13612 | 0.159159 | 0.117359 | 7 | 92 | 234 | 5 | 86 | 318 |
| rs10181743 | Imputed | G | ADD | 762 | 1.488 | 0.1083 | 1.204 | 1.84 | 3.673 | 0.00024 | 0.5529 | 0.42126 | 0.473837 | 0.266279 | 72 | 182 | 90 | 59 | 198 | 161 |
| rs10199127 | Imputed | T | DOM | 780 | 1.486 | 0.1462 | 1.116 | 1.98 | 2.712 | 0.006692 | 0.4327 | 0.28846 | 0.315714 | 0.266279 | 28 | 165 | 157 | 32 | 165 | 233 |
| rs10270624 | Imputed | G | DOM | 750 | 1.438 | 0.1529 | 1.066 | 1.94 | 2.375 | 0.01754 | 0.5731 | 0.20333 | 0.224036 | 0.186441 | 11 | 129 | 197 | 17 | 120 | 276 |
| rs1030006 | Imputed | G | REC | 797 | 1.663 | 0.1726 | 1.186 | 2.333 | 2.947 | 0.003209 | 0.8313 | 0.46926 | 0.495775 | 0.447964 | 96 | 160 | 99 | 81 | 234 | 127 |
| rs1031811 | Imputed | A | REC | 792 | 1.684 | 0.2618 | 1.008 | 2.813 | 1.991 | 0.04646 | 0.5994 | 0.2822 | 0.291785 | 0.274487 | 37 | 132 | 184 | 29 | 183 | 227 |
| rs10430870 | Genotyped | G | GEN | 800 | | | | | 8.659 | 0.01317 | 0.1303 | 0.24938 | 0.282913 | 0.222348 | 36 | 130 | 191 | 22 | 153 | 268 |
| rs10430870 | Genotyped | G | REC | 800 | 2.178 | 0.2884 | 1.237 | 3.833 | 2.698 | 0.006973 | 0.1303 | 0.24938 | 0.282913 | 0.222348 | 36 | 130 | 191 | 22 | 153 | 268 |
| rs10469597 | Imputed | A | GEN | 739 | | | | | 11.61 | 0.003011 | 0.04142 | 0.27267 | 0.308735 | 0.243243 | 43 | 119 | 170 | 23 | 152 | 232 |
| rs10469597 | Imputed | A | REC | 739 | 2.519 | 0.2716 | 1.479 | 4.289 | 3.401 | 0.00067 | 0.04142 | 0.27267 | 0.308735 | 0.243243 | 43 | 119 | 170 | 23 | 152 | 232 |
| rs10478919 | Imputed | G | DOM | 797 | 0.6489 | 0.1462 | 0.4872 | 0.8644 | -2.957 | 0.003109 | 0.7533 | 0.34316 | 0.314607 | 0.366213 | 44 | 136 | 176 | 52 | 219 | 170 |
| rs10506623 | Imputed | C | ADD | 777 | 0.7349 | 0.1071 | 0.5957 | 0.9066 | -2.875 | 0.004041 | 1 | 0.39961 | 0.362069 | 0.43007 | 50 | 152 | 146 | 74 | 221 | 134 |
| rs10506623 | Imputed | C | DOM | 777 | 0.6128 | 0.1531 | 0.454 | 0.8273 | -3.199 | 0.001381 | 1 | 0.39961 | 0.362069 | 0.43007 | 50 | 152 | 146 | 74 | 221 | 134 |
| rs10506626 | Imputed | A | ADD | 795 | 0.7463 | 0.105 | 0.6075 | 0.9169 | -2.786 | 0.005339 | 0.8818 | 0.39308 | 0.356742 | 0.422551 | 53 | 148 | 155 | 71 | 229 | 139 |
| rs10506626 | Imputed | A | DOM | 795 | 0.5922 | 0.1495 | 0.4418 | 0.7938 | -3.504 | 0.000458 | 0.8818 | 0.39308 | 0.356742 | 0.422551 | 53 | 148 | 155 | 71 | 229 | 139 |
| rs10509477 | Imputed | T | DOM | 800 | 1.654 | 0.1456 | 1.243 | 2.2 | 3.456 | 0.000547 | 0.9326 | 0.29688 | 0.329132 | 0.27088 | 31 | 173 | 153 | 40 | 160 | 243 |
| rs10517918 | Imported | G | REC | 798 | 1.697 | 0.1851 | 1.181 | 2.439 | 2.858 | 0.004265 | 0.7175 | 0.42669 | 0.460674 | 0.399321 | 81 | 166 | 109 | 67 | 219 | 156 |
| rs10517924 | Imputed | A | REC | 800 | 1.803 | 0.1754 | 1.279 | 2.543 | 3.362 | 0.000773 | 0.4338 | 0.45625 | 0.488796 | 0.430023 | 96 | 157 | 104 | 76 | 229 | 138 |
| rs10519362 | Imputed | G | DOM | 784 | 1.5 | 0.1539 | 1.109 | 2.028 | 2.634 | 0.00844 | 1 | 0.17985 | 0.201705 | 0.162037 | 9 | 124 | 219 | 16 | 108 | 308 |
| rs10520072 | Imputed | T | DOM | 800 | 0.6617 | 0.1466 | 0.4964 | 0.882 | -2.816 | 0.004859 | 0.8149 | 0.34563 | 0.317927 | 0.367946 | 44 | 139 | 174 | 53 | 220 | 170 |
| rs10737390 | Imputed | T | ADD | 787 | 0.5772 | 0.1513 | 0.4291 | 0.7764 | -3.632 | 0.000281 | 0.7109 | 0.40089 | 0.365819 | 0.429561 | 58 | 143 | 153 | 71 | 230 | 132 |
| rs10742851 | Imputed | T | REC | 800 | 0.406 | 0.2924 | 0.2289 | 0.7202 | -3.083 | 0.002051 | 1 | 0.29 | 0.268998 | 0.306998 | 17 | 158 | 182 | 50 | 172 | 221 |
| rs10743685 | Imputed | G | GEN | 795 | | | | | 12.35 | 0.002076 | 0.1392 | 0.39937 | 0.443662 | 0.363636 | 79 | 157 | 119 | 58 | 204 | 178 |
| rs10743685 | Imputed | G | REC | 795 | 1.943 | 0.1919 | 1.334 | 2.831 | 3.462 | 0.000536 | 0.1392 | 0.39937 | 0.443662 | 0.363636 | 79 | 157 | 119 | 58 | 204 | 178 |
| rs10749293 | Imputed | A | DOM | 797 | 1.637 | 0.1456 | 1.231 | 2.178 | 3.387 | 0.000706 | 0.8656 | 0.29674 | 0.328652 | 0.270975 | 31 | 172 | 153 | 40 | 159 | 242 |
| rs10749294 | Imputed | A | DOM | 798 | 1.575 | 0.1455 | 1.184 | 2.095 | 3.123 | 0.00179 | 0.7216 | 0.27256 | 0.300562 | 0.25 | 24 | 166 | 166 | 33 | 155 | 254 |
| rs10753760 | Imputed | T | ADD | 745 | 1.391 | 0.1067 | 1.128 | 1.715 | 3.093 | 0.001984 | 0.5446 | 0.4094 | 0.456061 | 0.372289 | 71 | 159 | 100 | 58 | 193 | 164 |
| rs10753760 | Imputed | T | GEN | 745 | | | | | 9.763 | 0.007586 | 0.5446 | 0.4094 | 0.456061 | 0.372289 | 71 | 159 | 100 | 58 | 193 | 164 |
| rs10772362 | Imputed | T | ADD | 800 | 0.6338 | 0.1259 | 0.4952 | 0.8112 | -3.621 | 0.000293 | 0.2824 | 0.2375 | 0.194678 | 0.272009 | 7 | 125 | 225 | 32 | 177 | 234 |
| rs10784891 | Imputed | C | ADD | 765 | 0.7164 | 0.1084 | 0.5792 | 0.886 | -3.077 | 0.002092 | 0.3414 | 0.44575 | 0.404692 | 0.478774 | 54 | 168 | 119 | 91 | 224 | 109 |

TABLE 14-continued

| SNP rs # | SOURCE | AL-LELE (A1) | MOD-EL | NMISS | OR | SE | L95 | U95 | STAT | P | HW_PVA-LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs10784891 | Imputed | C | DOM | 765 | 0.631 | 0.1608 | 0.4604 | 0.8648 | −2.863 | 0.004193 | 0.3414 | 0.44575 | 0.404692 | 0.478774 | 54 | 168 | 119 | 91 | 224 | 109 |
| rs10784891 | Imputed | C | GEN | 765 |  |  |  |  | 9.725 | 0.007731 | 0.3414 | 0.44575 | 0.404692 | 0.478774 | 54 | 168 | 119 | 91 | 224 | 109 |
| rs10787923 | Imputed | G | DOM | 796 | 1.647 | 0.1457 | 1.238 | 2.191 | 3.425 | 0.000616 | 0.8652 | 0.29648 | 0.328652 | 0.270455 | 31 | 172 | 153 | 40 | 158 | 242 |
| rs10787924 | Imputed | T | DOM | 797 | 1.585 | 0.1456 | 1.191 | 2.109 | 3.163 | 0.001564 | 0.8885 | 0.27227 | 0.300562 | 0.249433 | 24 | 166 | 166 | 33 | 154 | 254 |
| rs10787949 | Imputed | A | DOM | 800 | 1.634 | 0.1456 | 1.228 | 2.173 | 3.373 | 0.000745 | 1 | 0.29688 | 0.330532 | 0.269752 | 32 | 172 | 153 | 38 | 163 | 242 |
| rs10787951 | Imputed | G | DOM | 800 | 1.634 | 0.1456 | 1.228 | 2.173 | 3.373 | 0.000745 | 1 | 0.29688 | 0.330532 | 0.269752 | 32 | 172 | 153 | 38 | 163 | 242 |
| rs10787983 | Imputed | C | DOM | 798 | 1.614 | 0.1449 | 1.215 | 2.144 | 3.304 | 0.000953 | 0.8644 | 0.29261 | 0.32493 | 0.26644 | 30 | 172 | 155 | 37 | 161 | 243 |
| rs10794733 | Imputed | C | ADD | 786 | 0.765 | 0.1126 | 0.6135 | 0.9539 | −2.379 | 0.01734 | 0.934 | 0.31361 | 0.2849 | 0.336782 | 31 | 138 | 182 | 47 | 199 | 189 |
| rs10818280 | Imputed | C | ADD | 788 | 0.7042 | 0.1448 | 0.5302 | 0.9353 | −2.422 | 0.01544 | 0.7332 | 0.29759 | 0.26204 | 0.326437 | 25 | 135 | 193 | 47 | 190 | 198 |
| rs10860586 | Imputed | A | ADD | 796 | 1.322 | 0.1036 | 1.079 | 1.62 | 2.695 | 0.007028 | 0.8315 | 0.48995 | 0.523876 | 0.4625 | 97 | 179 | 80 | 92 | 223 | 125 |
| rs10860586 | Imputed | A | GEN | 796 |  |  |  |  | 7.298 | 0.02602 | 0.8315 | 0.48995 | 0.523876 | 0.4625 | 97 | 179 | 80 | 92 | 223 | 125 |
| rs10870473 | Imputed | A | ADD | 371 | 0.54 | 0.1831 | 0.3772 | 0.773 | −3.366 | 0.000762 | 0.894 | 0.2655 | 0.207317 | 0.311594 | 7 | 54 | 103 | 18 | 93 | 96 |
| rs10870473 | Imputed | A | DOM | 371 | 0.4734 | 0.2198 | 0.3077 | 0.7283 | −3.402 | 0.000668 | 0.894 | 0.2655 | 0.207317 | 0.311594 | 7 | 54 | 103 | 18 | 93 | 96 |
| rs10879240 | Imputed | C | ADD | 791 | 0.7324 | 0.1067 | 0.5942 | 0.9027 | −2.92 | 0.003505 | 0.2791 | 0.43805 | 0.40085 | 0.468037 | 53 | 177 | 123 | 91 | 228 | 119 |
| rs10879240 | Imputed | C | GEN | 791 |  |  |  |  | 8.522 | 0.0141 | 0.2791 | 0.43805 | 0.40085 | 0.468037 | 53 | 177 | 123 | 91 | 228 | 119 |
| rs10879242 | Imputed | A | ADD | 793 | 0.741 | 0.1058 | 0.6022 | 0.9117 | −3.288 | 0.0046 | 0.941 | 0.40038 | 0.364789 | 0.429224 | 52 | 155 | 148 | 74 | 228 | 136 |
| rs10879242 | Imputed | A | DOM | 793 | 0.6085 | 0.1511 | 0.4525 | 0.8182 | −3.288 | 0.00101 | 0.941 | 0.40038 | 0.364789 | 0.429224 | 52 | 155 | 148 | 74 | 228 | 136 |
| rs10879245 | Imputed | G | ADD | 793 | 0.741 | 0.1058 | 0.6022 | 0.9117 | −2.834 | 0.0046 | 0.941 | 0.40038 | 0.364789 | 0.429224 | 52 | 155 | 148 | 74 | 228 | 136 |
| rs10879245 | Imputed | G | DOM | 793 | 0.6085 | 0.1511 | 0.4525 | 0.8182 | −3.288 | 0.00101 | 0.941 | 0.40038 | 0.364789 | 0.429224 | 52 | 155 | 148 | 74 | 228 | 136 |
| rs10879249 | Imputed | T | ADD | 795 | 0.7264 | 0.1064 | 0.5897 | 0.8947 | −3.006 | 0.00265 | 1 | 0.3956 | 0.357746 | 0.426136 | 50 | 154 | 151 | 74 | 227 | 139 |
| rs10879249 | Imputed | T | DOM | 795 | 0.6001 | 0.151 | 0.4464 | 0.8068 | −3.382 | 0.000072 | 1 | 0.3956 | 0.357746 | 0.426136 | 50 | 154 | 151 | 74 | 227 | 139 |
| rs10886429 | Imputed | A | DOM | 797 | 1.634 | 0.1459 | 1.228 | 2.175 | 3.365 | 0.000766 | 0.9325 | 0.29737 | 0.328652 | 0.272109 | 31 | 172 | 153 | 40 | 160 | 241 |
| rs10886449 | Imputed | G | DOM | 800 | 1.594 | 0.145 | 1.2 | 2.119 | 3.217 | 0.001297 | 0.7887 | 0.27188 | 0.302521 | 0.247178 | 25 | 166 | 166 | 32 | 155 | 256 |
| rs10886451 | Imputed | G | DOM | 800 | 1.594 | 0.145 | 1.2 | 2.119 | 3.217 | 0.001297 | 0.7887 | 0.27188 | 0.302521 | 0.247178 | 25 | 166 | 166 | 32 | 155 | 256 |
| rs10886452 | Imputed | A | DOM | 800 | 1.634 | 0.1456 | 1.228 | 2.173 | 3.373 | 0.000745 | 1 | 0.29688 | 0.330532 | 0.269752 | 32 | 172 | 153 | 38 | 163 | 242 |
| rs10886456 | Imputed | G | DOM | 800 | 1.594 | 0.145 | 1.2 | 2.119 | 3.217 | 0.001297 | 7.89E-01 | 0.27188 | 0.302521 | 0.247178 | 25 | 166 | 166 | 32 | 155 | 256 |
| rs10886463 | Imputed | G | DOM | 800 | 1.624 | 0.1458 | 1.221 | 2.162 | 3.327 | 0.000878 | 0.9328 | 0.29875 | 0.330532 | 0.273138 | 32 | 172 | 153 | 40 | 162 | 241 |
| rs10886465 | Imputed | A | DOM | 800 | 1.664 | 0.1454 | 1.251 | 2.212 | 3.503 | 0.000461 | 1 | 0.295 | 0.329132 | 0.267494 | 31 | 173 | 153 | 38 | 161 | 244 |
| rs10886526 | Imputed | C | DOM | 798 | 1.614 | 0.1449 | 1.215 | 2.144 | 3.304 | 0.000953 | 0.8644 | 0.29261 | 0.32493 | 0.26644 | 30 | 172 | 155 | 37 | 161 | 243 |
| rs10922903 | Imputed | C | REC | 800 | 0.4885 | 0.1995 | 0.3304 | 0.7222 | −3.591 | 0.000329 | 0.8845 | 0.41813 | 0.37535 | 0.452596 | 44 | 180 | 133 | 97 | 207 | 139 |
| rs10941126 | Imputed | G | ADD | 800 | 0.2198 | 0.3906 | 0.1022 | 0.4726 | −3.878 | 0.000105 | 0.0147 | 0.03563 | 0.015406 | 0.051919 | 0 | 11 | 346 | 4 | 38 | 401 |
| rs10941126 | Imputed | G | DOM | 800 | 0.2258 | 0.4052 | 0.102 | 0.4995 | −3.673 | 0.00024 | 0.0147 | 0.03563 | 0.015406 | 0.051919 | 0 | 11 | 346 | 4 | 38 | 401 |
| rs10947980 | Imputed | A | ADD | 798 | 0.7397 | 0.1176 | 0.5875 | 0.9314 | −2.564 | 0.01033 | 0.7851 | 0.26504 | 0.232493 | 0.291383 | 19 | 128 | 210 | 35 | 187 | 219 |
| rs11059376 | Imputed | T | ADD | 720 | 1.559 | 0.1386 | 1.188 | 2.045 | 3.203 | 0.001362 | 0.8067 | 0.18681 | 0.222741 | 0.157895 | 16 | 111 | 194 | 10 | 106 | 283 |
| rs11072995 | Imputed | T | GEN | 793 |  |  |  |  | 9.167 | 0.01022 | 0.9062 | 0.18474 | 0.210452 | 0.164009 | 19 | 111 | 224 | 7 | 130 | 302 |
| rs11072995 | Imputed | T | REC | 793 | 3.578 | 0.4502 | 1.481 | 8.646 | 2.832 | 0.004626 | 0.9062 | 0.18474 | 0.210452 | 0.164009 | 19 | 111 | 224 | 7 | 130 | 302 |
| rs11081202 | Geno-typed | G | GEN | 800 |  |  |  |  | 7.034 | 0.02969 | 0.04263 | 0.29875 | 0.305322 | 0.293454 | 35 | 148 | 174 | 24 | 212 | 207 |
| rs11081202 | Geno-typed | G | REC | 800 | 1.887 | 0.2769 | 1.097 | 3.248 | 2.294 | 0.0218 | 0.04263 | 0.29875 | 0.305322 | 0.293454 | 35 | 148 | 174 | 24 | 212 | 207 |
| rs110965 | Imputed | C | GEN | 737 |  |  |  |  | 5.271 | 0.07169 | 0.4545 | 0.33175 | 0.354545 | 0.313268 | 44 | 146 | 140 | 32 | 191 | 184 |
| rs11124962 | Imputed | A | DOM | 790 | 1.469 | 0.1461 | 1.103 | 1.956 | 2.63 | 0.008532 | 0.00528 | 0.23418 | 0.26204 | 0.21167 | 15 | 155 | 183 | 14 | 157 | 266 |
| rs11116596 | Imputed | T | DOM | 794 | 0.6531 | 0.1466 | 0.49 | 0.8704 | −2.907 | 0.003646 | 0.8136 | 0.34446 | 0.316384 | 0.367045 | 44 | 136 | 174 | 52 | 219 | 169 |
| rs11178531 | Imputed | A | ADD | 796 | 0.7599 | 0.1049 | 0.6187 | 0.9334 | −2.618 | 0.008858 | 0.4338 | 0.46734 | 0.432394 | 0.495465 | 68 | 171 | 116 | 100 | 237 | 104 |
| rs11178531 | Imputed | A | DOM | 796 | 0.6258 | 0.1604 | 0.4569 | 0.857 | −2.922 | 0.003477 | 0.4338 | 0.46734 | 0.432394 | 0.495465 | 68 | 171 | 116 | 100 | 237 | 104 |
| rs11178583 | Imputed | A | ADD | 796 | 0.7274 | 0.1063 | 0.5906 | 0.896 | −2.993 | 0.002762 | 0.9411 | 0.39573 | 0.358146 | 0.426136 | 50 | 155 | 151 | 74 | 227 | 139 |

TABLE 14-continued

| SNP rs # | SOURCE | AL-LELE (A1) | MOD-EL | NMISS | OR | SE | L95 | U95 | STAT | P | HW_PVA-LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs11178583 | Imputed | A | DOM | 796 | 0.6032 | 0.1509 | 0.4488 | 0.8108 | -3.35 | 0.000809 | 0.9411 | 0.39573 | 0.358146 | 0.426136 | 50 | 155 | 151 | 74 | 227 | 139 |
| rs11178589 | Imputed | T | ADD | 787 | 0.7243 | 0.1059 | 0.5885 | 0.8915 | -3.044 | 0.002334 | 0.9413 | 0.40915 | 0.368946 | 0.441514 | 52 | 155 | 144 | 79 | 227 | 130 |
| rs11178589 | Imputed | T | DOM | 787 | 0.5988 | 0.1526 | 0.444 | 0.8075 | -3.362 | 0.000775 | 0.9413 | 0.40915 | 0.368946 | 0.441514 | 52 | 155 | 144 | 79 | 227 | 130 |
| rs11178594 | Imputed | C | ADD | 797 | 0.7305 | 0.1059 | 0.5936 | 0.8991 | -2.964 | 0.003033 | 1 | 0.39837 | 0.360563 | 0.428733 | 51 | 154 | 150 | 75 | 229 | 138 |
| rs11178594 | Imputed | C | DOM | 797 | 0.5995 | 0.1509 | 0.446 | 0.8058 | -3.391 | 0.000696 | 1 | 0.39837 | 0.360563 | 0.428733 | 51 | 154 | 150 | 75 | 229 | 138 |
| rs11178602 | Imputed | T | ADD | 795 | 0.7265 | 0.1059 | 0.5904 | 0.8941 | -3.018 | 0.002545 | 0.9411 | 0.39748 | 0.358757 | 0.428571 | 51 | 152 | 151 | 75 | 228 | 138 |
| rs11178602 | Imputed | T | DOM | 795 | 0.592 | 0.1508 | 0.4405 | 0.7956 | -3.476 | 0.00051 | 0.9411 | 0.39748 | 0.358757 | 0.428571 | 51 | 152 | 151 | 75 | 228 | 138 |
| rs11178648 | Imputed | T | ADD | 794 | 0.7481 | 0.1053 | 0.6086 | 0.9195 | -2.757 | 0.000584 | 0.9407 | 0.39232 | 0.356338 | 0.421412 | 53 | 147 | 155 | 70 | 230 | 139 |
| rs11178648 | Imputed | T | DOM | 794 | 0.5905 | 0.1497 | 0.4403 | 0.7918 | -3.52 | 0.000432 | 0.9407 | 0.39232 | 0.356338 | 0.421412 | 53 | 147 | 155 | 70 | 230 | 139 |
| rs11198877 | Imputed | T | DOM | 800 | 1.634 | 0.1456 | 1.228 | 2.173 | 3.373 | 0.000745 | 1 | 0.29688 | 0.330532 | 0.269752 | 32 | 172 | 153 | 38 | 163 | 242 |
| rs11198942 | Imputed | T | ADD | 800 | 1.654 | 0.1456 | 1.243 | 2.2 | 3.456 | 0.000547 | 0.9326 | 0.29688 | 0.329132 | 0.27088 | 31 | 173 | 153 | 40 | 160 | 243 |
| rs11221075 | Imputed | A | ADD | 725 | 0.6446 | 0.1613 | 0.4698 | 0.8842 | -2.723 | 0.006476 | 0.2665 | 0.13586 | 0.107256 | 0.158088 | 2 | 64 | 251 | 15 | 99 | 294 |
| rs11242020 | Imputed | T | DOM | 798 | 0.6462 | 0.1462 | 0.4852 | 0.8606 | -2.987 | 0.002819 | 0.754 | 0.34336 | 0.314607 | 0.366516 | 44 | 136 | 176 | 52 | 220 | 170 |
| rs11242021 | Imputed | T | DOM | 800 | 0.6617 | 0.1466 | 0.4964 | 0.882 | -2.816 | 0.004859 | 0.7549 | 0.34625 | 0.317927 | 0.369074 | 44 | 139 | 174 | 54 | 219 | 170 |
| rs11242022 | Imputed | T | DOM | 800 | 0.6617 | 0.1466 | 0.4964 | 0.882 | -2.816 | 0.004859 | 0.7549 | 0.34625 | 0.317927 | 0.369074 | 44 | 139 | 174 | 54 | 219 | 170 |
| rs11242023 | Imputed | T | DOM | 795 | 0.6676 | 0.1469 | 0.5005 | 0.8904 | -2.75 | 0.00596 | 0.7538 | 0.34403 | 0.317416 | 0.365604 | 44 | 138 | 174 | 52 | 217 | 170 |
| rs1149349 | Imputed | T | DOM | 798 | 1.696 | 0.1575 | 1.245 | 2.309 | 3.352 | 0.000802 | 0.6129 | 0.16729 | 0.19888 | 0.141723 | 11 | 120 | 226 | 9 | 107 | 325 |
| rs1149350 | Imputed | A | ADD | 789 | 1.592 | 0.131 | 1.232 | 2.058 | 3.552 | 0.000383 | 0.3353 | 0.21103 | 0.249288 | 0.180365 | 17 | 141 | 193 | 13 | 132 | 293 |
| rs1149350 | Imputed | A | DOM | 789 | 1.701 | 0.1501 | 1.267 | 2.282 | 3.539 | 0.000401 | 0.3353 | 0.21103 | 0.249288 | 0.180365 | 17 | 141 | 193 | 13 | 132 | 293 |
| rs1576627 | Imputed | T | ADD | 800 | 1.72 | 0.1612 | 1.254 | 2.358 | 3.364 | 0.000769 | 0.04851 | 0.12313 | 0.154062 | 0.098194 | 3 | 104 | 250 | 3 | 81 | 359 |
| rs1576627 | Imputed | T | DOM | 800 | 1.805 | 0.1683 | 1.298 | 2.51 | 3.508 | 0.000451 | 0.04851 | 0.12313 | 0.154062 | 0.098194 | 3 | 104 | 250 | 3 | 81 | 359 |
| rs1630050 | Imputed | G | GEN | 778 | | | | | 8.696 | 0.01294 | 1 | 0.20373 | 0.227666 | 0.184455 | 22 | 114 | 211 | 10 | 139 | 282 |
| rs1630050 | Imputed | G | REC | 778 | 3.097 | 0.3961 | 1.425 | 6.731 | 2.854 | 0.004317 | 1 | 0.20373 | 0.227666 | 0.184455 | 22 | 114 | 211 | 10 | 139 | 282 |
| rs1633024 | Imputed | C | GEN | 778 | | | | | 8.696 | 0.01294 | 1 | 0.20373 | 0.227666 | 0.184455 | 22 | 114 | 211 | 10 | 139 | 282 |
| rs1633024 | Imputed | C | REC | 778 | 3.097 | 0.3961 | 1.425 | 6.731 | 2.854 | 0.004317 | 1 | 0.20373 | 0.227666 | 0.184455 | 22 | 114 | 211 | 10 | 139 | 282 |
| rs1636298 | Imputed | G | GEN | 800 | | | | | 9.499 | 0.008657 | 0.9089 | 0.19125 | 0.217087 | 0.170429 | 20 | 115 | 222 | 8 | 135 | 300 |
| rs1636298 | Imputed | G | REC | 800 | 3.433 | 0.4298 | 1.478 | 7.972 | 2.87 | 0.004111 | 0.9089 | 0.19125 | 0.217087 | 0.170429 | 20 | 115 | 222 | 8 | 135 | 300 |
| rs1637363 | Imputed | C | GEN | 774 | | | | | 9.788 | 0.007493 | | 0.20607 | 0.231778 | 0.185615 | 23 | 113 | 207 | 10 | 140 | 281 |
| rs1637363 | Imputed | C | REC | 774 | 3.309 | 0.3942 | 1.528 | 7.166 | 3.035 | 0.002402 | | 0.20607 | 0.231778 | 0.185615 | 23 | 113 | 207 | 10 | 140 | 281 |
| rs1637813 | Imputed | A | GEN | 778 | | | | | 8.696 | 0.01294 | 0.9134 | 0.20373 | 0.227666 | 0.184455 | 22 | 114 | 211 | 10 | 139 | 282 |
| rs1637813 | Imputed | A | REC | 778 | 3.097 | 0.3961 | 1.425 | 6.731 | 2.854 | 0.004317 | 0.9134 | 0.20373 | 0.227666 | 0.184455 | 22 | 114 | 211 | 10 | 139 | 282 |
| rs1638043 | Imputed | C | GEN | 777 | | | | | 8.808 | 0.01223 | 0.9134 | 0.20785 | 0.232558 | 0.188222 | 23 | 114 | 207 | 11 | 141 | 281 |
| rs1638043 | Imputed | C | REC | 777 | 2.984 | 0.3815 | 1.413 | 6.303 | 2.866 | 0.00416 | 0.9134 | 0.20785 | 0.232558 | 0.188222 | 23 | 114 | 207 | 11 | 141 | 281 |
| rs1638115 | Imputed | A | GEN | 793 | | | | | 9.167 | 0.01022 | 0.9062 | 0.18474 | 0.210452 | 0.164009 | 19 | 111 | 224 | 7 | 130 | 302 |
| rs1638115 | Imputed | A | REC | 793 | 3.578 | 0.4502 | 1.481 | 8.646 | 2.832 | 0.004626 | 0.9062 | 0.18474 | 0.210452 | 0.164009 | 19 | 111 | 224 | 7 | 130 | 302 |
| rs1638444 | Imputed | C | GEN | 799 | | | | | 9.274 | 0.009687 | 0.8201 | 0.19149 | 0.217087 | 0.170814 | 20 | 115 | 222 | 8 | 135 | 299 |
| rs11717157 | Imputed | T | ADD | 800 | 1.366 | 0.1079 | 1.105 | 1.688 | 2.889 | 0.00386 | 0.6465 | 0.36313 | 0.403361 | 0.3307 | 60 | 168 | 129 | 42 | 209 | 192 |
| rs11717157 | Imputed | T | GEN | 800 | | | | | 9.972 | 0.006832 | 0.6465 | 0.36313 | 0.403361 | 0.3307 | 60 | 168 | 129 | 42 | 209 | 192 |
| rs11724055 | Imputed | A | DOM | 798 | 0.6341 | 0.1569 | 0.4662 | 0.8624 | -2.903 | 0.003694 | 0.2128 | 0.17043 | 0.140845 | 0.194131 | 6 | 88 | 261 | 12 | 148 | 283 |
| rs11743355 | Imputed | C | ADD | 732 | 0.2056 | 0.4133 | 0.0915 | 0.4623 | -3.827 | 0.00013 | 0.01548 | 0.03689 | 0.01548 | 0.05379 | 0 | 10 | 313 | 4 | 36 | 369 |
| rs11743355 | Imputed | C | DOM | 732 | 0.2102 | 0.4294 | 0.0906 | 0.4878 | -3.632 | 0.000282 | 0.01351 | 0.03689 | 0.01548 | 0.05379 | 0 | 10 | 313 | 4 | 36 | 369 |
| rs11746806 | Imputed | C | ADD | 800 | 0.2198 | 0.3906 | 0.1022 | 0.4726 | -3.878 | 0.000105 | 0.0147 | 0.03563 | 0.015406 | 0.051919 | 0 | 11 | 346 | 4 | 38 | 401 |
| rs11746806 | Imputed | T | DOM | 800 | 0.2258 | 0.4052 | 0.102 | 0.4995 | -3.673 | 0.00024 | 0.0147 | 0.03563 | 0.015406 | 0.051919 | 0 | 11 | 346 | 4 | 38 | 401 |
| rs11746959 | Imputed | T | ADD | 800 | 0.2198 | 0.3906 | 0.1022 | 0.4726 | -3.878 | 0.000105 | 0.0147 | 0.03563 | 0.015406 | 0.051919 | 0 | 11 | 346 | 4 | 38 | 401 |
| rs11746959 | Imputed | T | DOM | 800 | 0.2258 | 0.4052 | 0.102 | 0.4995 | -3.673 | 0.00024 | 0.0147 | 0.03563 | 0.015406 | 0.051919 | 0 | 11 | 346 | 4 | 38 | 401 |
| rs11749272 | Imputed | T | DOM | 797 | 0.6489 | 0.1462 | 0.4872 | 0.8644 | -2.957 | 0.003109 | 0.7533 | 0.34316 | 0.314607 | 0.366213 | 44 | 136 | 176 | 52 | 219 | 170 |

TABLE 14-continued

| SNP rs # | SOURCE | AL-LELE (A1) | MOD-EL | NMISS | OR | SE | L95 | U95 | STAT | P | HW_PVA-LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs1839636 | Imputed | C | GEN | 789 | | | | | 12.4 | 0.002029 | 0.3879 | 0.29087 | 0.336158 | 0.254023 | 42 | 154 | 158 | 30 | 161 | 244 |
| rs1839785 | Imputed | C | GEN | 782 | | | | | 12.37 | 0.002065 | 0.2578 | 0.289 | 0.334758 | 0.25174 | 42 | 151 | 158 | 30 | 157 | 244 |
| rs11853619 | Imputed | C | GEN | 799 | | | | | 9.423 | 0.008993 | 0.9088 | 0.19086 | 0.217087 | 0.169683 | 20 | 115 | 222 | 8 | 134 | 300 |
| rs11853619 | Imputed | C | REC | 799 | 3.396 | 0.4296 | 1.463 | 7.882 | 2.846 | 0.004433 | 0.9088 | 0.19086 | 0.217087 | 0.169683 | 20 | 115 | 222 | 8 | 134 | 300 |
| rs11856780 | Imputed | A | GEN | 799 | | | | | 9.423 | 0.008993 | 0.9088 | 0.19086 | 0.217087 | 0.169683 | 20 | 115 | 222 | 8 | 134 | 300 |
| rs11856780 | Imputed | A | REC | 799 | 3.396 | 0.4296 | 1.463 | 7.882 | 2.846 | 0.004433 | 0.9088 | 0.19086 | 0.217087 | 0.169683 | 20 | 115 | 222 | 8 | 134 | 300 |
| rs11901899 | Imputed | A | DOM | 767 | 1.388 | 0.1476 | 1.039 | 1.853 | 2.22 | 0.02644 | 0.4548 | 0.26206 | 0.288406 | 0.240521 | 24 | 151 | 170 | 24 | 155 | 243 |
| rs11903290 | Imputed | C | REC | 793 | 1.68 | 0.2618 | 1.006 | 2.807 | 1.982 | 0.04748 | 0.598 | 0.28121 | 0.29096 | 0.273349 | 37 | 132 | 185 | 29 | 182 | 228 |
| rs11909480 | Imputed | G | ADD | 797 | 0.3557 | 0.3375 | 0.1836 | 0.6892 | -3.063 | 0.00219 | 0.591 | 0.03325 | 0.016854 | 0.046485 | 0 | 12 | 344 | 1 | 39 | 401 |
| rs11909480 | Imputed | G | DOM | 797 | 0.3552 | 0.3405 | 0.1822 | 0.6924 | -3.04 | 0.002368 | 0.591 | 0.03325 | 0.016854 | 0.046485 | 0 | 12 | 344 | 1 | 39 | 401 |
| rs11910289 | Imputed | T | ADD | 765 | 1.705 | 0.2347 | 1.077 | 2.702 | 2.274 | 0.02295 | 1 | 0.05556 | 0.070175 | 0.043735 | 1 | 46 | 295 | 1 | 35 | 387 |
| rs11910289 | Imputed | T | DOM | 765 | 1.77 | 0.2428 | 1.1 | 2.848 | 2.351 | 0.01871 | 1 | 0.05556 | 0.070175 | 0.043735 | 1 | 46 | 295 | 1 | 35 | 387 |
| rs11920375 | Geno-typed | C | GEN | 800 | | | | | 10.36 | 0.005635 | 0.9394 | 0.3675 | 0.407563 | 0.335214 | 63 | 165 | 129 | 44 | 209 | 190 |
| rs11926319 | Imputed | G | DOM | 799 | 0.5553 | 0.1951 | 0.3788 | 0.8139 | -3.015 | 0.002567 | 0.6789 | 0.09449 | 0.071429 | 0.113122 | 3 | 45 | 309 | 5 | 90 | 347 |
| rs11933744 | Imputed | T | REC | 799 | 2.427 | 0.2805 | 1.401 | 4.206 | 3.162 | 0.001567 | 1 | 0.27722 | 0.30112 | 0.257919 | 39 | 137 | 181 | 22 | 184 | 236 |
| rs11934919 | Imputed | C | REC | 799 | 2.427 | 0.2805 | 1.401 | 4.206 | 3.162 | 0.001567 | 1 | 0.27722 | 0.30112 | 0.257919 | 39 | 137 | 181 | 22 | 184 | 236 |
| rs11934957 | Imputed | C | REC | 799 | 2.427 | 0.2805 | 1.401 | 4.206 | 3.162 | 0.001567 | 1 | 0.27722 | 0.30112 | 0.257919 | 39 | 137 | 181 | 22 | 184 | 236 |
| rs11959206 | Imputed | A | REC | 795 | 0.528 | 0.177 | 0.3733 | 0.7469 | -3.609 | 0.000307 | 0.9417 | 0.48805 | 0.44051 | 0.526018 | 62 | 187 | 104 | 127 | 211 | 104 |
| rs12038613 | Imputed | C | REC | 783 | 0.4896 | 0.2003 | 0.3306 | 0.7249 | -3.566 | 0.000363 | 0.9417 | 0.42209 | 0.376791 | 0.458825 | 44 | 175 | 130 | 96 | 206 | 132 |
| rs12151417 | Imputed | T | DOM | 763 | 1.463 | 0.1495 | 1.091 | 1.961 | 2.545 | 0.01093 | 0.7585 | 0.2287 | 0.255814 | 0.206444 | 19 | 138 | 187 | 19 | 135 | 265 |
| rs12153185 | Imputed | T | DOM | 792 | 0.6694 | 0.1472 | 0.5016 | 0.8933 | -2.726 | 0.006403 | 0.6938 | 0.34343 | 0.316901 | 0.364989 | 44 | 137 | 174 | 52 | 215 | 170 |
| rs12182651 | Imputed | T | DOM | 799 | 1.856 | 0.1976 | 1.26 | 2.734 | 3.131 | 0.001743 | 0.8332 | 0.09199 | 0.115169 | 0.073363 | 4 | 74 | 278 | 3 | 59 | 381 |
| rs12235345 | Imputed | C | DOM | 793 | 2.195 | 0.2213 | 1.423 | 3.387 | 3.553 | 0.000382 | 0.3614 | 0.06368 | 0.086402 | 0.045455 | 0 | 61 | 292 | 1 | 38 | 401 |
| rs12324786 | Geno-typed | T | GEN | 793 | | | | | 9.167 | 0.01022 | 0.9062 | 0.18474 | 0.210452 | 0.164009 | 19 | 111 | 224 | 7 | 130 | 302 |
| rs12324786 | Imputed | T | REC | 793 | 3.578 | 0.4502 | 1.481 | 8.646 | 2.832 | 0.004626 | 0.9062 | 0.18474 | 0.210452 | 0.164009 | 19 | 111 | 224 | 7 | 130 | 302 |
| rs12336958 | Imputed | G | DOM | 738 | 1.777 | 0.159 | 1.301 | 2.427 | 3.617 | 0.000298 | 0.2787 | 0.38821 | 0.428135 | 0.356448 | 49 | 182 | 96 | 55 | 183 | 173 |
| rs12407412 | Imputed | C | ADD | 800 | 1.72 | 0.1612 | 1.254 | 2.358 | 3.364 | 0.000769 | 0.04851 | 0.12313 | 0.154062 | 0.098194 | 3 | 104 | 250 | 3 | 81 | 359 |
| rs12407412 | Imputed | C | DOM | 800 | 1.805 | 0.1683 | 1.298 | 2.51 | 3.508 | 0.000451 | 0.04851 | 0.12313 | 0.154062 | 0.098194 | 3 | 104 | 250 | 3 | 81 | 359 |
| rs12418971 | Imputed | C | GEN | 765 | | | | | 9.69 | 0.007866 | 0.1822 | 0.2549 | 0.290698 | 0.225653 | 36 | 128 | 180 | 21 | 148 | 252 |
| rs12418971 | Imputed | C | REC | 765 | 2.279 | 0.2931 | 1.283 | 4.048 | 2.811 | 0.004945 | 0.1822 | 0.2549 | 0.290698 | 0.225653 | 36 | 128 | 180 | 21 | 148 | 252 |
| rs12241967 | Imputed | T | REC | 798 | 0.3933 | 0.2549 | 0.2387 | 0.6482 | -3.661 | 0.000252 | 0.2143 | 0.35088 | 0.308451 | 0.384876 | 23 | 173 | 159 | 67 | 207 | 169 |
| rs12420184 | Imputed | G | DOM | 796 | 0.5503 | 0.165 | 0.3982 | 0.7604 | -3.619 | 0.000295 | 0.5898 | 0.15515 | 0.125 | 0.179545 | 10 | 69 | 277 | 11 | 136 | 293 |
| rs12433968 | Imputed | T | DOM | 762 | 0.5602 | 0.1482 | 0.419 | 0.749 | -3.91 | 9.23e-05 | 0.1676 | 0.29921 | 0.25 | 0.338863 | 20 | 130 | 190 | 40 | 206 | 176 |
| rs12445477 | Imputed | A | DOM | 771 | 0.5609 | 0.2128 | 0.3696 | 0.8512 | -2.717 | 0.006591 | 0.2176 | 0.07847 | 0.058997 | 0.09375 | 1 | 38 | 300 | 1 | 79 | 352 |
| rs12447191 | Geno-typed | T | ADD | 800 | 0.6857 | 0.1355 | 0.5258 | 0.8943 | -2.785 | 0.005354 | 0.8153 | 0.18625 | 0.159664 | 0.207675 | 5 | 104 | 248 | 21 | 142 | 280 |
| rs12447191 | Geno-typed | T | DOM | 800 | 0.7141 | 0.1537 | 0.5284 | 0.9651 | -2.191 | 0.02846 | 0.8153 | 0.18625 | 0.159664 | 0.207675 | 5 | 104 | 248 | 21 | 142 | 280 |
| rs12465349 | Imputed | A | REC | 781 | 1.474 | 0.166 | 1.065 | 2.041 | 2.338 | 0.01938 | 0.3161 | 0.52369 | 0.555085 | 0.497658 | 108 | 177 | 69 | 99 | 227 | 101 |
| rs12247340 | Imputed | C | ADD | 798 | 1.541 | 0.1317 | 1.191 | 1.995 | 3.286 | 0.001016 | 0.1597 | 0.20551 | 0.240169 | 0.177602 | 14 | 143 | 199 | 13 | 131 | 298 |
| rs12247340 | Imputed | C | DOM | 798 | 1.679 | 0.1496 | 1.252 | 2.251 | 3.461 | 0.000538 | 0.1597 | 0.20551 | 0.240169 | 0.177602 | 14 | 143 | 199 | 13 | 131 | 298 |
| rs12247341 | Imputed | C | ADD | 797 | 1.534 | 0.1317 | 1.185 | 1.986 | 3.248 | 0.001161 | 0.1917 | 0.20514 | 0.239437 | 0.177602 | 14 | 142 | 199 | 13 | 131 | 298 |
| rs12247341 | Imputed | C | DOM | 797 | 1.668 | 0.1498 | 1.244 | 2.237 | 3.416 | 0.000635 | 0.1917 | 0.20514 | 0.239437 | 0.177602 | 14 | 142 | 199 | 13 | 131 | 298 |
| rs12247343 | Imputed | C | DOM | 787 | 1.673 | 0.158 | 1.228 | 2.281 | 3.258 | 0.001121 | 0.6121 | 0.169 | 0.2 | 0.144165 | 11 | 118 | 221 | 9 | 108 | 320 |
| rs12509758 | Imputed | C | DOM | 799 | 1.449 | 0.1495 | 1.081 | 1.942 | 2.48 | 0.01313 | 0.5762 | 0.19712 | 0.219101 | 0.179458 | 11 | 134 | 211 | 17 | 125 | 301 |

TABLE 14-continued

| SNP rs # | SOURCE | AL-LELE (A1) | MOD-EL | NMISS | OR | SE | L95 | U95 | STAT | P | HW_PVA_LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs12515472 | Imputed | A | DOM | 799 | 1.337 | 0.1509 | 0.9948 | 1.798 | 1.925 | 0.0542 | 0.6528 | 0.19524 | 0.20927 | 0.183973 | 11 | 127 | 218 | 17 | 129 | 297 |
| rs12548906 | Imputed | G | ADD | 761 | 1.308 | 0.1403 | 0.9936 | 1.722 | 1.914 | 0.05563 | 0.7959 | 0.16886 | 0.188235 | 0.153207 | 14 | 100 | 226 | 6 | 117 | 298 |
| rs12596240 | Imputed | G | DOM | 800 | 0.5814 | 0.1491 | 0.434 | 0.7787 | -3.637 | 0.000275 | 0.824 | 0.3925 | 0.348739 | 0.427765 | 49 | 151 | 157 | 76 | 227 | 140 |
| rs12618781 | Imputed | A | DOM | 792 | 0.6189 | 0.1597 | 0.4526 | 0.8463 | -3.005 | 0.002655 | 0.7209 | 0.46338 | 0.428977 | 0.490909 | 69 | 164 | 119 | 98 | 236 | 106 |
| rs12678600 | Imputed | A | DOM | 800 | 0.6105 | 0.1458 | 0.4588 | 0.8125 | -3.384 | 0.000715 | 0.5684 | 0.31813 | 0.280112 | 0.348758 | 30 | 140 | 187 | 47 | 215 | 181 |
| rs12692229 | Imputed | A | ADD | 795 | 1.248 | 0.1075 | 1.011 | 1.541 | 2.063 | 0.03912 | 0.7574 | 0.35723 | 0.383853 | 0.335973 | 47 | 177 | 129 | 52 | 193 | 197 |
| rs12713324 | Imputed | T | DOM | 779 | 1.464 | 0.1484 | 1.094 | 1.958 | 2.566 | 0.01029 | 0.8375 | 0.22465 | 0.252149 | 0.203226 | 19 | 138 | 192 | 19 | 136 | 275 |
| rs12719415 | Imputed | T | DOM | 800 | 0.6617 | 0.1466 | 0.4964 | 0.882 | -2.816 | 4.86E-03 | 0.8149 | 0.34563 | 0.317927 | 0.367946 | 44 | 139 | 174 | 53 | 220 | 170 |
| rs12820589 | Imputed | G | ADD | 757 | 1.483 | 0.1384 | 1.13 | 1.945 | 2.846 | 0.004422 | 0.07407 | 0.18758 | 0.219298 | 0.161446 | 12 | 126 | 204 | 7 | 120 | 288 |
| rs12820589 | Imputed | G | DOM | 757 | 1.498 | 0.1543 | 1.107 | 2.028 | 2.621 | 0.008774 | 0.07407 | 0.18758 | 0.219298 | 0.161446 | 12 | 126 | 204 | 7 | 120 | 288 |
| rs12831292 | Imputed | G | ADD | 788 | 0.73 | 0.1065 | 0.5925 | 0.8994 | -2.955 | 0.003122 | 0.941 | 0.40102 | 0.362857 | 0.431507 | 51 | 152 | 147 | 75 | 228 | 135 |
| rs12831292 | Imputed | G | DOM | 788 | 0.5953 | 0.1521 | 0.4418 | 0.802 | -3.411 | 0.000647 | 0.941 | 0.40102 | 0.362857 | 0.431507 | 51 | 152 | 147 | 75 | 228 | 135 |
| rs13012636 | Imputed | G | REC | 794 | 1.692 | 0.2617 | 1.013 | 2.827 | 2.01 | 0.04442 | 0.5987 | 0.28149 | 0.291785 | 0.273243 | 37 | 132 | 184 | 29 | 183 | 229 |
| rs13038146 | Imputed | C | ADD | 800 | 1.353 | 0.1061 | 1.099 | 1.666 | 2.854 | 0.004317 | 0.3983 | 0.35938 | 0.39916 | 0.327314 | 64 | 157 | 136 | 45 | 200 | 198 |
| rs13038146 | Imputed | C | GEN | 800 |  |  |  |  | 9.956 | 0.006888 | 0.3983 | 0.35938 | 0.39916 | 0.327314 | 64 | 157 | 136 | 45 | 200 | 198 |
| rs13038146 | Imputed | C | REC | 800 | 1.892 | 0.2107 | 1.252 | 2.859 | 3.026 | 0.002474 | 0.3983 | 0.35938 | 0.39916 | 0.327314 | 64 | 157 | 136 | 45 | 200 | 198 |
| rs13089860 | Imputed | A | DOM | 653 | 0.647 | 0.1731 | 0.4609 | 0.9083 | -2.516 | 0.01188 | 5.01E-07 | 0.49617 | 0.446735 | 0.535912 | 72 | 116 | 103 | 121 | 146 | 95 |
| rs13102419 | Imputed | T | REC | 779 | 1.798 | 0.1756 | 1.274 | 2.536 | 3.339 | 0.000841 | 0.3489 | 0.46213 | 0.494253 | 0.436195 | 96 | 152 | 100 | 77 | 222 | 132 |
| rs13194907 | Imputed | A | ADD | 800 | 1.998 | 0.2096 | 1.325 | 3.013 | 3.302 | 0.00096 | 0.2635 | 0.06938 | 0.092437 | 0.05079 | 4 | 58 | 295 | 2 | 41 | 400 |
| rs13194907 | Imputed | A | DOM | 800 | 2.076 | 0.2229 | 1.341 | 3.213 | 3.276 | 1.05E-03 | 0.2635 | 0.06938 | 0.092437 | 0.05079 | 4 | 58 | 295 | 2 | 41 | 400 |
| rs13195745 | Imputed | A | ADD | 799 | 1.993 | 0.2097 | 1.322 | 3.006 | 3.29 | 0.001001 | 0.2638 | 0.06946 | 0.092437 | 0.050905 | 4 | 58 | 295 | 2 | 41 | 399 |
| rs13195745 | Imputed | A | DOM | 799 | 2.07 | 0.223 | 1.337 | 3.204 | 3.263 | 0.001101 | 0.2638 | 0.06946 | 0.092437 | 0.050905 | 4 | 58 | 295 | 2 | 41 | 399 |
| rs13265054 | Imputed | T | DOM | 798 | 0.6161 | 0.146 | 0.4628 | 0.8202 | -3.318 | 0.000908 | 0.4633 | 0.3183 | 0.281513 | 0.348073 | 30 | 141 | 186 | 46 | 215 | 180 |
| rs13273002 | Imputed | A | GEN | 798 |  |  |  |  | 12.57 | 0.001864 | 0.4182 | 0.22619 | 0.190141 | 0.255079 | 9 | 117 | 229 | 36 | 154 | 253 |
| rs13282131 | Imputed | C | ADD | 797 | 1.33 | 0.1054 | 1.081 | 1.635 | 2.702 | 0.006897 | 0.5189 | 0.44468 | 0.480282 | 0.419683 | 82 | 177 | 96 | 72 | 227 | 143 |
| rs13282131 | Imputed | C | DOM | 797 |  |  |  |  | 7.883 | 0.01942 | 0.5189 | 0.44468 | 0.480282 | 0.419683 | 82 | 177 | 96 | 72 | 227 | 143 |
| rs13282131 | Imputed | C | GEN | 797 |  |  |  |  | 2.583 | 0.009794 | 0.5189 | 0.44468 | 0.480282 | 0.419683 | 82 | 177 | 96 | 72 | 227 | 143 |
| rs13282131 | Imputed | C | REC | 797 | 1.605 | 0.1832 | 1.121 | 2.299 | 15.12 | 0.00052 | 0.2006 | 0.32813 | 0.379552 | 0.286682 | 52 | 167 | 138 | 42 | 170 | 231 |
| rs1330052 | Imputed | G | GEN | 800 |  |  |  |  | -3.566 | 0.000363 | 0.9417 | 0.42209 | 0.376791 | 0.458525 | 44 | 175 | 130 | 96 | 206 | 132 |
| rs1355721 | Imputed | A | REC | 783 | 0.4896 | 0.2003 | 0.3306 | 0.7249 | 3.438 | 0.000587 | 0.8653 | 0.29686 | 0.328652 | 0.271071 | 31 | 172 | 153 | 40 | 158 | 241 |
| rs1336382 | Imputed | T | DOM | 795 | 1.652 | 0.146 | 1.241 | 2.2 | 3.456 | 0.000547 | 0.9326 | 0.29688 | 0.329132 | 0.27088 | 31 | 173 | 155 | 40 | 160 | 243 |
| rs1336383 | Imputed | T | DOM | 800 | 1.654 | 0.1456 | 1.243 | 2.152 | 3.335 | 0.000854 | 0.9322 | 0.29313 | 0.32493 | 0.267494 | 30 | 172 | 155 | 38 | 161 | 244 |
| rs1336407 | Imputed | T | DOM | 800 | 1.62 | 0.1448 | 1.22 | 2.152 | 3.335 | 0.000854 | 0.9322 | 0.29313 | 0.32493 | 0.267494 | 30 | 172 | 155 | 38 | 161 | 244 |
| rs1336409 | Imputed | T | DOM | 800 | 1.62 | 0.1448 | 1.22 | 2.152 | 3.335 | 0.000854 | 0.9322 | 0.29313 | 0.32493 | 0.267494 | 30 | 172 | 155 | 38 | 161 | 244 |
| rs1336596 | Imputed | A | DOM | 796 | 0.5452 | 0.1487 | 0.4073 | 0.7298 | -4.078 | 4.54E-05 | 0.3514 | 0.35239 | 0.312676 | 0.384354 | 45 | 132 | 178 | 60 | 219 | 162 |
| rs13387284 | Imputed | A | DOM | 760 | 0.6185 | 0.1611 | 0.451 | 0.8482 | -2.982 | 0.002863 | 0.8837 | 0.45526 | 0.420588 | 0.483333 | 65 | 156 | 119 | 91 | 224 | 105 |
| rs13401462 | Imputed | C | DOM | 760 | 1.748 | 0.1697 | 1.254 | 2.438 | 3.292 | 0.000996 | 0.7164 | 0.47632 | 0.507396 | 0.451422 | 79 | 185 | 74 | 96 | 189 | 137 |
| rs13409045 | Imputed | T | ADD | 792 | 0.7208 | 0.1088 | 0.5824 | 0.8921 | -3.01 | 0.002612 | 0.5973 | 0.37942 | 0.338983 | 0.4121 | 40 | 160 | 154 | 70 | 221 | 147 |
| rs1349284 | Imputed | C | GEN | 800 |  |  |  |  | 9.296 | 0.009578 | 0.7594 | 0.36125 | 0.397759 | 0.331828 | 60 | 164 | 133 | 42 | 210 | 191 |
| rs1355715 | Imputed | T | ADD | 800 | 0.4791 | 0.2123 | 0.316 | 0.7263 | -3.467 | 0.000527 | 0.6107 | 0.07375 | 0.047619 | 0.094808 | 1 | 32 | 324 | 4 | 76 | 363 |
| rs1357696 | Imputed | A | GEN | 782 |  |  |  |  | 10.92 | 0.004251 | 0.5414 | 0.37404 | 0.411932 | 0.343023 | 63 | 164 | 125 | 42 | 211 | 177 |
| rs1357698 | Imputed | A | GEN | 781 |  |  |  |  | 11.09 | 0.003915 | 0.5411 | 0.37452 | 0.413105 | 0.343023 | 63 | 164 | 124 | 42 | 211 | 177 |
| rs1357699 | Imputed | T | GEN | 781 |  |  |  |  | 11.09 | 0.003915 | 0.5411 | 0.37452 | 0.413105 | 0.343023 | 63 | 164 | 124 | 42 | 211 | 177 |
| rs1363273 | Imputed | C | REC | 780 | 0.5424 | 0.1801 | 0.3811 | 0.772 | -3.397 | 0.000682 | 0.5195 | 0.48397 | 0.448276 | 0.512731 | 60 | 192 | 96 | 118 | 207 | 107 |
| rs1373601 | Imputed | A | DOM | 731 | 0.6665 | 0.1502 | 0.4966 | 0.8946 | -2.702 | 0.006895 | 0.3096 | 0.32216 | 0.286585 | 0.351117 | 32 | 124 | 172 | 50 | 183 | 170 |
| rs1375829 | Imputed | C | GEN | 800 |  |  |  |  | 9.296 | 0.009578 | 0.7594 | 0.36125 | 0.397759 | 0.331828 | 60 | 164 | 133 | 42 | 210 | 191 |
| rs1395748 | Imputed | G | DOM | 800 | 0.6151 | 0.1445 | 0.4634 | 0.8164 | -3.364 | 0.000769 | 0.5437 | 0.285 | 0.239496 | 0.32167 | 19 | 133 | 205 | 42 | 201 | 200 |

TABLE 14-continued

| SNP rs # | SOURCE | AL-LELE (A1) | MODEL | NMISS | OR | SE | L95 | U95 | STAT | P | HW_PVALUE | AL-LELE FREQ | PRA-VA_AL-LELE FREQ | PLA-CEBO_AL-LELE FREQ | PRA-VA_A1_HZ_COUNT | PRA-VA_HET_COUNT | PRA-VA_A2_HZ_COUNT | PLA-CEBO_A1_HZ_COUNT | PLA-CEBO_HET_COUNT | PLA-CEBO_A2_HZ_COUNT |
|---|---|---|---|---|---|---|---|---|---|---|---|---|---|---|---|---|---|---|---|---|
| rs1414865 | Imputed | T | DOM | 800 | 1.634 | 0.1456 | 1.228 | 2.173 | 3.373 | 0.000745 | 1 | 0.29688 | 0.330532 | 0.269752 | 32 | 172 | 153 | 38 | 163 | 242 |
| rs1414873 | Imputed | A | DOM | 800 | 1.62 | 0.1448 | 1.22 | 2.152 | 3.335 | 0.000854 | 0.9322 | 0.29313 | 0.32493 | 0.267494 | 30 | 172 | 155 | 38 | 161 | 244 |
| rs1414876 | Imputed | C | DOM | 800 | 1.62 | 0.1448 | 1.22 | 2.152 | 3.335 | 0.000854 | 0.9322 | 0.29313 | 0.32493 | 0.267494 | 30 | 172 | 155 | 38 | 161 | 244 |
| rs1424643 | Imputed | G | ADD | 778 | 1.348 | 0.1253 | 1.054 | 1.723 | 2.38 | 0.0173 | 0.538 | 0.22494 | 0.252857 | 0.202103 | 18 | 141 | 191 | 18 | 137 | 273 |
| rs1424643 | Imputed | G | DOM | 778 | 1.485 | 0.149 | 1.109 | 1.988 | 2.654 | 0.007946 | 0.538 | 0.22494 | 0.252857 | 0.202103 | 18 | 141 | 191 | 18 | 137 | 273 |
| rs1424648 | Imputed | T | DOM | 784 | 1.357 | 0.1474 | 1.017 | 1.812 | 2.073 | 0.03819 | 0.4118 | 0.22449 | 0.248563 | 0.205275 | 18 | 137 | 193 | 17 | 145 | 274 |
| rs1429321 | Imputed | A | DOM | 797 | 1.456 | 0.1473 | 1.091 | 1.943 | 2.549 | 0.01079 | 0.838 | 0.22208 | 0.2493 | 0.2 | 19 | 140 | 198 | 19 | 138 | 283 |
| rs1429326 | Imputed | T | ADD | 792 | 1.336 | 0.1238 | 1.048 | 1.702 | 2.338 | 0.01941 | 0.8363 | 0.22033 | 0.247887 | 0.197941 | 18 | 140 | 197 | 19 | 135 | 283 |
| rs1429326 | Imputed | T | DOM | 792 | 1.48 | 0.1477 | 1.108 | 1.977 | 2.653 | 0.007971 | 0.8363 | 0.22033 | 0.247887 | 0.197941 | 18 | 140 | 197 | 19 | 135 | 283 |
| rs1444741 | Imputed | A | DOM | 728 | 0.6595 | 0.1504 | 0.4911 | 0.8857 | −2.767 | 0.005653 | 0.3937 | 0.31868 | 0.282875 | 0.34788 | 31 | 123 | 173 | 48 | 183 | 170 |
| rs1449916 | Imputed | C | DOM | 588 | 0.5892 | 0.1909 | 0.4052 | 0.8566 | −2.771 | 0.005596 | 0.7419 | 0.4915 | 0.450368 | 0.526899 | 59 | 127 | 86 | 85 | 163 | 68 |
| rs1459523 | Imputed | A | ADD | 800 | 1.366 | 0.1079 | 1.105 | 1.688 | 2.889 | 0.00386 | 0.6465 | 0.36313 | 0.403361 | 0.3307 | 60 | 168 | 129 | 42 | 209 | 192 |
| rs1459523 | Imputed | A | GEN | 800 | | | | | 9.972 | 0.006832 | 0.6465 | 0.36313 | 0.403361 | 0.3307 | 60 | 168 | 129 | 42 | 209 | 192 |
| rs1466352 | Imputed | T | GEN | 797 | | | | | 9.958 | 0.00688 | 0.821 | 0.37641 | 0.412676 | 0.347285 | 65 | 163 | 127 | 46 | 215 | 181 |
| rs1466353 | Imputed | G | GEN | 796 | | | | | 10.02 | 0.006658 | 0.8212 | 0.37626 | 0.412429 | 0.347285 | 65 | 162 | 127 | 46 | 215 | 181 |
| rs1476714 | Imputed | A | DOM | 797 | 0.6618 | 0.1469 | 0.4962 | 0.8826 | −2.81 | 0.004959 | 0.8142 | 0.34567 | 0.31831 | 0.367647 | 44 | 138 | 173 | 53 | 219 | 170 |
| rs1486723 | Imputed | C | REC | 800 | 0.4458 | 0.2394 | 0.2789 | 0.7127 | −3.375 | 0.000739 | 0.8155 | 0.3475 | 0.315126 | 0.373589 | 28 | 169 | 160 | 70 | 191 | 182 |
| rs1495375 | Imputed | A | ADD | 793 | 0.741 | 0.1058 | 0.6022 | 0.9117 | −2.834 | 0.0046 | 0.941 | 0.40038 | 0.364789 | 0.429224 | 52 | 155 | 148 | 74 | 228 | 136 |
| rs1495375 | Imputed | A | DOM | 793 | 0.6085 | 0.1511 | 0.4525 | 0.8182 | −3.288 | 0.00101 | 0.941 | 0.40038 | 0.364789 | 0.429224 | 52 | 155 | 148 | 74 | 228 | 136 |
| rs1495381 | Imputed | T | GEN | 799 | | | | | 8.222 | 0.01639 | 0.2696 | 0.40175 | 0.431373 | 0.377828 | 69 | 170 | 118 | 52 | 230 | 160 |
| rs1498061 | Imputed | C | REC | 385 | 1.776 | 0.2004 | 1.199 | 2.631 | 2.867 | 0.004141 | 0.07449 | 0.1961 | 0.144118 | 0.237209 | 3 | 43 | 124 | 6 | 90 | 119 |
| rs1498992 | Imputed | G | ADD | 795 | 0.4939 | 0.2066 | 0.3294 | 0.7405 | −3.414 | 0.00064 | 0.571 | 0.3239 | 0.280282 | 0.359091 | 33 | 133 | 189 | 54 | 208 | 178 |
| rs1499001 | Imputed | T | DOM | 763 | 0.5981 | 0.1449 | 0.4502 | 0.7944 | −3.549 | 0.000387 | 0.5785 | 0.26606 | 0.218475 | 0.304502 | 18 | 113 | 210 | 39 | 179 | 204 |
| rs1512988 | Imputed | A | ADD | 795 | 0.5667 | 0.1498 | 0.4225 | 0.76 | −3.793 | 0.000149 | 1 | 0.39371 | 0.355932 | 0.424036 | 49 | 154 | 151 | 74 | 226 | 141 |
| rs1512988 | Imputed | A | DOM | 795 | 0.7274 | 0.1066 | 0.5903 | 0.8964 | −2.987 | 0.002819 | 1 | 0.39371 | 0.355932 | 0.424036 | 49 | 154 | 151 | 74 | 226 | 141 |
| rs1512989 | Imputed | A | ADD | 795 | 0.6077 | 0.151 | 0.452 | 0.817 | −3.298 | 0.000973 | 1 | 0.39371 | 0.355932 | 0.424036 | 49 | 154 | 151 | 74 | 226 | 141 |
| rs1512989 | Imputed | A | DOM | 795 | 0.7274 | 0.1066 | 0.5903 | 0.8964 | −2.987 | 0.002819 | 1 | 0.39371 | 0.355932 | 0.424036 | 49 | 154 | 151 | 74 | 226 | 141 |
| rs1512991 | Imputed | T | ADD | 795 | 0.6077 | 0.151 | 0.452 | 0.817 | −3.298 | 0.000973 | 0.4324 | 0.46101 | 0.421127 | 0.493182 | 63 | 173 | 119 | 100 | 234 | 106 |
| rs1512991 | Imputed | T | DOM | 795 | 0.7286 | 0.1054 | 0.5926 | 0.8957 | −3.005 | 0.002655 | 0.4324 | 0.46101 | 0.421127 | 0.493182 | 63 | 173 | 119 | 100 | 234 | 106 |
| rs1512991 | Imputed | T | GEN | 795 | | | | | 9.858 | 0.007235 | 0.4324 | 0.46101 | 0.421127 | 0.493182 | 63 | 173 | 119 | 100 | 234 | 106 |
| rs1524303 | Imputed | T | ADD | 793 | 0.6184 | 0.1596 | 0.4523 | 0.8456 | −3.011 | 0.002605 | 0.7608 | 0.36948 | 0.407303 | 0.338673 | 62 | 166 | 128 | 44 | 208 | 185 |
| rs1524306 | Imputed | C | ADD | 800 | 1.366 | 0.1079 | 1.105 | 1.688 | 2.889 | 0.00386 | 0.6465 | 0.36313 | 0.403361 | 0.3307 | 60 | 168 | 129 | 42 | 209 | 192 |
| rs1524310 | Imputed | G | GEN | 800 | | | | | 9.972 | 0.006832 | 0.6465 | 0.36313 | 0.403361 | 0.3307 | 60 | 168 | 129 | 42 | 209 | 192 |
| rs1524310 | Imputed | G | ADD | 800 | 1.366 | 0.1079 | 1.105 | 1.688 | 2.889 | 0.00386 | 0.6465 | 0.36313 | 0.403361 | 0.3307 | 60 | 168 | 129 | 42 | 209 | 192 |
| rs1524321 | Imputed | C | GEN | 796 | | | | | 10.02 | 0.006673 | 0.8212 | 0.37629 | 0.412429 | 0.347285 | 65 | 162 | 127 | 46 | 209 | 181 |
| rs1527059 | Imputed | A | DOM | 799 | 0.5689 | 0.2041 | 0.3813 | 0.8488 | −2.763 | 0.005727 | 0.3612 | 0.08573 | 0.067410 | 0.100451 | 5 | 38 | 313 | 3 | 83 | 357 |
| rs152707 | Imputed | A | ADD | 800 | 0.684 | 0.1058 | 0.5559 | 0.8415 | −3.592 | 0.000328 | 0.6633 | 0.42063 | 0.372549 | 0.459368 | 45 | 176 | 136 | 93 | 221 | 129 |
| rs152707 | Imputed | A | DOM | 800 | | | | | −3.005 | 0.001266 | 0.6633 | 0.42063 | 0.372549 | 0.459368 | 45 | 176 | 136 | 93 | 221 | 129 |
| rs152712 | Genotyped | C | ADD | 799 | 0.6783 | 0.106 | 0.5511 | 0.8349 | −3.663 | 0.00025 | 0.5157 | 0.42553 | 0.376751 | 0.464932 | 45 | 179 | 133 | 95 | 221 | 126 |
| rs152712 | Genotyped | C | GEN | 799 | | | | | 14.09 | 0.00087 | 0.5157 | 0.42553 | 0.376751 | 0.464932 | 45 | 179 | 133 | 95 | 221 | 126 |
| rs1533994 | Imputed | T | GEN | 799 | | | | | 10.31 | 0.005765 | 0.763 | 0.37484 | 0.411765 | 0.345023 | 65 | 164 | 128 | 45 | 215 | 182 |
| rs1535866 | Imputed | G | DOM | 793 | 1.391 | 0.148 | 1.041 | 1.86 | 2.232 | 0.02564 | 0.9166 | 0.21564 | 0.239437 | 0.196347 | 18 | 134 | 203 | 18 | 136 | 284 |

TABLE 14-continued

| SNP rs # | SOURCE | AL-LELE (A1) | MOD-EL | NMISS | OR | SE | L95 | U95 | STAT | P | HW_PVALUE | AL-LELE FREQ | PRA-VA_AL-LELE FREQ | PLA-CEBO_AL-LELE FREQ | PRA-VA_A1_HZ_COUNT | PRA-VA_HET_COUNT | PRA-VA_A2_HZ_COUNT | PLA-CEBO_A1_HZ_COUNT | PLA-CEBO_HET_COUNT | PLA-CEBO_A2_HZ_COUNT |
|---|---|---|---|---|---|---|---|---|---|---|---|---|---|---|---|---|---|---|---|---|
| rs1563773 | Imputed | T | GEN | 798 | | | | | 10.17 | 0.006179 | 0.7628 | 0.37531 | 0.411765 | 0.343805 | 65 | 164 | 128 | 45 | 215 | 181 |
| rs1563774 | Imputed | T | GEN | 794 | | | | | 9.994 | 0.006759 | 0.5981 | 0.37846 | 0.414326 | 0.349315 | 65 | 165 | 126 | 45 | 216 | 177 |
| rs1567740 | Imputed | T | ADD | 796 | 0.7274 | 0.1063 | 0.5906 | 0.896 | −2.993 | 0.002762 | 0.9411 | 0.39573 | 0.358146 | 0.426136 | 50 | 155 | 151 | 74 | 227 | 139 |
| rs1567740 | Imputed | T | DOM | 796 | 0.6032 | 0.1509 | 0.4488 | 0.8108 | −3.35 | 0.000809 | 0.9411 | 0.39573 | 0.358146 | 0.426136 | 50 | 155 | 151 | 74 | 227 | 139 |
| rs1572573 | Imputed | A | DOM | 770 | 1.748 | 0.1541 | 1.292 | 2.365 | 3.624 | 0.00029 | 0.5616 | 0.19221 | 0.22929 | 0.163194 | 15 | 125 | 198 | 16 | 109 | 307 |
| rs1577497 | Imputed | C | REC | 786 | 0.4912 | 0.2002 | 0.3317 | 0.7272 | −3.551 | 0.000384 | 0.9417 | 0.42112 | 0.377143 | 0.456422 | 44 | 176 | 130 | 96 | 206 | 134 |
| rs1581514 | Imputed | T | ADD | 795 | 1.353 | 0.108 | 1.095 | 1.671 | 2.797 | 0.005152 | 0.5417 | 0.36541 | 0.403361 | 0.334475 | 60 | 168 | 129 | 42 | 209 | 187 |
| rs1581514 | Imputed | T | GEN | 795 | | | | | 9.607 | 0.008202 | 0.5417 | 0.36541 | 0.403361 | 0.334475 | 60 | 168 | 129 | 42 | 209 | 187 |
| rs1582321 | Imputed | T | DOM | 800 | 0.5814 | 0.1491 | 0.434 | 0.7787 | −3.637 | 0.000275 | 0.824 | 0.3925 | 0.348739 | 0.427765 | 49 | 151 | 157 | 76 | 227 | 140 |
| rs1582322 | Imputed | A | DOM | 799 | 0.5859 | 0.1493 | 0.4373 | 0.785 | −3.581 | 0.000342 | 0.824 | 0.39299 | 0.351124 | 0.426637 | 50 | 150 | 156 | 75 | 228 | 140 |
| rs1582323 | Imputed | A | DOM | 798 | 0.5825 | 0.1494 | 0.4346 | 0.7807 | −3.617 | 0.000298 | 0.8238 | 0.39286 | 0.350704 | 0.426637 | 50 | 149 | 156 | 75 | 228 | 140 |
| rs1592485 | Imputed | C | DOM | 799 | 0.5835 | 0.15 | 0.4349 | 0.7829 | −3.592 | 0.000328 | 0.5061 | 0.39737 | 0.355742 | 0.430995 | 53 | 148 | 156 | 78 | 225 | 139 |
| rs1600954 | Imputed | T | ADD | 759 | 1.379 | 0.106 | 1.12 | 1.697 | 3.029 | 0.002457 | 0.8845 | 0.48748 | 0.531343 | 0.45283 | 87 | 182 | 66 | 92 | 200 | 132 |
| rs1600954 | Imputed | T | GEN | 759 | | | | | 11.97 | 0.002519 | 0.8845 | 0.48748 | 0.531343 | 0.45283 | 87 | 182 | 66 | 92 | 200 | 132 |
| rs6938626 | Imputed | G | DOM | 797 | 0.612 | 0.1451 | 0.4605 | 0.8132 | −3.385 | 0.000711 | 1 | 0.28043 | 0.24507 | 0.308824 | 26 | 122 | 207 | 36 | 201 | 205 |
| rs6964300 | Imputed | G | ADD | 800 | 0.6771 | 0.135 | 0.5197 | 0.8821 | −2.889 | 0.003862 | 0.9076 | 0.1875 | 0.159664 | 0.209932 | 5 | 104 | 248 | 22 | 142 | 279 |
| rs6964300 | Imputed | G | DOM | 800 | 0.7073 | 0.1536 | 0.5234 | 0.9558 | −2.254 | 0.02418 | 0.9076 | 0.1875 | 0.159664 | 0.209932 | 5 | 104 | 248 | 22 | 142 | 279 |
| rs6986282 | Imputed | G | DOM | 800 | 0.3124 | 0.3551 | 0.1558 | 0.6267 | −3.276 | 0.001053 | 0.5896 | 0.03313 | 0.016807 | 0.046275 | 1 | 10 | 346 | 0 | 41 | 402 |
| rs7007620 | Imputed | G | ADD | 696 | 1.421 | 0.1303 | 1.101 | 1.834 | 2.696 | 0.007027 | 0.8349 | 0.23922 | 0.269868 | 0.215736 | 20 | 123 | 159 | 21 | 128 | 245 |
| rs7007620 | Imputed | G | DOM | 696 | 1.572 | 0.1588 | 1.152 | 2.146 | 2.85 | 0.004376 | 0.8349 | 0.23922 | 0.269868 | 0.215736 | 20 | 123 | 159 | 21 | 128 | 245 |
| rs7014326 | Imputed | T | DOM | 794 | 0.5837 | 0.145 | 0.4393 | 0.7755 | −3.713 | 0.000205 | 0.7323 | 0.29408 | 0.246479 | 0.332574 | 22 | 131 | 202 | 44 | 204 | 191 |
| rs7047957 | Imputed | C | DOM | 785 | 1.47 | 0.1535 | 1.088 | 1.986 | 2.51 | 0.01207 | 0.6344 | 0.1828 | 0.203704 | 0.165899 | 10 | 123 | 218 | 18 | 108 | 308 |
| rs705261 | Imputed | A | REC | 798 | 1.775 | 0.1989 | 1.202 | 2.622 | 2.885 | 0.003908 | 0.3391 | 0.40351 | 0.435393 | 0.377828 | 70 | 170 | 116 | 53 | 228 | 161 |
| rs7073341 | Imputed | A | ADD | 800 | 2.568 | 0.2635 | 1.532 | 4.305 | 3.58 | 0.000344 | 1 | 0.04375 | 0.064426 | 0.027088 | 1 | 44 | 312 | 0 | 24 | 419 |
| rs7073341 | Imputed | A | DOM | 800 | 2.569 | 0.2659 | 1.525 | 4.326 | 3.548 | 0.000388 | 1 | 0.04375 | 0.064426 | 0.027088 | 1 | 44 | 312 | 0 | 24 | 419 |
| rs7138702 | Imputed | G | ADD | 797 | 0.5527 | 0.1573 | 0.406 | 0.7522 | −3.77 | 0.000163 | 0.3509 | 0.13174 | 0.095506 | 0.160998 | 2 | 64 | 290 | 15 | 112 | 314 |
| rs7189710 | Imputed | G | ADD | 795 | 1.359 | 0.1063 | 1.103 | 1.673 | 2.882 | 0.003957 | 0.3973 | 0.36038 | 0.40113 | 0.327664 | 64 | 156 | 134 | 45 | 199 | 197 |
| rs7189710 | Imputed | G | GEN | 795 | | | | | 10.06 | 0.006549 | 0.3973 | 0.36038 | 0.40113 | 0.327664 | 64 | 156 | 134 | 45 | 199 | 197 |
| rs7189710 | Imputed | G | REC | 795 | 1.896 | 0.2108 | 1.254 | 2.866 | 3.034 | 0.002411 | 0.3973 | 0.36038 | 0.40113 | 0.327664 | 64 | 156 | 134 | 45 | 199 | 197 |
| rs7310176 | Imputed | T | ADD | 800 | 0.6381 | 0.1364 | 0.4884 | 0.8336 | −3.294 | 0.000988 | 0.22 | 0.17375 | 0.138655 | 0.202032 | 10 | 79 | 268 | 19 | 141 | 283 |
| rs7310176 | Imputed | T | DOM | 800 | 0.5794 | 0.1584 | 0.4248 | 0.7903 | −3.446 | 0.00057 | 0.22 | 0.17375 | 0.138655 | 0.202032 | 10 | 79 | 268 | 19 | 141 | 283 |
| rs7358860 | Imputed | A | DOM | 752 | 0.6291 | 0.1568 | 0.4626 | 0.8555 | −2.955 | 0.003129 | 0.2583 | 0.17 | 0.140056 | 0.194131 | 6 | 88 | 263 | 12 | 148 | 283 |
| rs7370541 | Imputed | T | GEN | 794 | | | | | 13.88 | 0.000967 | 0.5911 | 0.37434 | 0.426647 | 0.332536 | 67 | 151 | 116 | 45 | 188 | 185 |
| rs7370541 | Imputed | T | REC | 752 | 2.075 | 0.2103 | 1.374 | 3.133 | 3.469 | 0.000522 | 0.3116 | 0.37434 | 0.426647 | 0.332536 | 67 | 151 | 116 | 45 | 188 | 185 |
| rs7526574 | Imputed | G | GEN | 800 | | | | | 11.97 | 0.002516 | 0.2278 | 0.28875 | 0.333333 | 0.252822 | 43 | 152 | 162 | 31 | 162 | 250 |
| rs7530747 | Imputed | T | DOM | 797 | 0.5794 | 0.1476 | 0.4338 | 0.7738 | −3.698 | 0.000218 | 0.9395 | 0.36951 | 0.320225 | 0.409297 | 39 | 150 | 167 | 69 | 223 | 149 |
| rs7649114 | Imputed | C | ADD | 800 | 1.543 | 0.1498 | 1.151 | 2.07 | 2.898 | 0.003762 | 0.5766 | 0.19625 | 0.22249 | 0.173815 | 13 | 134 | 210 | 15 | 124 | 304 |
| rs7766172 | Imputed | A | REC | 770 | 0.3869 | 0.2703 | 0.2278 | 0.6573 | −3.512 | 0.000444 | 0.3748 | 0.33571 | 0.324047 | 0.344988 | 20 | 181 | 140 | 61 | 174 | 194 |
| rs1818885 | Imputed | G | GEN | 794 | | | | | 10.03 | 0.006649 | 0.5911 | 0.36146 | 0.400568 | 0.330317 | 59 | 164 | 129 | 41 | 210 | 191 |
| rs1832222 | Imputed | G | DOM | 799 | 1.612 | 0.1449 | 1.214 | 2.142 | 3.295 | 0.000984 | 0.9321 | 0.29349 | 0.32493 | 0.2681 | 30 | 172 | 155 | 38 | 161 | 243 |
| rs1861327 | Imputed | G | DOM | 800 | 0.5814 | 0.1491 | 0.434 | 0.7787 | −3.637 | 0.000275 | 0.824 | 0.3925 | 0.348739 | 0.427765 | 49 | 151 | 157 | 76 | 227 | 140 |
| rs1868581 | Imputed | G | ADD | 800 | 1.366 | 0.1079 | 1.105 | 1.688 | 2.889 | 0.00386 | 0.6465 | 0.36313 | 0.403361 | 0.3307 | 60 | 168 | 129 | 42 | 209 | 192 |
| rs1868581 | Imputed | G | GEN | 800 | | | | | 9.972 | 0.006832 | 0.6465 | 0.36313 | 0.403361 | 0.3307 | 60 | 168 | 129 | 42 | 209 | 192 |
| rs1874313 | Imputed | A | ADD | 797 | 0.7419 | 0.1059 | 0.6029 | 0.913 | −2.819 | 0.004818 | 0.8824 | 0.3946 | 0.359155 | 0.423077 | 51 | 153 | 151 | 74 | 226 | 142 |
| rs1874313 | Imputed | A | DOM | 797 | 0.615 | 0.1508 | 0.4577 | 0.8265 | −3.224 | 0.001263 | 0.8824 | 0.3946 | 0.359155 | 0.423077 | 51 | 153 | 151 | 74 | 226 | 142 |
| rs1876409 | Imputed | C | DOM | 800 | 0.6151 | 0.1445 | 0.4634 | 0.8164 | −3.364 | 0.000769 | 0.5437 | 0.285 | 0.239496 | 0.32167 | 19 | 133 | 205 | 42 | 201 | 200 |

TABLE 14-continued

| SNP rs # | SOURCE | AL-LELE (A1) | MOD-EL | NMISS | OR | SE | L95 | U95 | STAT | P | HW_PVA_LUE | AL-LELE_FREQ | PRA-VA_AL-LELE_FREQ | PLA-CEBO_AL-LELE_FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs1913201 | Imputed | G | ADD | 771 | 0.7218 | 0.1078 | 0.5844 | 0.8916 | -3.025 | 0.002485 | 0.3076 | 0.44617 | 0.405523 | 0.478923 | 54 | 171 | 119 | 92 | 225 | 110 |
| rs1913201 | Imputed | G | DOM | 771 | 0.6464 | 0.1598 | 0.4726 | 0.8841 | -2.731 | 0.006318 | 0.3076 | 0.44617 | 0.405523 | 0.478923 | 54 | 171 | 119 | 92 | 225 | 110 |
| rs1913201 | Imputed | G | GEN | 771 | | | | | 9.268 | 0.009717 | 0.3076 | 0.44617 | 0.405523 | 0.478923 | 54 | 171 | 119 | 92 | 225 | 110 |
| rs1916922 | Imputed | T | GEN | 800 | | | | | 9.972 | 0.006832 | 0.6465 | 0.36313 | 0.403361 | 0.3307 | 60 | 168 | 129 | 42 | 209 | 192 |
| rs1936871 | Geno-typed | G | DOM | 800 | 0.571 | 0.1536 | 0.4226 | 0.7716 | -3.647 | 0.000265 | 0.6638 | 0.42188 | 0.394958 | 0.443567 | 67 | 148 | 142 | 72 | 249 | 122 |
| rs1961157 | Imputed | T | REC | 800 | 0.6068 | 0.1891 | 0.4189 | 0.8791 | -2.642 | 0.00825 | 0.6171 | 0.45 | 0.413165 | 0.479684 | 55 | 185 | 117 | 103 | 219 | 121 |
| rs1987179 | Imputed | T | ADD | 800 | 0.7138 | 0.1326 | 0.5504 | 0.9257 | -2.542 | 0.01103 | 0.03097 | 0.20625 | 0.179272 | 0.227991 | 10 | 108 | 239 | 14 | 174 | 255 |
| rs1987179 | Imputed | T | DOM | 800 | 0.6634 | 0.1489 | 0.4955 | 0.8883 | -2.756 | 0.005859 | 0.03097 | 0.20625 | 0.179272 | 0.227991 | 10 | 108 | 239 | 14 | 174 | 255 |
| rs1990023 | Imputed | T | DOM | 798 | 0.6462 | 0.1462 | 0.4852 | 0.8606 | -2.987 | 0.002819 | 0.754 | 0.34336 | 0.314607 | 0.366516 | 44 | 136 | 176 | 52 | 220 | 170 |
| rs1995025 | Imputed | C | DOM | 775 | 1.608 | 0.1638 | 1.167 | 2.217 | 2.901 | 0.003714 | 0.4655 | 0.14323 | 0.17192 | 0.119718 | 8 | 104 | 237 | 5 | 92 | 329 |
| rs2016194 | Imputed | G | DOM | 799 | 0.6626 | 0.1466 | 0.4971 | 0.8832 | -2.807 | 0.004996 | 0.8145 | 0.34543 | 0.317927 | 0.367647 | 44 | 139 | 174 | 53 | 219 | 170 |
| rs2023651 | Imputed | T | DOM | 797 | 0.682 | 0.1247 | 0.5341 | 0.8707 | -3.07 | 0.002139 | 0.1305 | 0.22773 | 0.191011 | 0.25737 | 14 | 108 | 234 | 35 | 157 | 249 |
| rs2024902 | Imputed | A | ADD | 800 | 1.998 | 0.2096 | 1.325 | 3.013 | 3.302 | 0.00096 | 0.2635 | 0.06938 | 0.092437 | 0.05079 | 4 | 58 | 295 | 2 | 41 | 400 |
| rs2024902 | Imputed | A | DOM | 800 | 2.076 | 0.2229 | 1.341 | 3.213 | 3.276 | 0.001053 | 0.2635 | 0.06938 | 0.092437 | 0.05079 | 4 | 58 | 295 | 2 | 41 | 400 |
| rs2025107 | Imputed | A | DOM | 799 | 1.856 | 0.1976 | 1.26 | 2.734 | 3.131 | 0.001743 | 0.8332 | 0.09199 | 0.115169 | 0.073363 | 4 | 74 | 278 | 3 | 59 | 381 |
| rs2025108 | Imputed | T | DOM | 799 | 1.856 | 0.1976 | 1.26 | 2.734 | 3.131 | 0.001743 | 0.8332 | 0.09199 | 0.115169 | 0.073363 | 4 | 74 | 278 | 3 | 59 | 381 |
| rs2031987 | Imputed | T | GEN | 795 | | | | | 12.3 | 0.002134 | 0.2253 | 0.28616 | 0.331461 | 0.249431 | 42 | 152 | 162 | 30 | 159 | 250 |
| rs2052428 | Imputed | C | ADD | 784 | 0.5903 | 0.1642 | 0.4279 | 0.8144 | -3.21 | 0.001327 | 0.0995 | 0.46939 | 0.431818 | 0.5 | 67 | 170 | 115 | 94 | 244 | 94 |
| rs2053230 | Imputed | C | DOM | 722 | 0.5414 | 0.1548 | 0.3998 | 0.7333 | -3.964 | 7.36E-05 | 4.60E-06 | 0.18767 | 0.145511 | 0.221805 | 1 | 92 | 230 | 7 | 163 | 229 |
| rs2062448 | Imputed | T | DOM | 788 | 0.5462 | 0.1963 | 0.3718 | 0.8024 | -3.081 | 0.00206 | 0.1524 | 0.09708 | 0.072443 | 0.116972 | 4 | 43 | 305 | 7 | 88 | 341 |
| rs2063420 | Imputed | C | REC | 780 | 1.755 | 0.1868 | 1.217 | 2.531 | 3.01 | 0.002608 | 0.8266 | 0.43013 | 0.464183 | 0.402552 | 81 | 162 | 106 | 65 | 217 | 149 |
| rs2063591 | Imputed | C | ADD | 797 | 0.7519 | 0.1046 | 0.6125 | 0.9229 | -2.727 | 0.006392 | 0.5698 | 0.47177 | 0.435211 | 0.501131 | 69 | 171 | 115 | 104 | 235 | 103 |
| rs2063591 | Imputed | C | DOM | 797 | 0.6237 | 0.1609 | 0.4551 | 0.855 | -2.934 | 0.003349 | 0.5698 | 0.47177 | 0.435211 | 0.501131 | 69 | 171 | 115 | 104 | 235 | 103 |
| rs208026 | Geno-typed | A | DOM | 800 | 1.457 | 0.1466 | 1.093 | 1.941 | 2.565 | 0.01032 | 0.8428 | 0.23188 | 0.259104 | 0.209932 | 21 | 143 | 193 | 23 | 140 | 280 |
| rs208029 | Imputed | T | DOM | 786 | 1.41 | 0.1496 | 1.052 | 1.891 | 2.298 | 0.02157 | 0.9177 | 0.22137 | 0.242165 | 0.204598 | 17 | 136 | 198 | 22 | 134 | 279 |
| rs208757 | Imputed | G | DOM | 799 | 1.423 | 0.1463 | 1.068 | 1.895 | 2.411 | 0.01592 | 0.4251 | 0.22966 | 0.256303 | 0.208145 | 23 | 137 | 197 | 23 | 138 | 281 |
| rs2095586 | Imputed | A | DOM | 785 | 1.655 | 0.1465 | 1.242 | 2.205 | 3.438 | 0.000586 | 0.8644 | 0.29745 | 0.331412 | 0.270548 | 30 | 170 | 147 | 38 | 161 | 239 |
| rs2095606 | Imputed | A | DOM | 786 | 0.5466 | 0.1493 | 0.4079 | 0.7324 | -4.046 | 5.20E-05 | 0.8151 | 0.35242 | 0.311966 | 0.385057 | 42 | 135 | 174 | 57 | 221 | 157 |
| rs2102374 | Imputed | A | ADD | 790 | 0.6269 | 0.1219 | 0.4937 | 0.7961 | -3.831 | 0.000128 | 0.781 | 0.25886 | 0.211429 | 0.296591 | 14 | 120 | 216 | 37 | 187 | 216 |
| rs2102374 | Imputed | A | DOM | 790 | 0.5989 | 0.1465 | 0.4494 | 0.798 | -3.501 | 0.000464 | 0.781 | 0.25886 | 0.211429 | 0.296591 | 14 | 120 | 216 | 37 | 187 | 216 |
| rs2108426 | Imputed | C | DOM | 799 | 0.6626 | 0.1466 | 0.4971 | 0.8832 | -2.807 | 0.004996 | 0.8145 | 0.34543 | 0.317927 | 0.367647 | 44 | 139 | 174 | 53 | 219 | 170 |
| rs2110664 | Imputed | G | DOM | 744 | 1.429 | 0.1493 | 1.066 | 1.915 | 2.391 | 0.01682 | 0.5169 | 0.27218 | 0.300898 | 0.24878 | 26 | 149 | 159 | 25 | 154 | 231 |
| rs2132242 | Imputed | A | ADD | 793 | 0.7317 | 0.1056 | 0.5948 | 0.9 | -2.957 | 0.003104 | 0.8835 | 0.40984 | 0.371469 | 0.440774 | 53 | 157 | 144 | 79 | 229 | 131 |
| rs2132242 | Imputed | A | DOM | 793 | 0.6043 | 0.1522 | 0.4484 | 0.8143 | -3.309 | 0.000936 | 0.8835 | 0.40984 | 0.371469 | 0.440774 | 53 | 157 | 144 | 79 | 229 | 131 |
| rs2158958 | Imputed | A | DOM | 800 | 0.6617 | 0.1466 | 0.4964 | 0.882 | -2.816 | 0.004859 | 0.8149 | 0.34563 | 0.317927 | 0.367946 | 44 | 139 | 174 | 53 | 220 | 170 |
| rs2158961 | Imputed | G | ADD | 796 | 0.6544 | 0.1465 | 0.491 | 0.8722 | -2.893 | 0.003813 | 0.8139 | 0.34296 | 0.315493 | 0.365079 | 44 | 136 | 175 | 51 | 220 | 170 |
| rs2163046 | Imputed | A | DOM | 775 | 1.474 | 0.149 | 1.101 | 1.973 | 2.603 | 0.009245 | 0.8374 | 0.22516 | 0.252874 | 0.202576 | 19 | 138 | 191 | 19 | 135 | 273 |
| rs2180286 | Imputed | G | DOM | 798 | 0.6211 | 0.164 | 0.4503 | 0.8566 | -2.903 | 0.003694 | 0.3579 | 0.49875 | 0.469188 | 0.522676 | 89 | 157 | 111 | 116 | 229 | 96 |
| rs2180684 | Imputed | A | DOM | 800 | 1.684 | 0.1876 | 1.166 | 2.433 | 2.779 | 0.005451 | 0.05232 | 0.10313 | 0.120448 | 0.089165 | 5 | 76 | 276 | 9 | 61 | 373 |
| rs2188079 | Imputed | C | ADD | 798 | 1.333 | 0.1034 | 1.088 | 1.632 | 2.775 | 0.005514 | 0.7718 | 0.42043 | 0.461972 | 0.387133 | 81 | 166 | 108 | 62 | 219 | 162 |
| rs2188079 | Imputed | C | DOM | 798 | | | | | 10.2 | 0.006111 | 0.7718 | 0.42043 | 0.461972 | 0.387133 | 81 | 166 | 108 | 62 | 219 | 162 |
| rs2190598 | Imputed | T | DOM | 800 | 0.6617 | 0.1466 | 0.4964 | 0.882 | -2.816 | 0.004859 | 0.8149 | 0.34563 | 0.317927 | 0.367946 | 44 | 139 | 174 | 53 | 220 | 170 |
| rs2190600 | Imputed | A | DOM | 791 | 0.6716 | 0.1473 | 0.5032 | 0.8964 | -2.703 | 0.006874 | 0.6933 | 0.34324 | 0.316901 | 0.364679 | 44 | 137 | 174 | 52 | 214 | 170 |

TABLE 14-continued

| SNP rs # | SOURCE | AL-LELE (A1) | MOD-EL | NMISS | OR | SE | L95 | U95 | STAT | P | HW PVA-LUE | AL-LELE FREQ | PRA-VA AL-LELE FREQ | PLA-CEBO AL-LELE FREQ | PRA-VA A1 HZ CO-UNT | PRA-VA HET CO-UNT | PRA-VA A2 HZ CO-UNT | PLA-CEBO A1 HZ CO-UNT | PLA-CEBO HET CO-UNT | PLA-CEBO A2 HZ CO-UNT |
|---|---|---|---|---|---|---|---|---|---|---|---|---|---|---|---|---|---|---|---|---|
| rs2224184 | Geno-typed | T | DOM | 800 | 0.6357 | 0.1621 | 0.4626 | 0.8735 | -2.794 | 0.005199 | 0.2036 | 0.495 | 0.466387 | 0.518059 | 89 | 155 | 113 | 116 | 227 | 100 |
| rs2247066 | Imputed | A | DOM | 800 | 0.6151 | 0.1445 | 0.4634 | 0.8164 | -3.364 | 0.000769 | 0.5437 | 0.285 | 0.239496 | 0.32167 | 19 | 133 | 205 | 42 | 201 | 200 |
| rs2248236 | Imputed | C | ADD | 728 | 0.6377 | 0.1466 | 0.4784 | 0.85 | -3.068 | 0.002153 | 0.1692 | 0.18063 | 0.147516 | 0.206897 | 6 | 83 | 233 | 12 | 144 | 250 |
| rs2248236 | Imputed | C | DOM | 728 | 0.6049 | 0.1624 | 0.44 | 0.8317 | -3.095 | 0.00197 | 0.1692 | 0.18063 | 0.147516 | 0.206897 | 6 | 83 | 233 | 12 | 144 | 250 |
| rs2265733 | Imputed | C | ADD | 790 | 0.6269 | 0.1219 | 0.4937 | 0.7961 | -3.831 | 0.000128 | 0.781 | 0.25886 | 0.211429 | 0.296591 | 14 | 120 | 216 | 37 | 187 | 216 |
| rs2265733 | Imputed | C | DOM | 790 | 0.5989 | 0.1465 | 0.4494 | 0.798 | -3.501 | 0.000464 | 0.781 | 0.25886 | 0.211429 | 0.296591 | 14 | 120 | 216 | 37 | 187 | 216 |
| rs2270584 | Imputed | A | DOM | 796 | 0.7437 | 0.1051 | 0.6052 | 0.9138 | -2.818 | 0.004834 | 0.8821 | 0.39322 | 0.356338 | 0.422902 | 53 | 147 | 155 | 71 | 231 | 139 |
| rs2270584 | Imputed | A | ADD | 796 | 0.5859 | 0.1496 | 0.437 | 0.7855 | -3.574 | 0.000351 | 0.8821 | 0.39322 | 0.356338 | 0.422902 | 53 | 147 | 155 | 71 | 231 | 139 |
| rs2270586 | Imputed | A | DOM | 795 | 0.7444 | 0.1051 | 0.6059 | 0.9147 | -2.808 | 0.004978 | 0.8818 | 0.39308 | 0.356338 | 0.422727 | 53 | 147 | 155 | 71 | 230 | 139 |
| rs2270586 | Imputed | A | ADD | 795 | 0.5879 | 0.1496 | 0.4385 | 0.7883 | -3.55 | 0.000385 | 0.8818 | 0.39308 | 0.356338 | 0.422727 | 53 | 147 | 155 | 71 | 230 | 139 |
| rs229775 | Imputed | A | REC | 798 | 0.3933 | 0.2549 | 0.2387 | 0.6482 | -3.661 | 0.000252 | 0.2143 | 0.35088 | 0.308451 | 0.384876 | 23 | 173 | 159 | 67 | 207 | 169 |
| rs229815 | Imputed | T | REC | 762 | 0.4053 | 0.2727 | 0.2375 | 0.6916 | -3.312 | 0.000925 | 0.1243 | 0.33727 | 0.297935 | 0.368794 | 20 | 162 | 157 | 57 | 198 | 168 |
| rs229829 | Imputed | C | REC | 797 | 0.5066 | 0.2182 | 0.3303 | 0.7769 | -3.117 | 0.001827 | 0.3711 | 0.38896 | 0.344633 | 0.424379 | 35 | 174 | 145 | 79 | 218 | 146 |
| rs229831 | Imputed | A | REC | 797 | 0.3945 | 0.2549 | 0.2394 | 0.6501 | -3.65 | 0.000263 | 0.2138 | 0.35132 | 0.309322 | 0.384876 | 23 | 173 | 158 | 67 | 207 | 169 |
| rs2317057 | Imputed | T | ADD | 623 | 0.7125 | 0.1358 | 0.546 | 0.9298 | -2.496 | 0.01256 | 0.3235 | 0.23917 | 0.20471 | 0.265571 | 14 | 85 | 177 | 26 | 133 | 188 |
| rs2322100 | Geno-typed | T | REC | 800 | 1.768 | 0.28 | 1.021 | 3.061 | 2.035 | 0.04187 | 0.2233 | 0.28375 | 0.285714 | 0.282167 | 33 | 138 | 186 | 24 | 202 | 217 |
| rs2322101 | Imputed | A | REC | 799 | 1.764 | 0.28 | 1.019 | 3.053 | 2.026 | 0.04276 | 0.2237 | 0.28348 | 0.285714 | 0.281674 | 33 | 138 | 186 | 24 | 201 | 217 |
| rs2327929 | Imputed | G | REC | 799 | 1.996 | 0.1838 | 1.392 | 2.862 | 3.761 | 0.000169 | 0.09589 | 0.4224 | 0.470506 | 0.383747 | 89 | 157 | 110 | 65 | 210 | 168 |
| rs2332844 | Imputed | A | ADD | 681 | 1.802 | 0.1484 | 1.347 | 2.41 | 3.969 | 7.22E-05 | 0.4407 | 0.81718 | 0.86526 | 0.77748 | 230 | 73 | 5 | 228 | 124 | 21 |
| rs2332844 | Imputed | A | REC | 681 | 1.849 | 0.1698 | 1.326 | 2.579 | 3.62 | 0.000295 | 0.4407 | 0.81718 | 0.86526 | 0.77748 | 230 | 73 | 5 | 228 | 124 | 21 |
| rs2349170 | Imputed | G | DOM | 797 | 1.638 | 0.1487 | 1.224 | 2.192 | 3.319 | 0.000903 | 0.1438 | 0.21706 | 0.245787 | 0.193878 | 12 | 151 | 193 | 18 | 135 | 288 |
| rs2356722 | Imputed | G | DOM | 798 | 0.5863 | 0.1447 | 0.4416 | 0.7785 | -3.691 | 0.000223 | 0.6103 | 0.29449 | 0.247191 | 0.332579 | 22 | 132 | 202 | 44 | 206 | 192 |
| rs2364956 | Imputed | T | ADD | 772 | 1.439 | 0.1382 | 1.098 | 1.887 | 2.634 | 0.008429 | 1 | 0.16969 | 0.196581 | 0.147162 | 12 | 114 | 225 | 10 | 104 | 307 |
| rs2373793 | Imputed | G | DOM | 792 | 1.379 | 0.1411 | 1.046 | 1.818 | 2.279 | 0.02264 | 0.1524 | 0.14583 | 0.169492 | 0.126712 | 12 | 96 | 246 | 10 | 91 | 337 |
| rs2373793 | Imputed | G | ADD | 792 | 1.446 | 0.1627 | 1.051 | 1.989 | 2.265 | 0.0235 | 0.1524 | 0.14583 | 0.169492 | 0.126712 | 12 | 96 | 246 | 10 | 91 | 337 |
| rs238252 | Imputed | G | DOM | 799 | 1.66 | 0.1458 | 1.248 | 2.209 | 3.478 | 0.000505 | 0.02096 | 0.13329 | 0.169468 | 0.104072 | 13 | 95 | 249 | 9 | 74 | 359 |
| rs238252 | Imputed | G | ADD | 799 | 1.848 | 0.1687 | 1.328 | 2.573 | 3.642 | 0.000271 | 0.02096 | 0.13329 | 0.169468 | 0.104072 | 13 | 95 | 249 | 9 | 74 | 359 |
| rs2383903 | Imputed | G | DOM | 797 | 0.6249 | 0.1456 | 0.4698 | 0.8313 | -3.229 | 0.001242 | 0.9292 | 0.27478 | 0.240169 | 0.302721 | 24 | 123 | 209 | 35 | 197 | 209 |
| rs2387945 | Imputed | G | DOM | 792 | 1.587 | 0.1626 | 1.154 | 2.182 | 2.84 | 0.004513 | 0.4666 | 0.14141 | 0.169014 | 0.118993 | 8 | 104 | 243 | 5 | 94 | 338 |
| rs2389863 | Imputed | A | DOM | 784 | 0.6722 | 0.1503 | 0.5007 | 0.9025 | -2.643 | 0.008221 | 0.03874 | 0.20791 | 0.181948 | 0.228736 | 10 | 107 | 232 | 14 | 171 | 250 |
| rs2389869 | Imputed | G | ADD | 800 | 0.6634 | 0.1489 | 0.4955 | 0.8883 | -2.756 | 0.005859 | 0.03097 | 0.20625 | 0.179272 | 0.227991 | 10 | 108 | 239 | 14 | 174 | 255 |
| rs2389870 | Imputed | C | DOM | 800 | 0.6413 | 0.1561 | 0.4723 | 0.8709 | -2.846 | 0.004433 | 0.2661 | 0.1725 | 0.142857 | 0.196388 | 6 | 90 | 261 | 13 | 148 | 282 |
| rs2418494 | Geno-typed | G | ADD | 777 | 0.8166 | 0.101 | 0.67 | 0.9953 | -2.006 | 0.04483 | 0.06196 | 0.51351 | 0.485549 | 0.535963 | 84 | 168 | 94 | 134 | 194 | 103 |
| rs2418494 | Imputed | G | GEN | 777 | | | | | 4.805 | 0.0905 | 0.06196 | 0.51351 | 0.485549 | 0.535963 | 84 | 168 | 94 | 134 | 194 | 103 |
| rs2418541 | Imputed | A | DOM | 798 | 0.6462 | 0.1462 | 0.4852 | 0.8606 | -2.987 | 0.002819 | 0.754 | 0.34336 | 0.314607 | 0.366516 | 44 | 136 | 176 | 52 | 220 | 170 |
| rs2418542 | Imputed | A | DOM | 797 | 0.6489 | 0.1462 | 0.4872 | 0.8644 | -2.957 | 0.003109 | 0.7533 | 0.34316 | 0.314607 | 0.366213 | 44 | 136 | 176 | 52 | 219 | 170 |
| rs2423556 | Imputed | C | DOM | 796 | 0.6175 | 0.1654 | 0.4465 | 0.8539 | -2.915 | 0.003556 | 0.3955 | 0.50251 | 0.473239 | 0.526077 | 90 | 156 | 109 | 117 | 230 | 94 |
| rs2437688 | Imputed | C | ADD | 799 | 1.457 | 0.1639 | 1.056 | 2.008 | 2.294 | 0.02177 | 0.01205 | 0.10451 | 0.122191 | 0.090293 | 8 | 71 | 277 | 8 | 64 | 371 |
| rs2456809 | Imputed | G | DOM | 800 | 0.6151 | 0.1445 | 0.4634 | 0.8164 | -3.364 | 0.000769 | 0.604 | 0.28563 | 0.240896 | 0.32167 | 20 | 132 | 205 | 42 | 201 | 200 |
| rs2456811 | Imputed | T | ADD | 789 | 0.6292 | 0.1219 | 0.4955 | 0.799 | -3.8 | 0.000144 | 0.781 | 0.25919 | 0.212034 | 0.296591 | 14 | 120 | 215 | 37 | 187 | 216 |
| rs2456811 | Imputed | T | DOM | 789 | 0.6017 | 0.1465 | 0.4515 | 0.8019 | -3.466 | 0.000527 | 0.781 | 0.25919 | 0.212034 | 0.296591 | 14 | 120 | 215 | 37 | 187 | 216 |
| rs2476976 | Imputed | C | DOM | 799 | 1.596 | 0.1449 | 1.201 | 2.12 | 3.225 | 0.001258 | 0.7326 | 0.29287 | 0.323529 | 0.2681 | 29 | 173 | 155 | 37 | 163 | 242 |

TABLE 14-continued

| SNP rs # | SOURCE | AL-LELE (A1) | MOD-EL | NMISS | OR | SE | L95 | U95 | STAT | P | HW_PVA-LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs2484911 | Imputed | A | DOM | 797 | 1.56 | 0.1448 | 1.175 | 2.073 | 3.071 | 0.002132 | 0.5269 | 0.26725 | 0.296348 | 0.243764 | 23 | 165 | 168 | 30 | 155 | 256 |
| rs2488557 | Imputed | C | DOM | 787 | 0.5503 | 0.1765 | 0.3894 | 0.7777 | -3.384 | 0.000713 | 0.5179 | 0.12643 | 0.096264 | 0.150342 | 4 | 59 | 285 | 6 | 120 | 313 |
| rs250162 | Imputed | C | ADD | 777 | 0.7333 | 0.1252 | 0.5738 | 0.9373 | -2.477 | 0.01324 | 0.8414 | 0.23423 | 0.205279 | 0.256881 | 15 | 110 | 216 | 26 | 172 | 238 |
| rs250162 | Imputed | C | DOM | 777 | 0.6818 | 0.1495 | 0.5086 | 0.9139 | -2.562 | 0.0104 | 0.8414 | 0.23423 | 0.205279 | 0.256881 | 15 | 110 | 216 | 26 | 172 | 238 |
| rs2560708 | Imputed | T | DOM | 770 | 0.6815 | 0.1471 | 0.5108 | 0.9092 | -2.607 | 0.009133 | 0.07361 | 0.17078 | 0.14058 | 0.195294 | 3 | 91 | 251 | 12 | 142 | 271 |
| rs2617841 | Imputed | G | DOM | 737 | 0.679 | 0.1512 | 0.5048 | 0.9132 | -2.56 | 0.01045 | 0.6955 | 0.2517 | 0.218373 | 0.279012 | 15 | 115 | 202 | 29 | 168 | 208 |
| rs2622499 | Imputed | G | DOM | 798 | 0.6691 | 0.149 | 0.4996 | 0.8961 | -2.696 | 0.007022 | 0.0308 | 0.20677 | 0.180282 | 0.227991 | 10 | 108 | 237 | 14 | 174 | 255 |
| rs264129 | Imputed | T | DOM | 798 | 0.653 | 0.1461 | 0.4904 | 0.8695 | -2.917 | 0.003536 | 0.8136 | 0.34211 | 0.314607 | 0.364253 | 44 | 136 | 176 | 51 | 220 | 171 |
| rs2642936 | Imputed | T | ADD | 767 | 1.403 | 0.1248 | 1.098 | 1.791 | 2.712 | 0.006694 | 0.8364 | 0.22555 | 0.259475 | 0.198113 | 22 | 134 | 187 | 18 | 132 | 274 |
| rs2660633 | Imputed | A | DOM | 800 | 0.6151 | 0.1445 | 0.4634 | 0.8164 | -3.364 | 0.000769 | 0.5437 | 0.285 | 0.239496 | 0.32167 | 19 | 133 | 205 | 42 | 201 | 200 |
| rs2660634 | Imputed | C | DOM | 800 | 0.6151 | 0.1445 | 0.4634 | 0.8164 | -3.364 | 0.000769 | 0.5437 | 0.285 | 0.239496 | 0.32167 | 19 | 133 | 205 | 42 | 201 | 200 |
| rs2660648 | Imputed | A | ADD | 790 | 0.6269 | 0.1219 | 0.4937 | 0.7961 | -3.831 | 0.000128 | 0.781 | 0.25886 | 0.211429 | 0.296591 | 14 | 120 | 216 | 37 | 187 | 216 |
| rs2660648 | Imputed | A | DOM | 790 | 0.5989 | 0.1465 | 0.4494 | 0.798 | -3.501 | 0.000464 | 0.781 | 0.25886 | 0.211429 | 0.296591 | 14 | 120 | 216 | 37 | 187 | 216 |
| rs2681505 | Imputed | T | ADD | 800 | 0.6338 | 0.1259 | 0.4952 | 0.8112 | -3.621 | 0.000293 | 0.2824 | 0.2375 | 0.194678 | 0.272009 | 7 | 125 | 225 | 32 | 177 | 234 |
| rs277411 | Imputed | G | DOM | 797 | 0.346 | 0.3255 | 0.1828 | 0.6549 | -3.261 | 0.001112 | 1 | 0.03639 | 0.018207 | 0.051136 | 0 | 13 | 344 | 1 | 43 | 396 |
| rs2832634 | Imputed | G | ADD | 767 | 1.706 | 0.2347 | 1.077 | 2.702 | 2.276 | 0.02282 | 1 | 0.05541 | 0.069971 | 0.043632 | 1 | 46 | 296 | 1 | 35 | 388 |
| rs2832637 | Imputed | T | ADD | 767 | 1.706 | 0.2347 | 1.077 | 2.702 | 2.276 | 0.02282 | 1 | 0.05541 | 0.069971 | 0.043632 | 1 | 46 | 296 | 1 | 35 | 388 |
| rs2843167 | Imputed | A | DOM | 789 | 0.5976 | 0.1456 | 0.4493 | 0.795 | -3.536 | 0.000406 | 0.6009 | 0.2858 | 0.241477 | 0.32151 | 21 | 128 | 203 | 40 | 201 | 196 |
| rs2876227 | Imputed | C | ADD | 780 | 1.336 | 0.1077 | 1.082 | 1.65 | 2.692 | 0.007104 | 0.5865 | 0.35897 | 0.396848 | 0.328306 | 61 | 155 | 133 | 43 | 197 | 191 |
| rs2876227 | Imputed | C | GEN | 780 | | | | | 9.11 | 0.01051 | 0.5865 | 0.35897 | 0.396848 | 0.328306 | 61 | 155 | 133 | 43 | 197 | 191 |
| rs2882097 | Imputed | A | DOM | 800 | 1.654 | 0.1456 | 1.243 | 2.2 | 3.456 | 0.000547 | 0.9326 | 0.29688 | 0.329132 | 0.27088 | 31 | 173 | 153 | 40 | 160 | 243 |
| rs2909862 | Imputed | G | DOM | 680 | 1.87 | 0.1696 | 1.341 | 2.608 | 3.692 | 0.000223 | 0.5231 | 0.40147 | 0.447712 | 0.363636 | 53 | 168 | 85 | 52 | 168 | 154 |
| rs3001945 | Imputed | T | DOM | 792 | 1.587 | 0.1626 | 1.154 | 2.182 | 2.84 | 0.004513 | 0.4666 | 0.14141 | 0.169014 | 0.118993 | 8 | 104 | 243 | 5 | 94 | 338 |
| rs3011020 | Imputed | C | DOM | 791 | 1.591 | 0.1626 | 1.157 | 2.188 | 2.856 | 0.004284 | 0.4664 | 0.14159 | 0.169492 | 0.118993 | 8 | 104 | 242 | 5 | 94 | 338 |
| rs36071725 | Geno-typed | C | ADD | 800 | 1.524 | 0.1104 | 1.228 | 1.892 | 3.818 | 0.000134 | 0.4813 | 0.34438 | 0.396359 | 0.302483 | 60 | 163 | 134 | 30 | 208 | 205 |
| rs36071725 | Geno-typed | C | GEN | 800 | | | | | 18.94 | 7.72E-05 | 0.4813 | 0.34438 | 0.396359 | 0.302483 | 60 | 163 | 134 | 30 | 208 | 205 |
| rs373983 | Imputed | G | DOM | 782 | 1.553 | 0.154 | 1.148 | 2.1 | 2.858 | 0.004263 | 0.3368 | 0.41113 | 0.451149 | 0.379032 | 70 | 174 | 104 | 69 | 191 | 174 |
| rs3743794 | Imputed | G | DOM | 797 | 0.587 | 0.1492 | 0.4382 | 0.7864 | -3.571 | 0.000356 | 0.8817 | 0.39084 | 0.34887 | 0.424379 | 49 | 149 | 156 | 74 | 228 | 141 |
| rs3756154 | Imputed | C | ADD | 800 | 0.7138 | 0.1326 | 0.5504 | 0.9257 | -2.542 | 0.0103 | 0.03097 | 0.20625 | 0.179272 | 0.227991 | 10 | 108 | 239 | 14 | 174 | 255 |
| rs3756154 | Imputed | C | DOM | 800 | 0.6634 | 0.1489 | 0.4955 | 0.8883 | -2.756 | 0.005859 | 0.03097 | 0.20625 | 0.179272 | 0.227991 | 10 | 108 | 239 | 14 | 174 | 255 |
| rs3775850 | Imputed | A | DOM | 797 | 0.6253 | 0.1569 | 0.4598 | 0.8505 | -2.992 | 0.002768 | 0.212 | 0.17127 | 0.140845 | 0.195701 | 6 | 88 | 261 | 12 | 149 | 281 |
| rs3775851 | Imputed | C | DOM | 798 | 0.6341 | 0.1569 | 0.4662 | 0.8624 | -2.903 | 0.003694 | 0.2128 | 0.17043 | 0.140845 | 0.194131 | 6 | 88 | 261 | 12 | 148 | 283 |
| rs3793044 | Imputed | T | ADD | 800 | 1.998 | 0.2096 | 1.325 | 3.013 | 3.302 | 0.00096 | 0.2635 | 0.06938 | 0.092437 | 0.05079 | 4 | 58 | 295 | 2 | 41 | 400 |
| rs3793044 | Imputed | T | DOM | 800 | 2.076 | 0.2229 | 1.341 | 3.213 | 3.276 | 0.001053 | 0.2635 | 0.06938 | 0.092437 | 0.05079 | 4 | 58 | 295 | 2 | 41 | 400 |
| rs3793053 | Imputed | T | DOM | 784 | 1.878 | 0.1992 | 1.271 | 2.775 | 3.163 | 0.001559 | 0.8339 | 0.09311 | 0.116715 | 0.074871 | 4 | 73 | 270 | 3 | 59 | 375 |
| rs3796246 | Imputed | G | DOM | 797 | 0.5889 | 0.193 | 0.4034 | 0.8595 | -2.744 | 0.006063 | 0.6868 | 0.09598 | 0.074648 | 0.113122 | 3 | 47 | 305 | 5 | 90 | 347 |
| rs3806003 | Imputed | A | ADD | 800 | 1.998 | 0.2096 | 1.325 | 3.013 | 3.302 | 0.00096 | 0.2635 | 0.06938 | 0.092437 | 0.05079 | 4 | 58 | 295 | 2 | 41 | 400 |
| rs3806003 | Imputed | A | DOM | 800 | 2.076 | 0.2229 | 1.341 | 3.213 | 3.276 | 0.001053 | 0.2635 | 0.06938 | 0.092437 | 0.05079 | 4 | 58 | 295 | 2 | 41 | 400 |
| rs3806004 | Imputed | T | DOM | 799 | 1.856 | 0.1976 | 1.26 | 2.734 | 3.131 | 0.001743 | 0.8332 | 0.09199 | 0.115169 | 0.073363 | 4 | 74 | 278 | 3 | 59 | 381 |
| rs3806010 | Imputed | T | DOM | 799 | 1.856 | 0.1976 | 1.26 | 2.734 | 3.131 | 0.001743 | 0.8332 | 0.09199 | 0.115169 | 0.073363 | 4 | 74 | 278 | 3 | 59 | 381 |
| rs3806014 | Imputed | T | DOM | 796 | 1.865 | 0.1984 | 1.264 | 2.752 | 3.143 | 0.001675 | 0.8338 | 0.09234 | 0.115493 | 0.073696 | 4 | 74 | 277 | 3 | 59 | 379 |
| rs3806015 | Imputed | T | DOM | 799 | 1.856 | 0.1976 | 1.26 | 2.734 | 3.131 | 0.001743 | 0.8332 | 0.09199 | 0.115169 | 0.073363 | 4 | 74 | 278 | 3 | 59 | 381 |
| rs3806018 | Imputed | A | DOM | 790 | 1.834 | 0.1988 | 1.242 | 2.708 | 3.051 | 0.002279 | 0.8349 | 0.09304 | 0.115819 | 0.074541 | 4 | 74 | 276 | 3 | 59 | 374 |
| rs3806019 | Imputed | A | DOM | 799 | 1.856 | 0.1976 | 1.26 | 2.734 | 3.131 | 0.001743 | 0.8332 | 0.09199 | 0.115169 | 0.073363 | 4 | 74 | 278 | 3 | 59 | 381 |

TABLE 14-continued

| SNP rs # | SOURCE | AL-LELE (A1) | MOD-EL | NMISS | OR | SE | L95 | U95 | STAT | P | HW_PVA-LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs3806024 | Imputed | T | DOM | 784 | 1.878 | 0.1992 | 1.271 | 2.775 | 3.163 | 0.001559 | 0.8339 | 0.09311 | 0.116715 | 0.074371 | 4 | 73 | 270 | 3 | 59 | 375 |
| rs3915080 | Imputed | A | GEN | 785 | | | | | 10.95 | 0.004188 | 0.647 | 0.37134 | 0.409348 | 0.340278 | 63 | 163 | 127 | 42 | 210 | 180 |
| rs3942254 | Imputed | T | ADD | 789 | 0.7293 | 0.107 | 0.5913 | 0.8995 | -2.95 | 0.003182 | 0.9408 | 0.39607 | 0.358571 | 0.425968 | 49 | 153 | 148 | 74 | 226 | 139 |
| rs3942254 | Imputed | T | DOM | 789 | 0.6079 | 0.1519 | 0.4513 | 0.8187 | -3.277 | 0.00105 | 0.9408 | 0.39607 | 0.358571 | 0.425968 | 49 | 153 | 148 | 74 | 226 | 139 |
| rs3945085 | Imputed | A | DOM | 797 | 1.637 | 0.1456 | 1.231 | 2.178 | 3.387 | 0.000706 | 0.8656 | 0.29674 | 0.328652 | 0.270975 | 31 | 172 | 153 | 40 | 159 | 242 |
| rs3976737 | Imputed | G | ADD | 753 | 0.5945 | 0.1454 | 0.4471 | 0.7905 | -3.577 | 0.000348 | 0.3603 | 0.16799 | 0.126866 | 0.200957 | 7 | 71 | 257 | 18 | 132 | 267 |
| rs399485 | Imputed | A | DOM | 794 | 1.449 | 0.145 | 1.09 | 1.925 | 2.556 | 0.01057 | 0.7862 | 0.26763 | 0.299157 | 0.242009 | 29 | 155 | 172 | 26 | 160 | 252 |
| rs4029119 | Imputed | G | ADD | 800 | 0.2198 | 0.3906 | 0.1022 | 0.4726 | -3.878 | 0.000105 | 0.0147 | 0.03563 | 0.015406 | 0.051919 | 0 | 11 | 346 | 4 | 38 | 401 |
| rs4029119 | Imputed | G | DOM | 800 | 0.2258 | 0.4052 | 0.102 | 0.4995 | -3.673 | 0.00024 | 0.0147 | 0.03563 | 0.015406 | 0.051919 | 0 | 11 | 346 | 4 | 38 | 401 |
| rs4076201 | Imputed | G | GEN | 776 | | | | | 8.852 | 0.01196 | 0.913 | 0.20747 | 0.232558 | 0.1875 | 23 | 114 | 207 | 11 | 140 | 281 |
| rs4076201 | Imputed | G | REC | 776 | 2.978 | 0.3815 | 1.41 | 6.29 | 2.86 | 0.004234 | 0.913 | 0.20747 | 0.232558 | 0.1875 | 23 | 114 | 207 | 11 | 140 | 281 |
| rs41395945 | Imputed | G | ADD | 767 | 1.706 | 0.2347 | 1.077 | 2.702 | 2.276 | 0.02282 | 0.043632 | 0.5541 | 0.069971 | 0.043632 | 1 | 46 | 296 | 1 | 35 | 388 |
| rs41395945 | Imputed | G | DOM | 767 | 1.77 | 0.2427 | 1.1 | 2.849 | 2.353 | 0.0186 | 1 | 0.05541 | 0.069971 | 0.043632 | 1 | 46 | 296 | 1 | 35 | 388 |
| rs4146972 | Imputed | G | DOM | 800 | 1.441 | 0.1516 | 1.071 | 1.94 | 2.41 | 0.01594 | 0.8159 | 0.18688 | 0.207283 | 0.170429 | 11 | 126 | 220 | 18 | 115 | 310 |
| rs4238087 | Imputed | G | DOM | 789 | 0.719 | 0.1681 | 0.5172 | 0.9995 | -1.963 | 0.04968 | 0.6536 | 0.13688 | 0.117564 | 0.152523 | 4 | 75 | 274 | 12 | 109 | 315 |
| rs4251569 | Imputed | T | ADD | 791 | 0.7164 | 0.1513 | 0.5325 | 0.9637 | -2.204 | 0.02753 | 0.6528 | 0.13654 | 0.117232 | 0.152174 | 4 | 75 | 275 | 12 | 109 | 316 |
| rs4251569 | Imputed | T | DOM | 791 | 0.7189 | 0.1681 | 0.5171 | 0.9993 | -1.964 | 0.04952 | 0.6528 | 0.13654 | 0.117232 | 0.152174 | 4 | 75 | 275 | 12 | 109 | 316 |
| rs4273613 | Imputed | T | ADD | 800 | 0.2198 | 0.3906 | 0.1022 | 0.4726 | -3.878 | 0.000105 | 0.0147 | 0.03563 | 0.015406 | 0.051919 | 0 | 11 | 346 | 4 | 38 | 401 |
| rs4273613 | Imputed | T | DOM | 800 | 0.2258 | 0.4052 | 0.102 | 0.4995 | -3.673 | 0.00024 | 0.0147 | 0.03563 | 0.015406 | 0.051919 | 0 | 11 | 346 | 4 | 38 | 401 |
| rs4291049 | Imputed | T | REC | 798 | 0.5495 | 0.1747 | 0.3902 | 0.7739 | -3.428 | 0.000609 | 0.8875 | 0.49185 | 0.44507 | 0.529345 | 65 | 186 | 104 | 129 | 211 | 103 |
| rs4315598 | Imputed | T | ADD | 799 | 1.348 | 0.1061 | 1.095 | 1.66 | 2.813 | 0.004904 | 0.3986 | 0.35982 | 0.39916 | 0.328054 | 64 | 157 | 136 | 45 | 200 | 197 |
| rs4315598 | Imputed | T | GEN | 799 | | | | | 9.777 | 0.007533 | 0.3986 | 0.35982 | 0.39916 | 0.328054 | 64 | 157 | 136 | 45 | 200 | 197 |
| rs4321395 | Imputed | T | REC | 799 | 1.885 | 0.2107 | 1.247 | 2.849 | 3.009 | 0.002624 | 0.3986 | 0.35982 | 0.39916 | 0.328054 | 64 | 157 | 136 | 45 | 200 | 197 |
| rs4321395 | Imputed | A | DOM | 760 | 0.6185 | 0.1611 | 0.451 | 0.8482 | -2.982 | 0.002863 | 0.8837 | 0.45526 | 0.420588 | 0.483333 | 65 | 156 | 119 | 91 | 224 | 105 |
| rs4321596 | Geno-typed | T | REC | 800 | 2.132 | 0.296 | 1.194 | 3.809 | 2.559 | 0.0105 | 0.0184 | 0.23625 | 0.247899 | 0.226862 | 35 | 107 | 215 | 22 | 157 | 264 |
| rs4324417 | Imputed | T | DOM | 800 | 1.724 | 0.1627 | 1.254 | 2.372 | 3.349 | 0.000812 | 0.6702 | 0.46375 | 0.504202 | 0.431151 | 85 | 190 | 82 | 90 | 202 | 151 |
| rs4328619 | Geno-typed | G | DOM | 800 | 0.6851 | 0.1653 | 0.4955 | 0.9472 | -2.288 | 0.02212 | 0.357 | 0.47688 | 0.448179 | 0.5 | 71 | 178 | 108 | 104 | 235 | 104 |
| rs4338909 | Imputed | T | ADD | 798 | 1.366 | 0.1028 | 1.116 | 1.67 | 3.031 | 0.002435 | 0.4636 | 0.40664 | 0.448179 | 0.373016 | 70 | 180 | 107 | 67 | 195 | 179 |
| rs4370878 | Imputed | G | DOM | 798 | 1.625 | 0.1458 | 1.221 | 2.162 | 3.327 | 0.000877 | 0.9327 | 0.29762 | 0.328652 | 0.272624 | 31 | 172 | 153 | 40 | 161 | 241 |
| rs4379434 | Geno-typed | T | DOM | 800 | 1.624 | 0.1546 | 1.199 | 2.199 | 3.136 | 0.001712 | 0.7172 | 0.42063 | 0.446779 | 0.399549 | 63 | 193 | 101 | 81 | 192 | 170 |
| rs4416407 | Imputed | T | DOM | 791 | 1.831 | 0.1801 | 1.287 | 2.606 | 3.359 | 0.000782 | 0.8311 | 0.52212 | 0.553824 | 0.496575 | 97 | 197 | 59 | 117 | 201 | 120 |
| rs4417899 | Imputed | C | REC | 793 | 0.544 | 0.18 | 0.3823 | 0.7742 | -3.382 | 0.000721 | 0.9432 | 0.47415 | 0.442254 | 0.5 | 59 | 196 | 100 | 120 | 198 | 120 |
| rs4442732 | Imputed | A | ADD | 658 | 0.6071 | 0.133 | 0.4678 | 0.7879 | -3.752 | 0.000176 | 0.1382 | 0.33739 | 0.284483 | 0.379076 | 21 | 123 | 146 | 45 | 189 | 134 |
| rs4444612 | Imputed | G | ADD | 795 | 1.36 | 0.1064 | 1.104 | 1.675 | 2.888 | 0.003879 | 0.3988 | 0.36101 | 0.401408 | 0.328409 | 64 | 157 | 134 | 45 | 199 | 196 |
| rs4444612 | Imputed | G | GEN | 795 | | | | | 10.03 | 0.006632 | 0.3988 | 0.36101 | 0.401408 | 0.328409 | 64 | 157 | 134 | 45 | 199 | 196 |
| rs4444612 | Imputed | G | REC | 795 | 1.891 | 0.2107 | 1.251 | 2.858 | 3.023 | 0.002503 | 0.3988 | 0.36101 | 0.401408 | 0.328409 | 64 | 157 | 134 | 45 | 199 | 196 |
| rs4450660 | Imputed | T | DOM | 791 | 1.503 | 0.1459 | 1.129 | 2 | 2.791 | 0.005256 | 0.0061 | 0.23831 | 0.267606 | 0.21445 | 16 | 158 | 181 | 15 | 157 | 264 |
| rs4509702 | Imputed | C | DOM | 798 | 1.625 | 0.1458 | 1.221 | 2.162 | 3.327 | 0.000877 | 0.9327 | 0.29762 | 0.328652 | 0.272624 | 31 | 172 | 153 | 40 | 161 | 241 |
| rs4526920 | Imputed | C | GEN | 795 | | | | | 12.3 | 0.002134 | 0.2253 | 0.28616 | 0.331461 | 0.249431 | 42 | 152 | 162 | 30 | 159 | 250 |
| rs4533145 | Imputed | T | DOM | 788 | 0.4949 | 0.1927 | 0.3392 | 0.7219 | -3.652 | 0.000261 | 0.7024 | 0.10279 | 0.072443 | 0.127294 | 3 | 45 | 304 | 6 | 99 | 331 |
| rs4557006 | Imputed | A | DOM | 753 | 0.6286 | 0.1619 | 0.4577 | 0.8634 | -2.867 | 0.00414 | 0.8835 | 0.45684 | 0.422849 | 0.484375 | 65 | 155 | 117 | 91 | 221 | 104 |
| rs4570530 | Imputed | C | DOM | 798 | 1.625 | 0.1458 | 1.221 | 2.162 | 3.327 | 0.000877 | 0.9327 | 0.29762 | 0.328652 | 0.272624 | 31 | 172 | 153 | 40 | 161 | 241 |

TABLE 14-continued

| SNP rs # | SOURCE | AL- LELE (A1) | MOD- EL | NMISS | OR | SE | L95 | U95 | STAT | P | HW_ PVA LUE | AL- LELE FREQ | PRA- VA_ AL- LELE FREQ | PLA- CEBO_ AL- LELE FREQ | PRA- VA_ A1_ HZ_ CO- UNT | PRA- VA_ HET_ CO- UNT | PRA- VA_ A2_ HZ_ CO- UNT | PLA- CEBO_ A1_ HZ_ CO- UNT | PLA- CEBO_ HET_ CO- UNT | PLA- CEBO_ A2_ HZ_ CO- UNT |
|---|---|---|---|---|---|---|---|---|---|---|---|---|---|---|---|---|---|---|---|---|
| rs4615971 | Imputed | C | DOM | 798 | 1.614 | 0.1449 | 1.215 | 2.144 | 3.304 | 0.000953 | 0.8644 | 0.29261 | 0.32493 | 0.26644 | 30 | 172 | 155 | 37 | 161 | 243 |
| rs4628119 | Imputed | A | DOM | 800 | 0.6745 | 0.1474 | 0.5052 | 0.9004 | -2.672 | 0.007537 | 0.4259 | 0.23125 | 0.20028 | 0.256208 | 17 | 109 | 231 | 30 | 167 | 246 |
| rs4664443 | Imputed | G | ADD | 799 | 0.7174 | 0.1085 | 0.5799 | 0.8874 | -3.06 | 0.002211 | 0.7083 | 0.38235 | 0.341292 | 0.41535 | 41 | 161 | 154 | 73 | 222 | 148 |
| rs4688259 | Imputed | T | DOM | 792 | 1.832 | 0.1801 | 1.287 | 2.608 | 3.363 | 0.000772 | 0.9433 | 0.52525 | 0.556497 | 0.5 | 99 | 196 | 59 | 120 | 198 | 120 |
| rs4688632 | Imputed | G | REC | 797 | 0.5583 | 0.1725 | 0.3981 | 0.783 | -3.378 | 0.000731 | 1 | 0.49812 | 0.463483 | 0.526077 | 67 | 196 | 93 | 131 | 202 | 108 |
| rs4695284 | Imputed | A | ADD | 469 | 2.105 | 0.2029 | 1.414 | 3.133 | 3.667 | 0.000245 | 0.4244 | 0.1322 | 0.176744 | 0.094488 | 0 | 62 | 146 | 3 | 42 | 209 |
| rs4700302 | Imputed | A | ADD | 725 | 0.5167 | 0.1985 | 0.3501 | 0.7624 | -3.327 | 0.000879 | 0.1879 | 0.0931 | 0.066066 | 0.116071 | 7 | 44 | 289 | 3 | 85 | 304 |
| rs4702720 | Imputed | A | ADD | 628 | 0.6094 | 0.1416 | 0.4617 | 0.8044 | -3.497 | 0.00047 | 0.1125 | 0.2285 | 0.183099 | 0.265988 | 14 | 76 | 194 | 26 | 131 | 187 |
| rs4702720 | Imputed | A | DOM | 628 | 0.5402 | 0.171 | 0.3863 | 0.7553 | -3.601 | 0.000317 | 0.1125 | 0.2285 | 0.183099 | 0.265988 | 14 | 76 | 194 | 26 | 131 | 187 |
| rs4711091 | Geno- typed | G | GEN | 800 | | | | | 13.3 | 0.001292 | 0.3943 | 0.47 | 0.519608 | 0.430023 | 102 | 167 | 88 | 81 | 219 | 143 |
| rs4714484 | Imputed | A | ADD | 799 | 0.6694 | 0.1425 | 0.5063 | 0.8852 | -2.816 | 0.004864 | 0.7969 | 0.16333 | 0.133053 | 0.187783 | 6 | 83 | 268 | 14 | 138 | 290 |
| rs4736802 | Imputed | G | DOM | 794 | 1.64 | 0.1547 | 1.211 | 2.221 | 3.196 | 0.001395 | 0.7154 | 0.41877 | 0.445225 | 0.39726 | 62 | 193 | 101 | 80 | 188 | 170 |
| rs4760785 | Imputed | A | ADD | 771 | 0.7218 | 0.1078 | 0.5844 | 0.8916 | -3.025 | 0.002485 | 0.3076 | 0.44617 | 0.405523 | 0.478923 | 54 | 171 | 119 | 92 | 225 | 110 |
| rs4760785 | Imputed | A | DOM | 771 | 0.6464 | 0.1598 | 0.4726 | 0.8841 | -2.731 | 0.006318 | 0.3076 | 0.44617 | 0.405523 | 0.478923 | 54 | 171 | 119 | 92 | 225 | 110 |
| rs4760785 | Imputed | A | GEN | 771 | | | | | 9.268 | 0.009717 | 0.3076 | 0.44617 | 0.405523 | 0.478923 | 54 | 171 | 119 | 92 | 225 | 110 |
| rs4760894 | Imputed | A | ADD | 771 | 0.7218 | 0.1078 | 0.5844 | 0.8916 | -3.025 | 0.002485 | 0.3076 | 0.44617 | 0.405523 | 0.478923 | 54 | 171 | 119 | 92 | 225 | 110 |
| rs4760894 | Imputed | A | DOM | 771 | 0.6464 | 0.1598 | 0.4726 | 0.8841 | -2.731 | 0.006318 | 0.3076 | 0.44617 | 0.405523 | 0.478923 | 54 | 171 | 119 | 92 | 225 | 110 |
| rs4760894 | Imputed | T | GEN | 771 | | | | | 9.268 | 0.009717 | 0.3076 | 0.44617 | 0.405523 | 0.478923 | 54 | 171 | 119 | 92 | 225 | 110 |
| rs4760895 | Imputed | T | ADD | 771 | 0.7218 | 0.1078 | 0.5844 | 0.8916 | -3.025 | 0.002485 | 0.3076 | 0.44617 | 0.405523 | 0.478923 | 54 | 171 | 119 | 92 | 225 | 110 |
| rs4760895 | Imputed | A | DOM | 771 | 0.6464 | 0.1598 | 0.4726 | 0.8841 | -2.731 | 0.006318 | 0.3076 | 0.44617 | 0.405523 | 0.478923 | 54 | 171 | 119 | 92 | 225 | 110 |
| rs4760895 | Imputed | A | GEN | 771 | | | | | 9.268 | 0.009717 | 0.3076 | 0.44617 | 0.405523 | 0.478923 | 54 | 171 | 119 | 92 | 225 | 110 |
| rs4764738 | Imputed | A | ADD | 785 | 1.331 | 0.1042 | 1.085 | 1.633 | 2.742 | 0.0061 | 0.8865 | 0.49236 | 0.527143 | 0.464368 | 97 | 175 | 78 | 92 | 220 | 123 |
| rs4764738 | Imputed | A | GEN | 785 | | | | | 7.557 | 0.02286 | 0.8865 | 0.49236 | 0.527143 | 0.464368 | 97 | 175 | 78 | 92 | 220 | 123 |
| rs4764974 | Imputed | A | ADD | 796 | 1.322 | 0.1036 | 1.079 | 1.62 | 2.695 | 0.007028 | 0.8315 | 0.48995 | 0.523876 | 0.4625 | 97 | 179 | 80 | 92 | 223 | 125 |
| rs4764974 | Imputed | T | GEN | 796 | | | | | 7.298 | 0.02602 | 0.8315 | 0.48995 | 0.523876 | 0.4625 | 97 | 179 | 80 | 92 | 223 | 125 |
| rs4798366 | Imputed | G | REC | 780 | 1.597 | 0.2447 | 0.9889 | 2.58 | 1.915 | 0.05555 | 0.1069 | 0.33269 | 0.338109 | 0.328306 | 42 | 152 | 155 | 34 | 215 | 182 |
| rs483159 | Imputed | T | DOM | 718 | 1.425 | 0.1565 | 1.048 | 1.936 | 2.262 | 0.0237 | 0.6567 | 0.21379 | 0.236196 | 0.195153 | 16 | 122 | 188 | 19 | 115 | 258 |
| rs4836502 | Imputed | A | ADD | 800 | 1.446 | 0.1466 | 1.048 | 1.834 | 3.044 | 0.002335 | 0.8149 | 0.34563 | 0.317927 | 0.367946 | 44 | 139 | 174 | 53 | 220 | 170 |
| rs4836507 | Imputed | C | DOM | 791 | 0.6617 | 0.1473 | 0.4964 | 0.882 | -2.816 | 0.004859 | 0.6933 | 0.34324 | 0.316901 | 0.364679 | 44 | 137 | 174 | 52 | 214 | 170 |
| rs4836744 | Imputed | A | ADD | 797 | 0.6716 | 0.1117 | 0.5032 | 0.8964 | -2.703 | 0.006874 | 0.6748 | 0.30176 | 0.262712 | 0.332957 | 24 | 138 | 192 | 51 | 193 | 199 |
| rs4836744 | Imputed | A | DOM | 797 | 0.7163 | 0.144 | 0.5755 | 0.8916 | -2.988 | 0.002809 | 0.6748 | 0.30176 | 0.262712 | 0.332957 | 24 | 138 | 192 | 51 | 193 | 199 |
| rs4848944 | Geno- typed | C | REC | 800 | 0.6741 | 0.1744 | 0.4789 | 0.9488 | -2.261 | 0.02373 | 0.6208 | 0.48438 | 0.47619 | 0.490971 | 69 | 202 | 86 | 115 | 205 | 123 |
| rs4851529 | Imputed | A | DOM | 798 | 0.6968 | 0.1498 | 0.5195 | 0.9346 | -2.411 | 0.0159 | 0.883 | 0.40288 | 0.375 | 0.425339 | 54 | 159 | 143 | 74 | 228 | 140 |
| rs4851531 | Imputed | T | DOM | 785 | 0.7275 | 0.1515 | 0.5406 | 0.9789 | -2.101 | 0.03565 | 0.8825 | 0.40764 | 0.382184 | 0.427918 | 54 | 158 | 136 | 75 | 224 | 138 |
| rs4858046 | Geno- typed | T | GEN | 800 | | | | | 9.709 | 0.007792 | 0.544 | 0.37 | 0.406162 | 0.340858 | 62 | 166 | 129 | 43 | 216 | 184 |
| rs4878214 | Imputed | A | ADD | 628 | 0.5979 | 0.1405 | 0.454 | 0.7875 | -3.661 | 0.000252 | 0.5024 | 0.23248 | 0.181159 | 0.272727 | 8 | 84 | 184 | 29 | 134 | 189 |
| rs4880803 | Imputed | A | ADD | 789 | 0.7753 | 0.1121 | 0.6223 | 0.9658 | -2.27 | 0.02319 | 0.9344 | 0.31559 | 0.288352 | 0.337529 | 32 | 139 | 181 | 47 | 201 | 189 |
| rs489441 | Imputed | G | ADD | 748 | 1.446 | 0.1212 | 1.14 | 1.834 | 3.044 | 0.002335 | 0.4584 | 0.26939 | 0.307808 | 0.238554 | 27 | 151 | 155 | 23 | 152 | 240 |
| rs489441 | Imputed | G | DOM | 748 | 1.584 | 0.1496 | 1.181 | 2.123 | 3.074 | 0.002112 | 0.4584 | 0.26939 | 0.307808 | 0.238554 | 27 | 151 | 155 | 23 | 152 | 240 |
| rs4896568 | Imputed | T | DOM | 774 | 0.6713 | 0.1492 | 0.5011 | 0.8993 | -2.672 | 0.007546 | 0.4888 | 0.23902 | 0.208455 | 0.263341 | 18 | 107 | 218 | 30 | 167 | 234 |
| rs4938851 | Imputed | T | ADD | 800 | 1.543 | 0.1498 | 1.151 | 2.07 | 2.898 | 0.00376 | 0.4999 | 0.19563 | 0.222689 | 0.173815 | 12 | 135 | 210 | 15 | 124 | 304 |
| rs4964416 | Imputed | C | DOM | 799 | 0.598 | 0.1645 | 0.4332 | 0.8256 | -3.125 | 0.001776 | 0.1781 | 0.48123 | 0.442577 | 0.512443 | 71 | 174 | 112 | 104 | 245 | 93 |
| rs5756669 | Imputed | C | DOM | 800 | 1.724 | 0.1627 | 1.254 | 2.372 | 3.349 | 0.000812 | 0.6702 | 0.46375 | 0.504202 | 0.431151 | 85 | 190 | 82 | 90 | 202 | 151 |

TABLE 14-continued

| SNP rs # | SOURCE | AL-LELE (A1) | MOD-EL | NMISS | OR | SE | L95 | U95 | STAT | P | HW_PVA_LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs6033138 | Imputed | C | ADD | 796 | 1.371 | 0.105 | 1.116 | 1.685 | 3.008 | 0.002629 | 0.3261 | 0.37437 | 0.415493 | 0.34127 | 68 | 159 | 128 | 50 | 201 | 190 |
| rs6033138 | Imputed | C | GEN | 796 | | | | | 10.23 | 0.005998 | 0.3261 | 0.37437 | 0.415493 | 0.34127 | 68 | 159 | 128 | 50 | 201 | 190 |
| rs6033138 | Imputed | C | REC | 796 | 1.836 | 0.2034 | 1.232 | 2.736 | 2.987 | 0.002813 | 0.3261 | 0.37437 | 0.415493 | 0.34127 | 68 | 159 | 128 | 50 | 201 | 190 |
| rs6040619 | Imputed | C | ADD | 800 | 1.337 | 0.1054 | 1.088 | 1.644 | 2.757 | 0.005839 | 0.4439 | 0.36188 | 0.40056 | 0.3307 | 64 | 158 | 135 | 46 | 201 | 196 |
| rs6040619 | Imputed | C | GEN | 800 | | | | | 9.282 | 0.009648 | 0.4439 | 0.36188 | 0.40056 | 0.3307 | 64 | 158 | 135 | 46 | 201 | 196 |
| rs6040625 | Imputed | T | REC | 800 | 1.844 | 0.2095 | 1.223 | 2.78 | 2.92 | 0.003504 | 0.3996 | 0.36188 | 0.40056 | 0.329571 | 64 | 158 | 135 | 46 | 201 | 196 |
| rs6040625 | Imputed | T | ADD | 800 | 1.343 | 0.1053 | 1.093 | 1.651 | 2.802 | 0.005079 | 0.3996 | 0.36125 | 0.40056 | 0.329571 | 64 | 158 | 135 | 46 | 200 | 197 |
| rs6040625 | Imputed | T | GEN | 800 | | | | | 9.403 | 0.009081 | 0.3996 | 0.36125 | 0.40056 | 0.329571 | 64 | 158 | 135 | 46 | 200 | 197 |
| rs6040630 | Imputed | A | REC | 800 | 1.844 | 0.2095 | 1.223 | 2.78 | 2.92 | 0.003504 | 0.3996 | 0.36125 | 0.40056 | 0.329571 | 64 | 158 | 135 | 46 | 200 | 197 |
| rs6040630 | Imputed | A | ADD | 800 | 1.353 | 0.1061 | 1.099 | 1.666 | 2.854 | 0.004317 | 0.3983 | 0.35938 | 0.39916 | 0.327314 | 64 | 157 | 136 | 45 | 200 | 198 |
| rs6040630 | Imputed | A | GEN | 800 | | | | | 9.956 | 0.006888 | 0.3983 | 0.35938 | 0.39916 | 0.327314 | 64 | 157 | 136 | 45 | 200 | 198 |
| rs6040630 | Imputed | A | REC | 800 | 1.892 | 0.2107 | 1.252 | 2.859 | 3.026 | 0.002474 | 0.3983 | 0.35938 | 0.39916 | 0.327314 | 64 | 157 | 136 | 45 | 200 | 198 |
| rs6040633 | Imputed | A | ADD | 799 | 1.35 | 0.1061 | 1.096 | 1.662 | 2.826 | 0.004712 | 0.3986 | 0.35982 | 0.39916 | 0.328054 | 64 | 157 | 136 | 45 | 200 | 197 |
| rs6040633 | Imputed | A | GEN | 799 | | | | | 9.841 | 0.007297 | 0.3986 | 0.35982 | 0.39916 | 0.328054 | 64 | 157 | 136 | 45 | 200 | 197 |
| rs6040633 | Imputed | A | REC | 800 | 1.888 | 0.2106 | 1.249 | 2.853 | 3.016 | 0.002559 | 0.3983 | 0.35938 | 0.39916 | 0.327314 | 64 | 157 | 136 | 45 | 200 | 198 |
| rs6040634 | Imputed | T | ADD | 800 | 1.353 | 0.1061 | 1.099 | 1.666 | 2.854 | 0.004317 | 0.3983 | 0.35938 | 0.39916 | 0.327314 | 64 | 157 | 136 | 45 | 200 | 198 |
| rs6040634 | Imputed | T | GEN | 799 | | | | | 9.956 | 0.006888 | 0.3983 | 0.3592 | 0.39916 | 0.326923 | 64 | 157 | 136 | 45 | 199 | 198 |
| rs6040634 | Imputed | T | REC | 799 | 1.892 | 0.2107 | 1.252 | 2.859 | 3.026 | 0.002474 | 0.3574 | 0.3592 | 0.39916 | 0.326923 | 64 | 157 | 136 | 45 | 199 | 198 |
| rs6040636 | Imputed | T | ADD | 800 | 1.359 | 0.1061 | 1.103 | 1.673 | 2.888 | 0.00388 | 0.3574 | 0.3592 | 0.39916 | 0.326923 | 64 | 157 | 136 | 45 | 199 | 198 |
| rs6040636 | Imputed | T | GEN | 799 | | | | | 10.05 | 0.006571 | 0.3574 | 0.3592 | 0.39916 | 0.326923 | 64 | 157 | 136 | 45 | 199 | 198 |
| rs6040636 | Imputed | T | REC | 799 | 1.892 | 0.2107 | 1.252 | 2.859 | 3.027 | 0.002467 | 0.3983 | 0.35938 | 0.39916 | 0.327314 | 64 | 157 | 136 | 45 | 200 | 198 |
| rs6040638 | Imputed | C | ADD | 800 | 1.353 | 0.1061 | 1.099 | 1.666 | 2.854 | 0.004317 | 0.3983 | 0.35938 | 0.39916 | 0.327314 | 64 | 157 | 136 | 45 | 200 | 198 |
| rs6040638 | Imputed | C | GEN | 800 | | | | | 9.956 | 0.006888 | 0.3983 | 0.35938 | 0.39916 | 0.327314 | 64 | 157 | 136 | 45 | 200 | 198 |
| rs6040638 | Imputed | C | REC | 800 | 1.892 | 0.2107 | 1.252 | 2.859 | 3.026 | 0.002474 | 0.5346 | 0.35642 | 0.39916 | 0.327314 | 64 | 157 | 136 | 45 | 200 | 198 |
| rs6040644 | Imputed | A | ADD | 800 | 1.353 | 0.1061 | 1.099 | 1.666 | 2.854 | 0.004317 | 0.5346 | 0.35642 | 0.396011 | 0.327314 | 64 | 157 | 136 | 45 | 200 | 198 |
| rs6040644 | Imputed | A | GEN | 800 | | | | | 9.956 | 0.006888 | 0.5346 | 0.35642 | 0.396011 | 0.327314 | 64 | 157 | 136 | 45 | 200 | 198 |
| rs6040644 | Imputed | A | REC | 800 | 1.892 | 0.2107 | 1.252 | 2.859 | 3.026 | 0.002474 | 0.5346 | 0.35938 | 0.396011 | 0.327314 | 64 | 157 | 136 | 45 | 200 | 198 |
| rs6040667 | Imputed | T | ADD | 787 | 1.352 | 0.1076 | 1.095 | 1.67 | 2.804 | 0.005046 | 0.5346 | 0.35642 | 0.396011 | 0.324541 | 64 | 156 | 134 | 43 | 197 | 196 |
| rs6040667 | Imputed | T | GEN | 787 | | | | | 9.469 | 0.008785 | 0.5346 | 0.35642 | 0.396011 | 0.324541 | 61 | 156 | 134 | 43 | 197 | 196 |
| rs6040668 | Imputed | T | REC | 787 | 1.878 | 0.2152 | 1.232 | 2.864 | 2.93 | 0.003389 | 0.5346 | 0.35642 | 0.396011 | 0.324541 | 61 | 156 | 134 | 43 | 197 | 196 |
| rs6040668 | Imputed | T | ADD | 787 | 1.352 | 0.1076 | 1.095 | 1.67 | 2.804 | 0.005046 | 0.5346 | 0.35642 | 0.396011 | 0.324541 | 61 | 156 | 134 | 43 | 197 | 196 |
| rs6040668 | Imputed | T | GEN | 787 | | | | | 9.469 | 0.008785 | 0.5346 | 0.35642 | 0.396011 | 0.324541 | 61 | 156 | 134 | 43 | 197 | 196 |
| rs6040644 | Imputed | C | REC | 800 | 1.878 | 0.2152 | 1.232 | 2.864 | 2.93 | 0.003389 | 0.5346 | 0.35938 | 0.396011 | 0.324541 | 64 | 157 | 136 | 45 | 197 | 196 |
| rs6043066 | Geno-typed | G | DOM | 800 | 1.67 | 0.1467 | 1.253 | 2.227 | 3.497 | 0.000471 | 0.7679 | 0.235 | 0.268908 | 0.207675 | 19 | 154 | 184 | 23 | 138 | 282 |
| rs6048146 | Imputed | G | DOM | 800 | 2.46 | 0.3199 | 1.314 | 4.605 | 2.814 | 0.004893 | 0.00359 | 0.0375 | 0.04902 | 0.028217 | 1 | 33 | 323 | 4 | 17 | 422 |
| rs6082725 | Geno-typed | T | DOM | 800 | 2.46 | 0.3199 | 1.314 | 4.605 | 2.814 | 0.004893 | 0.00359 | 0.0375 | 0.04902 | 0.028217 | 1 | 33 | 323 | 4 | 17 | 422 |
| rs6131206 | Imputed | C | ADD | 778 | 1.252 | 0.1109 | 1.007 | 1.556 | 2.026 | 0.04277 | 0.4542 | 0.31362 | 0.343109 | 0.290618 | 45 | 144 | 152 | 36 | 182 | 219 |
| rs6131208 | Imputed | T | ADD | 788 | 1.358 | 0.1075 | 1.1 | 1.676 | 2.846 | 0.004434 | 0.5343 | 0.35596 | 0.396011 | 0.323799 | 61 | 156 | 134 | 43 | 197 | 197 |
| rs6131208 | Imputed | T | GEN | 788 | | | | | 9.654 | 0.008 | 0.5343 | 0.35596 | 0.396011 | 0.323799 | 61 | 156 | 134 | 43 | 197 | 197 |
| rs6134243 | Imputed | T | REC | 788 | 1.885 | 0.2151 | 1.237 | 2.874 | 2.948 | 0.0032 | 0.3983 | 0.35938 | 0.39916 | 0.327314 | 64 | 157 | 136 | 45 | 200 | 198 |
| rs6134243 | Imputed | C | ADD | 800 | 1.353 | 0.1061 | 1.099 | 1.666 | 2.854 | 0.004317 | 0.3983 | 0.35938 | 0.39916 | 0.327314 | 64 | 157 | 136 | 45 | 200 | 198 |
| rs6134243 | Imputed | C | GEN | 800 | | | | | 9.956 | 0.006888 | 0.3983 | 0.35938 | 0.39916 | 0.327314 | 64 | 157 | 136 | 45 | 200 | 198 |
| rs6134243 | Imputed | C | REC | 800 | 1.892 | 0.2107 | 1.252 | 2.859 | 3.026 | 0.002474 | 0.5335 | 0.17146 | 0.135854 | 0.200226 | 11 | 157 | 136 | 45 | 200 | 198 |
| rs6136020 | Imputed | A | DOM | 799 | 0.5431 | 0.1594 | 0.3974 | 0.7422 | -3.831 | 0.000128 | 0.5335 | 0.17146 | 0.135854 | 0.200226 | 11 | 75 | 271 | 15 | 147 | 280 |

TABLE 14-continued

| SNP rs # | SOURCE | AL-LELE (A1) | MOD-EL | NMISS | OR | SE | L95 | U95 | STAT | P | HW_PVA-LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs613799 | Imputed | C | DOM | 686 | 1.64 | 0.1564 | 1.207 | 2.228 | 3.161 | 0.00157 | 0.7076 | 0.28426 | 0.317434 | 0.257853 | 23 | 147 | 134 | 30 | 137 | 215 |
| rs644041 | Imputed | G | ADD | 736 | 1.415 | 0.1215 | 1.116 | 1.796 | 2.86 | 0.004237 | 0.5161 | 0.2731 | 0.309451 | 0.243873 | 27 | 149 | 152 | 24 | 151 | 233 |
| rs644041 | Imputed | G | DOM | 736 | 1.556 | 0.1508 | 1.158 | 2.092 | 2.932 | 0.003363 | 0.5161 | 0.2731 | 0.309451 | 0.243873 | 27 | 149 | 152 | 24 | 151 | 233 |
| rs647645 | Imputed | C | ADD | 796 | 0.6924 | 0.1019 | 0.567 | 0.8454 | -3.608 | 0.000308 | 0.08529 | 0.44284 | 0.391854 | 0.484091 | 58 | 163 | 135 | 110 | 206 | 124 |
| rs647645 | Imputed | C | GEN | 796 |  | 0.182 |  |  | 13.04 | 0.001476 | 0.08529 | 0.44284 | 0.391854 | 0.484091 | 58 | 163 | 135 | 110 | 206 | 124 |
| rs647645 | Imputed | C | REC | 796 | 0.5812 | 0.182 | 0.4068 | 0.8303 | -2.982 | 0.002867 | 0.08529 | 0.44284 | 0.391854 | 0.484091 | 58 | 163 | 135 | 110 | 206 | 124 |
| rs6495554 | Imputed | C | GEN | 800 |  | 0.4298 |  |  | 9.326 | 0.009436 | 0.9088 | 0.19063 | 0.215686 | 0.170429 | 20 | 114 | 223 | 8 | 135 | 300 |
| rs6495554 | Imputed | C | REC | 800 | 3.433 | 0.4298 | 1.478 | 7.972 | 2.87 | 0.004111 | 0.9088 | 0.19063 | 0.215686 | 0.170429 | 20 | 114 | 223 | 8 | 135 | 300 |
| rs6495555 | Imputed | C | GEN | 800 |  | 0.4298 |  |  | 9.326 | 0.009436 | 0.9088 | 0.19063 | 0.215686 | 0.170429 | 20 | 114 | 223 | 8 | 135 | 300 |
| rs6495555 | Imputed | C | REC | 800 | 3.433 | 0.4298 | 1.478 | 7.972 | 2.87 | 0.004111 | 0.9088 | 0.19063 | 0.215686 | 0.170429 | 20 | 114 | 223 | 8 | 135 | 300 |
| rs6544728 | Imputed | T | DOM | 794 | 1.526 | 0.1458 | 1.147 | 2.032 | 2.901 | 0.003725 | 0.01412 | 0.23678 | 0.266949 | 0.2125 | 16 | 157 | 181 | 16 | 155 | 269 |
| rs6550705 | Imputed | C | ADD | 800 | 1.366 | 0.1079 | 1.105 | 1.688 | 2.889 | 0.00386 | 0.6465 | 0.36313 | 0.403361 | 0.3307 | 60 | 168 | 129 | 42 | 209 | 192 |
| rs6550705 | Imputed | C | GEN | 800 |  | 0.1079 |  |  | 9.972 | 0.006832 | 0.6465 | 0.36313 | 0.403361 | 0.3307 | 60 | 168 | 129 | 42 | 209 | 192 |
| rs6550707 | Imputed | T | GEN | 797 |  |  |  |  | 9.958 | 0.00688 | 0.821 | 0.37641 | 0.412676 | 0.347285 | 65 | 163 | 127 | 46 | 215 | 181 |
| rs658108 | Imputed | A | DOM | 798 | 1.56 | 0.1448 | 1.174 | 2.071 | 3.069 | 0.002149 | 0.471 | 0.26817 | 0.296919 | 0.244898 | 23 | 166 | 168 | 30 | 156 | 255 |
| rs6593441 | Imputed | A | ADD | 785 | 1.577 | 0.1691 | 1.132 | 2.196 | 2.693 | 0.007076 | 0.7536 | 0.12994 | 0.152422 | 0.111751 | 7 | 93 | 251 | 7 | 83 | 344 |
| rs668732 | Imputed | A | DOM | 787 | 1.778 | 0.1671 | 1.281 | 2.467 | 3.444 | 0.000574 | 0.2538 | 0.48729 | 0.545455 | 0.44023 | 106 | 172 | 74 | 89 | 205 | 141 |
| rs671041 | Imputed | A | DOM | 798 | 1.56 | 0.1448 | 1.174 | 2.071 | 3.069 | 0.002149 | 0.471 | 0.26817 | 0.296919 | 0.244898 | 23 | 166 | 168 | 30 | 156 | 255 |
| rs6719700 | Imputed | A | ADD | 695 | 1.427 | 0.1498 | 1.064 | 1.914 | 2.374 | 0.01759 | 0.5793 | 0.16403 | 0.190323 | 0.142857 | 8 | 102 | 200 | 8 | 94 | 283 |
| rs6719700 | Imputed | A | DOM | 695 | 1.536 | 0.1676 | 1.106 | 2.133 | 2.559 | 0.01049 | 0.5793 | 0.16403 | 0.190323 | 0.142857 | 8 | 102 | 200 | 8 | 94 | 283 |
| rs6722640 | Imputed | T | DOM | 797 | 0.682 | 0.1502 | 0.5081 | 0.9154 | -2.548 | 0.01082 | 0.8836 | 0.40715 | 0.377465 | 0.430995 | 56 | 156 | 143 | 77 | 227 | 138 |
| rs6743092 | Imputed | T | ADD | 789 | 1.36 | 0.1049 | 1.108 | 1.671 | 2.935 | 0.003334 | 0.4767 | 0.4924 | 0.533803 | 0.458825 | 99 | 181 | 75 | 87 | 224 | 123 |
| rs6743092 | Imputed | T | GEN | 789 |  |  |  |  | 8.823 | 0.01214 | 0.4767 | 0.4924 | 0.533803 | 0.458825 | 99 | 181 | 75 | 87 | 224 | 123 |
| rs6744759 | Imputed | T | REC | 789 | 1.57 | 0.1704 | 1.124 | 2.192 | 2.646 | 0.008151 | 0.5987 | 0.28149 | 0.291785 | 0.273245 | 37 | 132 | 184 | 29 | 183 | 229 |
| rs6746170 | Imputed | G | REC | 794 | 1.692 | 0.2617 | 1.013 | 2.827 | 2.01 | 0.04442 | 0.0061 | 0.23839 | 0.269014 | 0.213801 | 16 | 159 | 180 | 15 | 159 | 268 |
| rs6759922 | Imputed | A | DOM | 797 | 1.528 | 0.1455 | 1.149 | 2.032 | 2.914 | 0.003568 | 0.8837 | 0.45526 | 0.420588 | 0.483333 | 65 | 156 | 119 | 91 | 224 | 105 |
| rs6769864 | Imputed | A | DOM | 760 | 0.6185 | 0.1611 | 0.451 | 0.8482 | -2.982 | 0.002863 | 0.5931 | 0.36375 | 0.415473 | 0.331828 | 60 | 168 | 125 | 42 | 210 | 191 |
| rs6773932 | Imputed | T | GEN | 800 |  |  |  |  | 9.838 | 0.007307 | 0.5414 | 0.37404 | 0.411932 | 0.343023 | 60 | 164 | 122 | 42 | 211 | 177 |
| rs6774353 | Imputed | C | GEN | 782 |  |  |  |  | 10.92 | 0.004251 | 0.5414 | 0.37404 | 0.411932 | 0.343023 | 63 | 164 | 125 | 42 | 211 | 177 |
| rs6781670 | Imputed | C | GEN | 782 |  |  |  |  | 10.92 | 0.004251 | 0.5414 | 0.37404 | 0.411932 | 0.343023 | 63 | 164 | 125 | 42 | 211 | 177 |
| rs6786431 | Imputed | A | GEN | 782 |  |  |  |  | 10.92 | 0.004251 | 0.5414 | 0.37404 | 0.411932 | 0.343023 | 63 | 164 | 125 | 42 | 211 | 177 |
| rs6789091 | Imputed | T | GEN | 757 |  |  |  |  | -2.889 | 0.00386 | 0.6116 | 0.12285 | 0.095588 | 0.145084 | 2 | 61 | 277 | 11 | 99 | 307 |
| rs6791296 | Imputed | T | ADD | 792 | 0.6225 | 0.164 | 0.4514 | 0.8586 | -2.889 | 0.000678 | 0.8868 | 0.52588 | 0.557746 | 0.5 | 100 | 196 | 59 | 120 | 197 | 120 |
| rs6792662 | Imputed | G | DOM | 782 | 1.844 | 0.1801 | 1.296 | 2.624 | 3.398 | 0.000678 | 0.5414 | 0.37404 | 0.411932 | 0.343023 | 63 | 164 | 125 | 42 | 211 | 177 |
| rs6797574 | Imputed | G | GEN | 782 |  |  |  |  | 10.92 | 0.004251 | 0.5414 | 0.37693 | 0.415473 | 0.345433 | 63 | 164 | 122 | 42 | 211 | 174 |
| rs6797882 | Imputed | G | GEN | 776 |  |  |  |  | 11.03 | 0.004027 | 0.4454 | 0.50439 | 0.539216 | 0.476136 | 95 | 195 | 67 | 110 | 199 | 131 |
| rs6805139 | Imputed | G | DOM | 797 | 1.812 | 0.1727 | 1.292 | 2.542 | 3.442 | 0.000577 | 0.7769 | 0.36313 | 0.403361 | 0.3307 | 60 | 168 | 129 | 42 | 209 | 192 |
| rs6806043 | Imputed | G | ADD | 800 | 1.366 | 0.1079 | 1.105 | 1.688 | 2.889 | 0.00386 | 0.6465 | 0.36313 | 0.403361 | 0.3307 | 60 | 168 | 129 | 42 | 209 | 192 |
| rs6806043 | Imputed | C | GEN | 799 |  |  |  |  | 9.972 | 0.006832 | 0.6465 | 0.36313 | 0.403361 | 0.3307 | 60 | 168 | 129 | 42 | 209 | 192 |
| rs6850716 | Imputed | C | GEN | 795 |  |  |  |  | 12.52 | 0.001916 | 0.7677 | 0.23467 | 0.270308 | 0.205882 | 29 | 135 | 193 | 13 | 156 | 273 |
| rs6867153 | Imputed | A | REC | 800 | 0.528 | 0.177 | 0.3733 | 0.7469 | -3.609 | 0.000307 | 1 | 0.48805 | 0.44051 | 0.526018 | 62 | 187 | 104 | 127 | 211 | 104 |
| rs687047 | Imputed | C | ADD | 800 | 0.6526 | 0.1561 | 0.4806 | 0.8861 | -2.734 | 0.006248 | 0.2074 | 0.12813 | 0.102241 | 0.148984 | 2 | 69 | 286 | 15 | 102 | 326 |
| rs6871041 | Imputed | G | GEN | 666 | 0.6 | 0.1598 |  |  | -3.196 | 0.001391 | 0.6287 | 0.27628 | 0.239057 | 0.306233 | 20 | 102 | 175 | 28 | 170 | 171 |
| rs688358 | Imputed | A | ADD | 795 | 0.6534 | 0.156 | 0.4812 | 0.8872 | -2.727 | 0.006386 | 0.2666 | 0.12893 | 0.103107 | 0.14966 | 2 | 69 | 283 | 15 | 102 | 324 |
| rs6888012 | Imputed | A | REC | 795 | 0.528 | 0.177 | 0.3733 | 0.7469 | -3.609 | 0.000307 | 1 | 0.48805 | 0.44051 | 0.526018 | 62 | 187 | 104 | 127 | 211 | 104 |

TABLE 14-continued

| SNP rs # | SOURCE | AL-LELE (A1) | MOD-EL | NMISS | OR | SE | L95 | U95 | STAT | P | HW_PVALUE | AL-LELE FREQ | PRA-VA_AL-LELE FREQ | PLA-CEBO_AL-LELE FREQ | PRA-VA_A1_HZ_COUNT | PRA-VA_HET_COUNT | PRA-VA_A2_HZ_COUNT | PLA-CEBO_A1_HZ_COUNT | PLA-CEBO_HET_COUNT | PLA-CEBO_A2_HZ_COUNT |
|---|---|---|---|---|---|---|---|---|---|---|---|---|---|---|---|---|---|---|---|---|
| rs6908481 | Imputed | C | REC | 784 | 1.96 | 0.1947 | 1.338 | 2.871 | 3.458 | 0.000545 | 0.2049 | 0.39796 | 0.438395 | 0.365517 | 77 | 152 | 120 | 56 | 206 | 173 |
| rs7032231 | Imputed | A | ADD | 789 | 1.212 | 0.1105 | 0.9756 | 1.504 | 1.737 | 0.08246 | 0.3821 | 0.33714 | 0.357955 | 0.320366 | 40 | 172 | 140 | 44 | 192 | 201 |
| rs7067638 | Imputed | T | DOM | 795 | 1.6 | 0.1731 | 1.14 | 2.247 | 2.717 | 0.00659 | 0.4039 | 0.12075 | 0.142655 | 0.103175 | 7 | 87 | 260 | 7 | 77 | 357 |
| rs7077799 | Imputed | A | DOM | 745 | 1.625 | 0.1513 | 1.208 | 2.185 | 3.208 | 0.001335 | 0.9311 | 0.3047 | 0.33689 | 0.279376 | 30 | 161 | 137 | 38 | 157 | 222 |
| rs7082163 | Imputed | A | ADD | 800 | 1.58 | 0.1552 | 1.166 | 2.142 | 2.948 | 0.003195 | 0.4017 | 0.12 | 0.145658 | 0.099323 | 8 | 88 | 261 | 6 | 76 | 361 |
| rs7082163 | Imputed | A | DOM | 800 | 1.684 | 0.1729 | 1.2 | 2.364 | 3.014 | 0.002574 | 0.4017 | 0.12 | 0.145658 | 0.099323 | 8 | 88 | 261 | 6 | 76 | 361 |
| rs7089661 | Imputed | C | DOM | 800 | 1.62 | 0.1448 | 1.22 | 2.152 | 3.335 | 0.000854 | 0.9322 | 0.29313 | 0.32493 | 0.267494 | 30 | 172 | 155 | 38 | 161 | 244 |
| rs7101319 | Imputed | C | ADD | 797 | 1.567 | 0.1554 | 1.156 | 2.125 | 2.891 | 0.003836 | 0.3994 | 0.11982 | 0.14507 | 0.099548 | 8 | 87 | 260 | 6 | 76 | 360 |
| rs7101319 | Imputed | C | DOM | 797 | 1.667 | 0.1733 | 1.187 | 2.341 | 2.95 | 0.003178 | 0.3994 | 0.11982 | 0.14507 | 0.099548 | 8 | 87 | 260 | 6 | 76 | 360 |
| rs710832 | Imputed | A | GEN | 800 | | | | | 10.04 | 0.006605 | 0.2223 | 0.25125 | 0.232493 | 0.266366 | 14 | 138 | 205 | 43 | 150 | 250 |
| rs710832 | Geno-typed | A | REC | 800 | 0.3805 | 0.3178 | 0.2041 | 0.7092 | -3.041 | 0.002357 | 0.2223 | 0.25125 | 0.232493 | 0.266366 | 14 | 138 | 205 | 43 | 150 | 250 |
| rs7134262 | Imputed | T | GEN | 796 | | | | | 18.44 | 9.88E-05 | 0.8191 | 0.36621 | 0.394958 | 0.342825 | 67 | 148 | 142 | 38 | 225 | 176 |
| rs7134262 | Imputed | T | REC | 796 | 2.449 | 0.2188 | 1.595 | 3.76 | 4.092 | 4.27E-05 | 0.8191 | 0.36621 | 0.394958 | 0.342825 | 67 | 148 | 142 | 38 | 225 | 176 |
| rs7134671 | Imputed | T | GEN | 786 | | | | | 6.843 | 0.03266 | 0.7059 | 0.38168 | 0.416193 | 0.353687 | 63 | 167 | 122 | 54 | 199 | 181 |
| rs7138300 | Imputed | C | ADD | 771 | 0.7218 | 0.1078 | 0.5844 | 0.8916 | -3.025 | 0.002485 | 0.3076 | 0.44617 | 0.405523 | 0.478923 | 54 | 171 | 119 | 92 | 225 | 110 |
| rs7138300 | Imputed | C | DOM | 771 | 0.6464 | 0.1598 | 0.4726 | 0.8841 | -2.731 | 0.006318 | 0.3076 | 0.44617 | 0.405523 | 0.478923 | 54 | 171 | 119 | 92 | 225 | 110 |
| rs7138300 | Imputed | C | GEN | 771 | | | | | 9.268 | 0.009717 | 0.3076 | 0.44617 | 0.405523 | 0.478923 | 54 | 171 | 119 | 92 | 225 | 110 |
| rs7163931 | Imputed | G | GEN | 800 | | | | | 9.326 | 0.009436 | 0.9088 | 0.19063 | 0.215686 | 0.170429 | 20 | 114 | 223 | 8 | 135 | 300 |
| rs7163931 | Imputed | G | REC | 800 | 3.433 | 0.4298 | 1.478 | 7.972 | 2.87 | 0.004111 | 0.9088 | 0.19063 | 0.215686 | 0.170429 | 20 | 114 | 223 | 8 | 135 | 300 |
| rs7171486 | Geno-typed | G | DOM | 800 | 0.7681 | 0.1448 | 0.5783 | 1.02 | -1.821 | 0.06855 | 0.04585 | 0.35875 | 0.343137 | 0.371332 | 54 | 137 | 166 | 62 | 205 | 176 |
| rs7172611 | Imputed | G | GEN | 800 | | | | | 9.499 | 0.008657 | 0.9089 | 0.19125 | 0.217087 | 0.170429 | 20 | 115 | 222 | 8 | 135 | 300 |
| rs7172611 | Imputed | G | REC | 800 | 3.433 | 0.4298 | 1.478 | 7.972 | 2.87 | 0.004111 | 0.9089 | 0.19125 | 0.217087 | 0.170429 | 20 | 115 | 222 | 8 | 135 | 300 |
| rs7172689 | Imputed | T | GEN | 800 | | | | | 9.499 | 0.008657 | 0.9089 | 0.19125 | 0.217087 | 0.170429 | 20 | 115 | 222 | 8 | 135 | 300 |
| rs7172689 | Imputed | T | REC | 800 | 3.433 | 0.4298 | 1.478 | 7.972 | 2.87 | 0.004111 | 0.9089 | 0.19125 | 0.217087 | 0.170429 | 20 | 115 | 222 | 8 | 135 | 300 |
| rs7175701 | Imputed | C | GEN | 799 | | | | | 8.043 | 0.01793 | 1 | 0.20901 | 0.231742 | 0.190745 | 23 | 119 | 214 | 12 | 145 | 286 |
| rs7180245 | Imputed | A | GEN | 800 | | | | | 9.499 | 0.008657 | 0.9089 | 0.19125 | 0.217087 | 0.170429 | 20 | 115 | 222 | 8 | 135 | 300 |
| rs7180245 | Imputed | A | REC | 800 | 3.433 | 0.4298 | 1.478 | 7.972 | 2.87 | 0.004111 | 0.9089 | 0.19125 | 0.217087 | 0.170429 | 20 | 115 | 222 | 8 | 135 | 300 |
| rs7220603 | Imputed | A | ADD | 800 | 0.7182 | 0.1147 | 0.5737 | 0.8992 | -2.886 | 0.003898 | 0.9321 | 0.29375 | 0.257703 | 0.327799 | 22 | 140 | 195 | 46 | 194 | 203 |
| rs7283476 | Imputed | T | ADD | 673 | 1.688 | 0.1538 | 1.249 | 2.283 | 3.405 | 0.000662 | 0.08317 | 0.17608 | 0.213816 | 0.144986 | 11 | 108 | 185 | 3 | 101 | 265 |
| rs7283476 | Imputed | T | DOM | 800 | 0.3701 | 0.3146 | 0.1998 | 0.6857 | -3.159 | 0.001582 | 0.3047 | 0.0375 | 0.019608 | 0.051919 | 1 | 12 | 344 | 1 | 44 | 398 |
| rs7295817 | Imputed | T | DOM | 795 | 0.3345 | 0.3297 | 0.1753 | 0.6385 | -3.321 | 0.000898 | 0.3047 | 0.0375 | 0.019608 | 0.051919 | 1 | 12 | 344 | 1 | 44 | 398 |
| rs7298255 | Imputed | C | ADD | 800 | | | | | 10.28 | 0.005851 | 0.2702 | 0.40377 | 0.359551 | 0.439636 | 46 | 164 | 146 | 91 | 204 | 144 |
| rs7298255 | Imputed | A | DOM | 800 | 0.7363 | 0.1048 | 0.5997 | 0.9041 | -2.922 | 0.003477 | 0.4767 | 0.45875 | 0.420168 | 0.489842 | 63 | 174 | 120 | 100 | 234 | 109 |
| rs7305832 | Imputed | A | GEN | 798 | 0.6348 | 0.1584 | 0.4654 | 0.8659 | -2.87 | 0.004111 | 0.4767 | 0.36529 | 0.394958 | 0.34127 | 63 | 174 | 120 | 100 | 234 | 109 |
| rs7305832 | Imputed | C | REC | 800 | 2.46 | 0.2188 | 1.602 | 3.777 | 18.44 | 9.88E-05 | 0.8787 | 0.36529 | 0.394958 | 0.34127 | 67 | 148 | 142 | 38 | 225 | 178 |
| rs7331467 | Imputed | A | GEN | 800 | | | | | 4.113 | 3.91E-05 | 0.8787 | 0.32813 | 0.379552 | 0.286682 | 52 | 167 | 138 | 42 | 225 | 178 |
| rs7392620 | Imputed | C | ADD | 783 | 0.7778 | 0.1122 | 0.6242 | 0.9691 | 15.12 | 0.00052 | 0.2006 | 0.31034 | 0.282857 | 0.332564 | 31 | 136 | 183 | 47 | 170 | 231 |
| rs742827 | Imputed | A | ADD | 727 | 1.41 | 0.1113 | 1.134 | 1.754 | -2.239 | 0.02513 | 0.6765 | 0.37345 | 0.419255 | 0.337037 | 61 | 148 | 113 | 43 | 194 | 192 |
| rs742827 | Imputed | A | GEN | 727 | | | | | 3.087 | 0.002021 | 0.692 | 0.37345 | 0.419255 | 0.337037 | 61 | 148 | 113 | 43 | 187 | 175 |
| rs742827 | Imputed | A | REC | 727 | 1.914 | 0.2166 | 1.252 | 2.926 | 10.58 | 0.005035 | 0.692 | 0.37345 | 0.419255 | 0.337037 | 61 | 148 | 113 | 43 | 187 | 175 |
| rs7446891 | Imputed | G | DOM | 800 | 0.6617 | 0.1466 | 0.4964 | 0.882 | 2.998 | 0.002718 | 0.8149 | 0.34563 | 0.317927 | 0.367946 | 44 | 139 | 174 | 53 | 220 | 170 |

TABLE 14-continued

| SNP rs # | SOURCE | AL-LELE (A1) | MOD-EL | NMISS | OR | SE | L95 | U95 | STAT | P | HW_PVA-LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs7448641 | Imputed | C | ADD | 800 | 0.2198 | 0.3906 | 0.1022 | 0.4726 | -3.878 | 0.000105 | 0.0147 | 0.03563 | 0.015406 | 0.051919 | 0 | 11 | 346 | 4 | 38 | 401 |
| rs7448641 | Imputed | C | DOM | 800 | 0.2258 | 0.4052 | 0.102 | 0.4995 | -3.673 | 0.00024 | 0.0147 | 0.03563 | 0.015406 | 0.051919 | 0 | 11 | 346 | 4 | 38 | 401 |
| rs7484728 | Imputed | T | GEN | 788 | 1.746 | 0.1907 | 1.202 | 2.538 | 6.971 | 0.03064 | 0.7064 | 0.38135 | 0.416193 | 0.353211 | 63 | 167 | 122 | 54 | 200 | 182 |
| rs7499402 | Geno-typed | A | ADD | 800 | | | | | 2.924 | 0.00346 | 0.8111 | 0.08125 | 0.103641 | 0.063205 | 4 | 66 | 287 | 0 | 56 | 387 |
| rs7529851 | Imputed | A | ADD | 800 | 0.7957 | 0.1062 | 0.6462 | 0.9799 | -2.151 | 0.03144 | 0.1689 | 0.4225 | 0.393557 | 0.445824 | 48 | 185 | 124 | 85 | 225 | 133 |
| rs7529851 | Imputed | A | GEN | 800 | | | | | 5.275 | 0.07153 | 0.1689 | 0.4225 | 0.393557 | 0.445824 | 48 | 185 | 124 | 85 | 225 | 133 |
| rs7573951 | Imputed | G | ADD | 799 | 0.7174 | 0.1085 | 0.5799 | 0.8874 | -3.06 | 0.002211 | 0.7083 | 0.38235 | 0.341292 | 0.41535 | 41 | 161 | 154 | 73 | 222 | 148 |
| rs7599198 | Imputed | T | DOM | 717 | 0.6201 | 0.1648 | 0.4489 | 0.8565 | -2.9 | 0.003737 | 0.8207 | 0.447 | 0.410938 | 0.476071 | 60 | 143 | 117 | 85 | 208 | 104 |
| rs7600050 | Imputed | C | ADD | 763 | 1.294 | 0.1099 | 1.043 | 1.605 | 2.343 | 0.01915 | 0.6944 | 0.3578 | 0.391496 | 0.330569 | 49 | 169 | 123 | 46 | 187 | 189 |
| rs7607712 | Imputed | T | DOM | 784 | 1.401 | 0.1287 | 1.088 | 1.803 | 2.618 | 0.008843 | 0.3346 | 0.2111 | 0.241477 | 0.186343 | 17 | 136 | 199 | 13 | 135 | 284 |
| rs7607712 | Imputed | T | DOM | 784 | 1.477 | 0.1494 | 1.102 | 1.979 | 2.609 | 0.009089 | 0.3346 | 0.2111 | 0.241477 | 0.186343 | 17 | 136 | 199 | 13 | 135 | 284 |
| rs7613492 | Imputed | G | GEN | 792 | | | | | 9.987 | 0.006783 | 0.6445 | 0.36111 | 0.400568 | 0.329545 | 59 | 164 | 129 | 41 | 208 | 191 |
| rs7621663 | Imputed | G | ADD | 749 | 1.413 | 0.113 | 1.132 | 1.763 | 3.057 | 0.002237 | 0.6276 | 0.34312 | 0.386228 | 0.308434 | 53 | 152 | 129 | 32 | 192 | 191 |
| rs7621663 | Imputed | G | GEN | 749 | | | | | 12.37 | 0.002057 | 0.6276 | 0.34312 | 0.386228 | 0.308434 | 53 | 152 | 129 | 32 | 192 | 191 |
| rs7621663 | Imputed | G | REC | 749 | 2.257 | 0.239 | 1.413 | 3.606 | 3.406 | 0.000658 | 0.6111 | 0.34312 | 0.386228 | 0.308434 | 53 | 152 | 129 | 32 | 192 | 191 |
| rs7626584 | Imputed | G | ADD | 799 | 0.4778 | 0.2123 | 0.3152 | 0.7244 | -3.478 | 0.000505 | 0.03097 | 0.07384 | 0.047619 | 0.095023 | 1 | 32 | 324 | 4 | 76 | 362 |
| rs7684899 | Imputed | C | ADD | 800 | 0.7138 | 0.1326 | 0.5504 | 0.9257 | -2.542 | 0.01103 | 0.03097 | 0.20625 | 0.179272 | 0.227991 | 10 | 108 | 239 | 14 | 174 | 255 |
| rs7684899 | Imputed | C | DOM | 800 | 0.6634 | 0.1489 | 0.4955 | 0.8883 | -2.756 | 0.005859 | 0.0147 | 0.20625 | 0.179272 | 0.227991 | 10 | 108 | 239 | 14 | 174 | 255 |
| rs7701604 | Imputed | G | ADD | 800 | 0.2258 | 0.3906 | 0.1022 | 0.4726 | -3.878 | 0.000105 | 0.0147 | 0.03563 | 0.015406 | 0.051919 | 0 | 11 | 346 | 4 | 38 | 401 |
| rs7703676 | Imputed | G | ADD | 800 | 0.2258 | 0.4052 | 0.102 | 0.4995 | -3.673 | 0.00024 | 0.0147 | 0.03563 | 0.015406 | 0.051919 | 0 | 11 | 346 | 4 | 38 | 401 |
| rs7703676 | Imputed | C | REC | 797 | 0.5462 | 0.1754 | 0.3873 | 0.7703 | -3.448 | 0.000565 | 1 | 0.48934 | 0.443662 | 0.526018 | 64 | 187 | 104 | 127 | 211 | 104 |
| rs7708491 | Imputed | C | DOM | 797 | 0.6489 | 0.1462 | 0.4872 | 0.8644 | -2.957 | 0.003109 | 0.7533 | 0.34316 | 0.314607 | 0.366213 | 44 | 136 | 176 | 52 | 219 | 170 |
| rs7711358 | Imputed | A | REC | 796 | 0.525 | 0.1769 | 0.3712 | 0.7425 | -3.643 | 0.000269 | 1 | 0.48807 | 0.440678 | 0.526018 | 62 | 188 | 104 | 127 | 211 | 104 |
| rs7719448 | Imputed | G | REC | 795 | 0.528 | 0.177 | 0.3733 | 0.7469 | -3.609 | 0.000307 | 1 | 0.48805 | 0.44051 | 0.526018 | 62 | 187 | 104 | 127 | 211 | 104 |
| rs7724761 | Imputed | T | DOM | 734 | 1.752 | 0.1551 | 1.293 | 2.374 | 3.615 | 0.0003 | 0.1575 | 0.21662 | 0.255319 | 0.185185 | 20 | 128 | 181 | 21 | 108 | 276 |
| rs7742476 | Imputed | T | ADD | 797 | 1.568 | 0.1276 | 1.221 | 2.013 | 3.524 | 0.000425 | 0.3626 | 0.19322 | 0.232394 | 0.161765 | 17 | 131 | 207 | 17 | 109 | 316 |
| rs7762993 | Imputed | A | DOM | 797 | 1.808 | 0.1517 | 1.343 | 2.434 | 3.904 | 9.47E-05 | 0.3626 | 0.19322 | 0.232394 | 0.161765 | 17 | 131 | 207 | 17 | 109 | 316 |
| rs7767265 | Imputed | G | ADD | 794 | 1.626 | 0.1195 | 1.287 | 2.056 | 4.068 | 4.74E-05 | 0.1075 | 0.22922 | 0.27762 | 0.190476 | 23 | 142 | 184 | 23 | 122 | 296 |
| rs7767265 | Imputed | G | DOM | 794 | 1.904 | 0.1484 | 1.424 | 2.547 | 4.34 | 1.43E-05 | 0.1075 | 0.22922 | 0.27762 | 0.190476 | 23 | 142 | 184 | 23 | 122 | 296 |
| rs7768128 | Imputed | G | REC | 768 | 0.3796 | 0.3438 | 0.1935 | 0.7448 | -2.817 | 0.004846 | 0.2237 | 0.23112 | 0.222063 | 0.238663 | 12 | 131 | 206 | 35 | 130 | 254 |
| rs7771264 | Imputed | T | DOM | 769 | 0.6735 | 0.1496 | 0.5024 | 0.9029 | -2.643 | 0.008215 | 0.5527 | 0.23927 | 0.209677 | 0.26285 | 18 | 107 | 216 | 29 | 167 | 232 |
| rs7773151 | Geno-typed | C | DOM | 800 | 0.6804 | 0.1475 | 0.5096 | 0.9086 | -2.61 | 0.009059 | 0.3706 | 0.23063 | 0.20028 | 0.255079 | 17 | 109 | 231 | 30 | 166 | 247 |
| rs7773210 | Geno-typed | A | DOM | 800 | 0.6745 | 0.1474 | 0.5052 | 0.9004 | -2.672 | 0.007537 | 0.4259 | 0.23125 | 0.20028 | 0.256208 | 17 | 109 | 231 | 30 | 167 | 246 |
| rs7808536 | Imputed | G | DOM | 793 | 1.395 | 0.1494 | 1.041 | 1.87 | 2.231 | 0.02571 | 0.5044 | 0.19924 | 0.21875 | 0.183673 | 11 | 132 | 209 | 17 | 128 | 296 |
| rs7843510 | Geno-typed | G | DOM | 800 | 1.623 | 0.1544 | 1.199 | 2.197 | 3.137 | 0.001708 | 0.6638 | 0.42125 | 0.446779 | 0.400677 | 63 | 193 | 101 | 82 | 191 | 170 |
| rs7894867 | Imputed | T | DOM | 795 | 1.6 | 0.1731 | 1.14 | 2.247 | 2.717 | 0.006659 | 0.4039 | 0.12075 | 0.142655 | 0.103175 | 7 | 87 | 260 | 7 | 77 | 357 |
| rs7921834 | Imputed | C | DOM | 798 | 1.614 | 0.1449 | 1.215 | 2.144 | 3.304 | 0.000953 | 0.8644 | 0.29261 | 0.32493 | 0.26644 | 30 | 172 | 155 | 37 | 161 | 243 |
| rs7939893 | Imputed | C | ADD | 792 | 0.7358 | 0.1051 | 0.5988 | 0.904 | -2.92 | 0.003502 | 0.01403 | 0.33965 | 0.3 | 0.371854 | 38 | 137 | 180 | 69 | 187 | 181 |
| rs7939893 | Imputed | C | DOM | 792 | 0.6755 | 0.145 | 0.5084 | 0.8976 | -2.705 | 0.006832 | 0.01403 | 0.33965 | 0.3 | 0.371854 | 38 | 137 | 180 | 69 | 187 | 181 |
| rs7944513 | Imputed | T | GEN | 790 | | | | | 13.06 | 0.001463 | 0.5615 | 0.24304 | 0.271307 | 0.22032 | 31 | 129 | 192 | 12 | 169 | 257 |

TABLE 14-continued

| SNP rs # | SOURCE | AL-LELE (A1) | MOD-EL | NMISS | OR | SE | L95 | U95 | STAT | P | HW_PVA_LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs7944513 | Imputed | T | REC | 790 | 3.574 | 0.3533 | 1.788 | 7.143 | 3.605 | 0.000313 | 0.5615 | 0.24304 | 0.271307 | 0.22032 | 31 | 129 | 192 | 12 | 169 | 257 |
| rs7949720 | Imputed | G | ADD | 756 | 0.57 | 0.1619 | 0.415 | 0.7828 | −3.472 | 0.000516 | 0.8773 | 0.13624 | 0.102985 | 0.162708 | 5 | 59 | 271 | 8 | 121 | 292 |
| rs7949720 | Imputed | G | DOM | 756 | 0.5191 | 0.1768 | 0.3671 | 0.7341 | −3.708 | 0.000209 | 0.8773 | 0.13624 | 0.102985 | 0.162708 | 5 | 59 | 271 | 8 | 121 | 292 |
| rs7955901 | Imputed | C | ADD | 786 | 0.7383 | 0.1058 | 0.6 | 0.9085 | −2.867 | 0.004143 | 0.389 | 0.4542 | 0.416193 | 0.485023 | 60 | 173 | 119 | 96 | 229 | 109 |
| rs7955901 | Imputed | C | DOM | 786 | 0.6461 | 0.1592 | 0.4729 | 0.8826 | −2.744 | 0.006061 | 0.389 | 0.4542 | 0.416193 | 0.485023 | 60 | 173 | 119 | 96 | 229 | 109 |
| rs7956274 | Imputed | T | ADD | 795 | 0.7286 | 0.1054 | 0.5926 | 0.8957 | −3.005 | 0.002655 | 0.4324 | 0.46101 | 0.421127 | 0.493182 | 63 | 173 | 119 | 100 | 234 | 106 |
| rs7956274 | Imputed | T | DOM | 795 | 0.6184 | 0.1596 | 0.4523 | 0.8456 | −3.011 | 0.002605 | 0.4324 | 0.46101 | 0.421127 | 0.493182 | 63 | 173 | 119 | 100 | 234 | 106 |
| rs7956274 | Imputed | T | GEN | 795 |  |  |  |  | 9.858 | 0.007235 | 0.4324 | 0.46101 | 0.421127 | 0.493182 | 63 | 173 | 119 | 100 | 234 | 106 |
| rs7957932 | Imputed | G | ADD | 796 | 0.7518 | 0.1046 | 0.6125 | 0.9228 | −2.729 | 0.006355 | 0.5703 | 0.47173 | 0.435211 | 0.501134 | 69 | 171 | 115 | 104 | 234 | 103 |
| rs7957932 | Imputed | G | DOM | 796 | 0.6254 | 0.1609 | 0.4562 | 0.8572 | −2.918 | 0.003526 | 0.5703 | 0.47173 | 0.435211 | 0.501134 | 69 | 171 | 115 | 104 | 234 | 103 |
| rs7984504 | Imputed | C | GEN | 800 |  |  |  |  | 11.72 | 0.002847 | 0.1757 | 0.2975 | 0.341737 | 0.261851 | 45 | 154 | 158 | 34 | 164 | 245 |
| rs7999518 | Imputed | A | REC | 738 | 0.6515 | 0.1778 | 0.4598 | 0.9232 | −2.409 | 0.01598 | 0.2381 | 0.48238 | 0.459877 | 0.5 | 65 | 168 | 91 | 115 | 184 | 115 |
| rs8026245 | Imputed | G | GEN | 778 |  |  |  |  | 8.696 | 0.01294 | 1 | 0.20373 | 0.227666 | 0.184455 | 22 | 114 | 211 | 10 | 139 | 282 |
| rs8026245 | Imputed | G | REC | 778 | 3.097 | 0.3961 | 1.425 | 6.731 | 2.854 | 0.004317 | 1 | 0.20373 | 0.227666 | 0.184455 | 22 | 114 | 211 | 10 | 139 | 282 |
| rs8060725 | Geno-typed | A | ADD | 800 | 0.7255 | 0.1166 | 0.5772 | 0.9118 | −2.752 | 0.005931 | 0.09267 | 0.30125 | 0.266106 | 0.329571 | 18 | 154 | 185 | 44 | 204 | 195 |
| rs8103016 | Geno-typed | A | ADD | 800 | 1.537 | 0.1267 | 1.199 | 1.97 | 3.391 | 0.000697 | 0.5109 | 0.2025 | 0.239496 | 0.172686 | 22 | 127 | 208 | 14 | 125 | 304 |
| rs8103016 | Geno-typed | A | DOM | 800 | 1.604 | 0.1508 | 1.194 | 2.156 | 3.135 | 0.001718 | 0.5109 | 0.2025 | 0.239496 | 0.172686 | 22 | 127 | 208 | 14 | 125 | 304 |
| rs8104182 | Imputed | G | ADD | 799 | 1.45 | 0.1279 | 1.129 | 1.863 | 2.906 | 0.00366 | 0.4289 | 0.19462 | 0.226124 | 0.1693 | 20 | 121 | 215 | 14 | 122 | 307 |
| rs8104182 | Imputed | G | DOM | 799 | 1.504 | 0.1519 | 1.117 | 2.025 | 2.686 | 0.007239 | 0.4289 | 0.19462 | 0.226124 | 0.1693 | 20 | 121 | 215 | 14 | 122 | 307 |
| rs8129461 | Imputed | G | ADD | 800 | 0.3701 | 0.3146 | 0.1998 | 0.6857 | −3.159 | 0.001582 | 0.3047 | 0.0375 | 0.019608 | 0.051919 | 1 | 12 | 344 | 1 | 44 | 398 |
| rs8129461 | Imputed | G | DOM | 800 | 0.3701 | 0.3146 | 0.1998 | 0.6857 | −3.321 | 0.000898 | 0.3047 | 0.0375 | 0.019608 | 0.051919 | 1 | 12 | 344 | 1 | 44 | 398 |
| rs8130021 | Imputed | G | ADD | 800 | 0.3345 | 0.3297 | 0.1753 | 0.6385 | −3.159 | 0.001582 | 0.3047 | 0.0375 | 0.019608 | 0.051919 | 1 | 12 | 344 | 1 | 44 | 398 |
| rs8130021 | Imputed | G | DOM | 800 | 0.3345 | 0.3297 | 0.1753 | 0.6385 | −3.321 | 0.000898 | 0.3047 | 0.0375 | 0.019608 | 0.051919 | 1 | 12 | 344 | 1 | 44 | 398 |
| rs879961 | Imputed | T | ADD | 791 | 0.6288 | 0.1219 | 0.4951 | 0.7985 | −3.805 | 0.000142 | 0.8526 | 0.2579 | 0.210826 | 0.295455 | 14 | 120 | 217 | 37 | 186 | 217 |
| rs879961 | Imputed | T | DOM | 791 | 0.6015 | 0.1465 | 0.4513 | 0.8016 | −3.469 | 0.000522 | 0.8526 | 0.2579 | 0.210826 | 0.295455 | 14 | 120 | 217 | 37 | 186 | 217 |
| rs906353 | Imputed | A | DOM | 795 | 0.622 | 0.1448 | 0.4683 | 0.8261 | −3.279 | 0.001041 | 0.6019 | 0.28428 | 0.239496 | 0.320776 | 19 | 133 | 205 | 42 | 197 | 199 |
| rs915491 | Imputed | C | DOM | 800 | 1.594 | 0.145 | 1.2 | 2.119 | 3.217 | 0.001297 | 0.7887 | 0.27188 | 0.302521 | 0.247178 | 25 | 166 | 166 | 32 | 155 | 256 |
| rs915493 | Imputed | T | DOM | 800 | 1.594 | 0.145 | 1.2 | 2.119 | 3.217 | 0.001297 | 0.7887 | 0.27188 | 0.302521 | 0.247178 | 25 | 166 | 166 | 32 | 155 | 256 |
| rs915494 | Imputed | A | ADD | 796 | 1.39 | 0.114 | 1.112 | 1.738 | 2.888 | 0.003875 | 0.932 | 0.2946 | 0.329577 | 0.26644 | 32 | 170 | 153 | 36 | 163 | 242 |
| rs915494 | Imputed | A | DOM | 796 | 1.637 | 0.146 | 1.229 | 2.179 | 3.375 | 0.000738 | 0.932 | 0.2946 | 0.329577 | 0.26644 | 32 | 170 | 153 | 36 | 163 | 242 |
| rs917295 | Imputed | G | DOM | 800 | 0.6617 | 0.1466 | 0.4964 | 0.882 | −2.816 | 0.004859 | 0.8149 | 0.34563 | 0.317927 | 0.367946 | 44 | 139 | 174 | 53 | 220 | 170 |
| rs9284851 | Imputed | A | GEN | 794 |  |  |  |  | 10.63 | 0.004929 | 0.7057 | 0.3772 | 0.415014 | 0.346939 | 65 | 163 | 125 | 45 | 216 | 180 |
| rs9293464 | Imputed | T | REC | 796 | 0.525 | 0.1769 | 0.3712 | 0.7425 | −3.643 | 0.000269 | 1 | 0.48807 | 0.440678 | 0.526018 | 62 | 188 | 104 | 127 | 211 | 104 |
| rs9295154 | Geno-typed | G | DOM | 800 | 1.438 | 0.161 | 1.049 | 1.972 | 2.255 | 0.02411 | 0.5656 | 0.14375 | 0.165266 | 0.126411 | 8 | 102 | 247 | 6 | 100 | 337 |
| rs9310221 | Imputed | A | DOM | 747 | 1.847 | 0.1614 | 1.346 | 2.534 | 3.801 | 0.000144 | 0.2965 | 0.42838 | 0.465774 | 0.39781 | 66 | 181 | 89 | 78 | 171 | 162 |
| rs9310699 | Geno-typed | T | GEN | 800 |  |  |  |  | 9.296 | 0.009578 | 0.7594 | 0.36125 | 0.397759 | 0.331828 | 60 | 164 | 133 | 42 | 210 | 191 |
| rs9310700 | Imputed | C | ADD | 771 | 1.383 | 0.1116 | 1.111 | 1.721 | 2.907 | 0.003644 | 0.4286 | 0.35019 | 0.390671 | 0.317757 | 54 | 160 | 129 | 35 | 202 | 191 |
| rs9310700 | Imputed | C | GEN | 771 |  |  |  |  | 10.95 | 0.004186 | 0.4286 | 0.35019 | 0.390671 | 0.317757 | 54 | 160 | 129 | 35 | 202 | 191 |
| rs9310701 | Imputed | C | GEN | 797 |  |  |  |  | 9.958 | 0.00688 | 0.821 | 0.37641 | 0.412676 | 0.347285 | 65 | 163 | 127 | 46 | 215 | 181 |
| rs9310704 | Imputed | G | GEN | 784 |  |  |  |  | 11.11 | 0.003861 | 0.6466 | 0.37181 | 0.410511 | 0.340278 | 63 | 163 | 126 | 42 | 210 | 180 |
| rs9319185 | Imputed | C | GEN | 790 |  |  |  |  | 12.94 | 0.001552 | 0.3434 | 0.29177 | 0.33028 | 0.254023 | 43 | 154 | 158 | 30 | 161 | 244 |

TABLE 14-continued

| SNP rs # | SOURCE | AL-LELE (A1) | MOD-EL | NMISS | OR | SE | L95 | U95 | STAT | P | HW_PVA_LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs9319186 | Imputed | T | GEN | 795 | | | | | 12.3 | 0.002134 | 0.2253 | 0.28616 | 0.331461 | 0.249431 | 42 | 152 | 162 | 30 | 159 | 250 |
| rs9327555 | Imputed | T | DOM | 800 | 0.6617 | 0.1466 | 0.4964 | 0.882 | -2.816 | 0.004859 | 0.8149 | 0.34563 | 0.317927 | 0.367946 | 44 | 139 | 174 | 53 | 220 | 170 |
| rs9403367 | Imputed | C | DOM | 800 | 0.6745 | 0.1474 | 0.5052 | 0.9004 | -2.672 | 0.007537 | 0.4259 | 0.23125 | 0.20028 | 0.256208 | 17 | 109 | 231 | 30 | 167 | 246 |
| rs9419608 | Imputed | G | REC | 797 | 1.836 | 0.1694 | 1.317 | 2.559 | 3.586 | 0.000336 | 0.9435 | 0.48996 | 0.533708 | 0.454649 | 108 | 164 | 84 | 84 | 233 | 124 |
| rs9426437 | Imputed | T | DOM | 760 | 0.5666 | 0.1548 | 0.4183 | 0.7675 | -3.669 | 0.000244 | 0.5994 | 0.40921 | 0.3739 | 0.437947 | 59 | 137 | 145 | 72 | 223 | 124 |
| rs9454967 | Imputed | G | DOM | 799 | 1.856 | 0.1976 | 1.26 | 2.734 | 3.131 | 0.001743 | 0.8332 | 0.09199 | 0.115169 | 0.073363 | 4 | 74 | 278 | 3 | 59 | 381 |
| rs9635511 | Imputed | T | DOM | 791 | 0.5722 | 0.1505 | 0.4297 | 0.7753 | -3.651 | 0.000262 | 0.7663 | 0.39444 | 0.351275 | 0.429224 | 50 | 148 | 155 | 75 | 226 | 137 |
| rs966583 | Imputed | A | ADD | 795 | 0.7274 | 0.1066 | 0.5903 | 0.8964 | -2.987 | 0.002819 | 1 | 0.39371 | 0.355932 | 0.424036 | 49 | 154 | 151 | 74 | 226 | 141 |
| rs966583 | Imputed | A | DOM | 795 | 0.6077 | 0.151 | 0.452 | 0.817 | -3.298 | 0.000973 | 1 | 0.39371 | 0.355932 | 0.424036 | 49 | 154 | 151 | 74 | 226 | 141 |
| rs980263 | Imputed | T | GEN | 796 | | | | | 10.4 | 0.00552 | 0.7627 | 0.37563 | 0.412676 | 0.345805 | 65 | 163 | 127 | 45 | 215 | 181 |
| rs980264 | Imputed | T | GEN | 796 | | | | | 10.4 | 0.00552 | 0.7627 | 0.37563 | 0.412676 | 0.345805 | 65 | 163 | 127 | 45 | 215 | 181 |
| rs9812206 | Imputed | G | ADD | 799 | 0.526 | 0.1802 | 0.3695 | 0.7488 | -3.565 | 0.000364 | 0.4346 | 0.10075 | 0.070028 | 0.125566 | 3 | 44 | 310 | 7 | 97 | 338 |
| rs9812206 | Imputed | G | DOM | 799 | 0.4862 | 0.1936 | 0.3327 | 0.7106 | -3.725 | 0.000196 | 0.4346 | 0.10075 | 0.070028 | 0.125566 | 3 | 44 | 310 | 7 | 97 | 338 |
| rs9813552 | Imputed | G | ADD | 800 | 0.5703 | 0.1786 | 0.4019 | 0.8093 | -3.145 | 0.001661 | 0.6984 | 0.10125 | 0.07423 | 0.123025 | 3 | 47 | 307 | 6 | 97 | 340 |
| rs9813552 | Imputed | G | DOM | 800 | 0.5318 | 0.191 | 0.3657 | 0.7733 | -3.306 | 0.000946 | 0.6984 | 0.10125 | 0.07423 | 0.123025 | 3 | 47 | 307 | 6 | 97 | 340 |
| rs9815037 | Imputed | T | ADD | 799 | 0.5621 | 0.1845 | 0.3915 | 0.8069 | -3.123 | 0.001792 | 0.6789 | 0.09449 | 0.06882 | 0.115124 | 3 | 43 | 310 | 5 | 92 | 346 |
| rs9815037 | Imputed | T | DOM | 799 | 0.5176 | 0.1969 | 0.3519 | 0.7613 | -3.345 | 0.000822 | 0.6789 | 0.09449 | 0.06882 | 0.115124 | 3 | 43 | 310 | 5 | 92 | 346 |
| rs9819583 | Imputed | T | GEN | 798 | | | | | 9.421 | 0.008999 | 0.7593 | 0.36153 | 0.398876 | 0.331448 | 60 | 164 | 132 | 42 | 209 | 191 |
| rs9825349 | Imputed | A | ADD | 798 | 0.5607 | 0.1845 | 0.3906 | 0.8049 | -3.136 | 0.001712 | 0.6792 | 0.09461 | 0.06882 | 0.115385 | 3 | 43 | 310 | 5 | 92 | 345 |
| rs9825349 | Imputed | A | DOM | 798 | 0.5163 | 0.1969 | 0.351 | 0.7593 | -3.358 | 0.000784 | 0.6792 | 0.09461 | 0.06882 | 0.115385 | 3 | 43 | 310 | 5 | 92 | 345 |
| rs9833118 | Imputed | G | ADD | 794 | 1.352 | 0.1082 | 1.094 | 1.672 | 2.791 | 0.005247 | 0.4927 | 0.3665 | 0.404494 | 0.335616 | 60 | 168 | 128 | 42 | 210 | 186 |
| rs9833118 | Imputed | G | GEN | 794 | | | | | 9.638 | 0.008076 | 0.4927 | 0.3665 | 0.404494 | 0.335616 | 60 | 168 | 128 | 42 | 210 | 186 |
| rs9834217 | Imputed | T | ADD | 799 | 0.5621 | 0.1845 | 0.3915 | 0.8069 | -3.123 | 0.001792 | 0.6789 | 0.09449 | 0.06882 | 0.115124 | 3 | 43 | 310 | 5 | 92 | 346 |
| rs9834217 | Imputed | T | DOM | 799 | 0.5176 | 0.1969 | 0.3519 | 0.7613 | -3.345 | 0.000822 | 0.6789 | 0.09449 | 0.06882 | 0.115124 | 3 | 43 | 310 | 5 | 92 | 346 |
| rs9838563 | Imputed | C | GEN | 797 | | | | | 9.958 | 0.00688 | 0.821 | 0.37641 | 0.412676 | 0.347285 | 65 | 163 | 127 | 46 | 215 | 181 |
| rs9840460 | Imputed | T | ADD | 799 | 0.5621 | 0.1845 | 0.3915 | 0.8069 | -3.123 | 0.001792 | 0.6789 | 0.09449 | 0.06882 | 0.115124 | 3 | 43 | 310 | 5 | 92 | 346 |
| rs9840460 | Imputed | T | DOM | 799 | 0.5176 | 0.1969 | 0.3519 | 0.7613 | -3.345 | 0.000822 | 0.6789 | 0.09449 | 0.06882 | 0.115124 | 3 | 43 | 310 | 5 | 92 | 346 |
| rs9840756 | Imputed | A | ADD | 799 | 0.5621 | 0.1845 | 0.3915 | 0.8069 | -3.123 | 0.001792 | 0.6789 | 0.09449 | 0.06882 | 0.115124 | 3 | 43 | 310 | 5 | 92 | 346 |
| rs9840756 | Imputed | A | DOM | 799 | 0.5176 | 0.1969 | 0.3519 | 0.7613 | -3.345 | 0.000822 | 0.6789 | 0.09449 | 0.06882 | 0.115124 | 3 | 43 | 310 | 5 | 92 | 346 |
| rs9847999 | Imputed | C | GEN | 794 | | | | | 10.29 | 0.005829 | 0.7623 | 0.37657 | 0.412429 | 0.347727 | 65 | 162 | 127 | 45 | 216 | 179 |
| rs9864769 | Imputed | C | GEN | 797 | | | | | 9.958 | 0.00688 | 0.821 | 0.37641 | 0.412676 | 0.347285 | 65 | 163 | 127 | 46 | 215 | 181 |
| rs9866421 | Geno-typed | C | REC | 800 | 0.5528 | 0.191 | 0.3802 | 0.8038 | -3.104 | 0.00191 | 0.6672 | 0.44063 | 0.411765 | 0.463883 | 50 | 194 | 113 | 102 | 207 | 134 |
| rs987296 | Imputed | T | GEN | 800 | | | | | 9.296 | 0.009578 | 0.7594 | 0.36125 | 0.397759 | 0.331828 | 60 | 164 | 133 | 42 | 210 | 191 |
| rs9881685 | Imputed | A | ADD | 799 | 0.526 | 0.1802 | 0.3695 | 0.7488 | -3.565 | 0.000364 | 0.4346 | 0.10075 | 0.070028 | 0.125566 | 3 | 44 | 310 | 7 | 97 | 338 |
| rs9881685 | Imputed | A | DOM | 799 | 0.4862 | 0.1936 | 0.3327 | 0.7106 | -3.725 | 0.000196 | 0.4346 | 0.10075 | 0.070028 | 0.125566 | 3 | 44 | 310 | 7 | 97 | 338 |
| rs992695 | Imputed | C | ADD | 790 | 0.6317 | 0.1218 | 0.4976 | 0.8019 | -3.773 | 0.000161 | 0.7811 | 0.25949 | 0.212857 | 0.296591 | 14 | 121 | 215 | 37 | 187 | 216 |
| rs992695 | Imputed | C | DOM | 790 | 0.6056 | 0.1463 | 0.4546 | 0.8068 | -3.427 | 0.00061 | 0.7811 | 0.25949 | 0.212857 | 0.296591 | 14 | 121 | 215 | 37 | 187 | 216 |
| rs9936999 | Imputed | G | DOM | 485 | 1.885 | 0.192 | 1.294 | 2.746 | 3.302 | 0.000961 | 0.4247 | 0.35052 | 0.389952 | 0.320652 | 22 | 119 | 68 | 33 | 111 | 132 |

TABLE 15

| SNP rs # | SOURCE | ALLELE (A1) | MODEL | NMISS | OR | SE | L95 | U95 | STAT | P | HW_PVALUE | ALLELE_FREQ | PRAVA_ALLELE_FREQ | PLACEBO_ALLELE_FREQ | PRAVA_A1_HZ_COUNT | PRAVA_HET_COUNT | PRAVA_A2_HZ_COUNT | PLACEBO_A1_HZ_COUNT | PLACEBO_HET_COUNT | PLACEBO_A2_HZ_COUNT |
|---|---|---|---|---|---|---|---|---|---|---|---|---|---|---|---|---|---|---|---|---|
| rs77638540 | Genotyped | T | DOM | 431 | 0.6846 | 0.4051 | 0.3095 | 1.515 | −0.935 | 0.3497 | 0.407 | 0.0348 | 0.02717 | 0.04049 | 0 | 10 | 174 | 1 | 18 | 228 |
| rs72746987 | Genotyped | A | DOM | 431 | 0.3415 | 0.4723 | 0.1353 | 0.8617 | −2.275 | 0.02291 | 0.01335 | 0.03596 | 0.02174 | 0.04656 | 2 | 4 | 178 | 1 | 21 | 225 |
| rs10021016 | Genotyped | G | GEN | 431 | | | | | 4.358 | 0.1131 | 0.8982 | 0.25174 | 0.28533 | 0.22672 | 17 | 71 | 96 | 11 | 90 | 146 |
| rs10021016 | Genotyped | G | REC | 431 | 2.151 | 0.4014 | 0.9794 | 4.724 | 1.908 | 0.05637 | 0.8982 | 0.25174 | 0.28533 | 0.22672 | 17 | 71 | 96 | 11 | 90 | 146 |
| rs10051148 | Imputed | C | DOM | 431 | 0.7035 | 0.1964 | 0.4787 | 1.034 | −1.791 | 0.07336 | 0.8246 | 0.31903 | 0.29348 | 0.33806 | 19 | 70 | 95 | 26 | 115 | 106 |
| rs10054055 | Imputed | T | DOM | 431 | 0.7019 | 0.1964 | 0.4777 | 1.031 | −1.803 | 0.0714 | 0.9114 | 0.31439 | 0.28804 | 0.33401 | 18 | 70 | 96 | 25 | 115 | 107 |
| rs10067895 | Imputed | A | DOM | 423 | 0.6884 | 0.1986 | 0.4665 | 1.016 | −1.88 | 0.0601 | 0.8235 | 0.32151 | 0.29444 | 0.34156 | 19 | 68 | 93 | 26 | 114 | 103 |
| rs10100725 | Imputed | C | DOM | 431 | 0.6909 | 0.2229 | 0.4464 | 1.069 | −1.659 | 0.09719 | 1 | 0.14849 | 0.11957 | 0.17004 | 5 | 42 | 141 | 8 | 68 | 171 |
| rs10128531 | Imputed | T | ADD | 422 | 1.446 | 0.1929 | 0.9906 | 2.11 | 1.911 | 0.05601 | 0.04404 | 0.17773 | 0.20718 | 0.1556 | 5 | 65 | 111 | 2 | 71 | 168 |
| rs10181743 | Imputed | G | ADD | 419 | 1.259 | 0.1434 | 0.9504 | 1.668 | 1.605 | 0.1084 | 0.7667 | 0.44511 | 0.47727 | 0.42181 | 42 | 84 | 50 | 39 | 127 | 77 |
| rs10199127 | Imputed | T | DOM | 426 | 1.892 | 0.1994 | 1.28 | 2.797 | 3.197 | 0.00139 | 0.2788 | 0.277 | 0.32692 | 0.23975 | 14 | 91 | 77 | 14 | 89 | 141 |
| rs10270624 | Imputed | G | DOM | 426 | 1.873 | 0.2081 | 1.245 | 2.816 | 3.014 | 0.00258 | 0.8741 | 0.18662 | 0.22826 | 0.15496 | 7 | 70 | 107 | 7 | 61 | 174 |
| rs1030006 | Imputed | G | REC | 431 | 1.973 | 0.2532 | 1.201 | 3.24 | 2.684 | 0.00728 | 0.6962 | 0.43387 | 0.47826 | 0.40081 | 45 | 86 | 53 | 34 | 130 | 83 |
| rs1031811 | Imputed | A | REC | 425 | 1.901 | 0.3376 | 0.9811 | 3.684 | 1.903 | 0.057 | 0.909 | 0.30471 | 0.32597 | 0.28893 | 23 | 72 | 86 | 17 | 107 | 120 |
| rs10430870 | Genotyped | G | GEN | 431 | | | | | 1.662 | 0.4357 | 0.1902 | 0.24246 | 0.24457 | 0.24089 | 11 | 68 | 105 | 9 | 101 | 137 |
| rs10430870 | Genotyped | G | REC | 431 | 1.672 | 0.4618 | 0.6765 | 4.134 | 1.114 | 0.2654 | 0.1902 | 0.24246 | 0.24457 | 0.24089 | 11 | 68 | 105 | 9 | 101 | 137 |
| rs10469597 | Imputed | A | GEN | 397 | | | | | 5.33 | 0.06962 | 0.4689 | 0.29471 | 0.32941 | 0.26872 | 19 | 74 | 77 | 12 | 98 | 117 |
| rs10469597 | Imputed | A | REC | 397 | 2.363 | 0.3863 | 1.108 | 5.039 | 2.226 | 0.02598 | 0.4689 | 0.29471 | 0.32941 | 0.26872 | 19 | 74 | 77 | 12 | 98 | 117 |
| rs10478919 | Imputed | G | DOM | 431 | 0.7035 | 0.1964 | 0.4787 | 1.034 | −1.791 | 0.07336 | 0.7398 | 0.32019 | 0.2962 | 0.33806 | 20 | 69 | 95 | 26 | 115 | 106 |
| rs10506623 | Imputed | C | ADD | 431 | 0.6851 | 0.1503 | 0.5103 | 0.9198 | −2.516 | 0.01187 | 0.132 | 0.35054 | 0.35054 | 0.43725 | 20 | 89 | 75 | 41 | 134 | 72 |
| rs10506623 | Imputed | C | DOM | 431 | 0.6216 | 0.2072 | 0.4141 | 0.9329 | −2.295 | 0.02171 | 0.132 | 0.40023 | 0.35054 | 0.43725 | 20 | 89 | 75 | 41 | 134 | 72 |
| rs10506626 | Imputed | A | ADD | 430 | 0.644 | 0.1506 | 0.4794 | 0.8651 | −2.922 | 0.00348 | 0.2655 | 0.39186 | 0.33424 | 0.43496 | 19 | 85 | 80 | 41 | 132 | 73 |
| rs10506626 | Imputed | A | DOM | 430 | 0.5681 | 0.2056 | 0.3796 | 0.85 | −2.75 | 0.00596 | 0.2655 | 0.39186 | 0.33424 | 0.43496 | 19 | 85 | 80 | 41 | 132 | 73 |
| rs10509477 | Imputed | T | DOM | 430 | 1.458 | 0.197 | 0.9908 | 2.145 | 1.913 | 0.05576 | 0.4158 | 0.29419 | 0.32065 | 0.27439 | 18 | 82 | 84 | 23 | 89 | 134 |
| rs10517918 | Imputed | G | REC | 424 | 2.104 | 0.2569 | 1.272 | 3.481 | 2.896 | 0.00378 | 0.765 | 0.42099 | 0.46448 | 0.38797 | 45 | 80 | 58 | 32 | 123 | 86 |
| rs10517924 | Imputed | A | REC | 430 | 1.646 | 0.2374 | 1.033 | 2.621 | 2.098 | 0.03593 | 0.9228 | 0.46512 | 0.49454 | 0.44332 | 48 | 85 | 50 | 44 | 131 | 72 |
| rs10519362 | Imputed | G | DOM | 431 | 1.479 | 0.2285 | 0.9448 | 2.314 | 1.711 | 0.087 | 0.1367 | 0.13109 | 0.15489 | 0.11336 | 6 | 45 | 133 | 5 | 46 | 196 |
| rs10520072 | Imputed | T | DOM | 429 | 0.6749 | 0.197 | 0.4587 | 0.993 | −1.996 | 0.04596 | 1 | 0.31585 | 0.28689 | 0.3374 | 25 | 69 | 96 | 25 | 116 | 105 |
| rs10733790 | Imputed | T | DOM | 426 | 0.6833 | 0.203 | 0.459 | 1.017 | −1.876 | 0.06061 | 0.7588 | 0.38498 | 0.35714 | 0.40574 | 25 | 80 | 77 | 36 | 126 | 82 |
| rs10742851 | Imputed | C | REC | 431 | 0.2879 | 0.5067 | 0.1066 | 0.7773 | −2.457 | 0.014 | 0.8969 | 0.2471 | 0.2038 | 0.27935 | 5 | 65 | 114 | 22 | 94 | 131 |
| rs10743685 | Imputed | G | GEN | 431 | | | | | 4.792 | 0.0911 | 0.9175 | 0.36543 | 0.40217 | 0.33806 | 30 | 88 | 66 | 28 | 111 | 108 |
| rs10743685 | Imputed | G | REC | 431 | 1.602 | 0.2855 | 0.9156 | 2.803 | 1.651 | 0.09875 | 0.9175 | 0.36543 | 0.40217 | 0.33806 | 30 | 88 | 66 | 28 | 111 | 108 |
| rs10749293 | Imputed | T | DOM | 431 | 1.52 | 0.1971 | 1.033 | 2.237 | 2.125 | 0.03357 | 0.4125 | 0.29002 | 0.32065 | 0.26721 | 18 | 82 | 84 | 22 | 88 | 137 |
| rs10749294 | Imputed | A | DOM | 431 | 1.505 | 0.1973 | 1.022 | 2.216 | 2.073 | 0.03821 | 0.3324 | 0.27262 | 0.25304 | 0.25304 | 15 | 80 | 89 | 21 | 83 | 143 |
| rs10753760 | Imputed | T | DOM | 406 | 1.468 | 0.1459 | 1.103 | 1.954 | 2.632 | 0.00849 | 0.6768 | 0.39039 | 0.44253 | 0.35129 | 35 | 84 | 55 | 29 | 105 | 98 |
| rs10753760 | Imputed | T | GEN | 406 | | | | | 6.957 | 0.03085 | 0.6768 | 0.39039 | 0.44253 | 0.35129 | 35 | 84 | 55 | 29 | 105 | 98 |
| rs10772362 | Imputed | T | ADD | 431 | 0.6724 | 0.1684 | 0.4834 | 0.9355 | −2.356 | 0.01848 | 0.6967 | 0.24594 | 0.20652 | 0.2753 | 7 | 62 | 115 | 17 | 102 | 128 |
| rs10784891 | Imputed | C | ADD | 429 | 0.7576 | 0.1448 | 0.5705 | 1.006 | −1.918 | 0.05515 | 0.4895 | 0.42657 | 0.38736 | 0.45547 | 30 | 81 | 71 | 44 | 137 | 66 |
| rs10784891 | Imputed | C | DOM | 429 | 0.5886 | 0.2107 | 0.3895 | 0.8896 | −2.516 | 0.01189 | 0.4895 | 0.42657 | 0.38736 | 0.45547 | 30 | 81 | 71 | 44 | 137 | 66 |
| rs10784891 | Imputed | C | GEN | 429 | | | | | 6.516 | 0.03846 | 0.4895 | 0.42657 | 0.38736 | 0.45547 | 30 | 81 | 71 | 44 | 137 | 66 |
| rs10787923 | Imputed | G | DOM | 430 | 1.509 | 0.1972 | 1.025 | 2.221 | 2.086 | 0.03699 | 0.4129 | 0.2907 | 0.32065 | 0.26829 | 18 | 82 | 84 | 22 | 88 | 136 |
| rs10787924 | Imputed | T | DOM | 431 | 1.505 | 0.1973 | 1.022 | 2.216 | 2.073 | 0.03821 | 0.3324 | 0.27262 | 0.29891 | 0.25304 | 15 | 80 | 89 | 21 | 83 | 143 |
| rs10787949 | Imputed | A | DOM | 430 | 1.433 | 0.1969 | 0.9742 | 2.108 | 1.827 | 0.06765 | 0.4183 | 0.29535 | 0.32337 | 0.27439 | 19 | 81 | 84 | 22 | 91 | 133 |
| rs10787951 | Imputed | G | DOM | 430 | 1.433 | 0.1969 | 0.9742 | 2.108 | 1.827 | 0.06765 | 0.4183 | 0.29535 | 0.32337 | 0.27439 | 19 | 81 | 84 | 22 | 91 | 133 |

TABLE 15-continued

| SNP rs # | SOURCE | AL-LELE (A1) | MOD-EL | NMISS | OR | SE | L95 | U95 | STAT | P | HW_PVA LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs10787983 | Imputed | C | DOM | 430 | 1.458 | 0.197 | 0.9908 | 2.145 | 1.913 | 0.05576 | 0.4158 | 0.29419 | 0.32065 | 0.27439 | 18 | 82 | 84 | 23 | 89 | 134 |
| rs10794733 | Imputed | C | ADD | 421 | 0.7588 | 0.1519 | 0.5634 | 1.022 | -1.818 | 0.06914 | 0.9124 | 0.33017 | 0.29558 | 0.35625 | 13 | 81 | 87 | 32 | 107 | 101 |
| rs10818280 | Imputed | C | DOM | 426 | 0.6701 | 0.1985 | 0.4541 | 0.9889 | -2.016 | 0.04375 | 0.2268 | 0.32864 | 0.30055 | 0.34979 | 17 | 76 | 90 | 23 | 124 | 96 |
| rs10860586 | Imputed | A | ADD | 430 | 1.512 | 0.1414 | 1.146 | 1.995 | 2.923 | 0.00347 | 1 | 0.49186 | 0.55163 | 0.44715 | 57 | 89 | 38 | 47 | 126 | 73 |
| rs10860586 | Imputed | A | GEN | 430 | | | | | 8.948 | 0.0114 | 1 | 0.49186 | 0.55163 | 0.44715 | 57 | 89 | 38 | 47 | 126 | 73 |
| rs10870473 | Imputed | A | ADD | 182 | 0.6204 | 0.2357 | 0.3909 | 0.9846 | -2.026 | 0.04278 | 0.4798 | 0.2967 | 0.2439 | 0.34 | 7 | 26 | 49 | 11 | 46 | 43 |
| rs10870473 | Imputed | A | DOM | 182 | 0.4859 | 0.3065 | 0.2665 | 0.886 | -2.355 | 0.01853 | 0.4798 | 0.2967 | 0.2439 | 0.34 | 7 | 26 | 49 | 11 | 46 | 43 |
| rs10879240 | Imputed | C | ADD | 430 | 0.7653 | 0.1438 | 0.5773 | 1.014 | -1.86 | 0.06286 | 5.55E-01 | 0.42674 | 0.38859 | 0.45528 | 31 | 81 | 72 | 44 | 136 | 66 |
| rs10879240 | Imputed | C | GEN | 430 | | | | | 6.525 | 0.03829 | 0.5549 | 0.42674 | 0.38859 | 0.45528 | 31 | 81 | 72 | 44 | 136 | 66 |
| rs10879242 | Imputed | A | ADD | 431 | 0.6996 | 0.1493 | 0.5222 | 0.9374 | -2.393 | 0.0167 | 0.1622 | 0.40371 | 0.35598 | 0.43927 | 21 | 89 | 74 | 42 | 133 | 72 |
| rs10879242 | Imputed | A | DOM | 431 | 0.6354 | 0.2073 | 0.4232 | 0.9539 | -2.188 | 0.02869 | 0.1622 | 0.40371 | 0.35598 | 0.43927 | 21 | 89 | 74 | 42 | 133 | 72 |
| rs10879245 | Imputed | G | ADD | 431 | 0.6996 | 0.1493 | 0.5222 | 0.9374 | -2.393 | 0.0167 | 0.1622 | 0.40371 | 0.35598 | 0.43927 | 21 | 89 | 74 | 42 | 133 | 72 |
| rs10879245 | Imputed | G | DOM | 431 | 0.6354 | 0.2073 | 0.4232 | 0.9539 | -2.188 | 0.02869 | 0.1622 | 0.40371 | 0.35598 | 0.43927 | 21 | 89 | 74 | 42 | 133 | 72 |
| rs10879249 | Imputed | T | ADD | 430 | 0.6776 | 0.1506 | 0.5044 | 0.9103 | -2.584 | 0.00976 | 0.1092 | 0.40116 | 0.35054 | 0.43902 | 20 | 89 | 75 | 41 | 134 | 71 |
| rs10879249 | Imputed | T | DOM | 430 | 0.6103 | 0.2074 | 0.4065 | 0.9164 | -2.381 | 0.01726 | 0.1092 | 0.40116 | 0.35054 | 0.43902 | 20 | 89 | 75 | 41 | 134 | 71 |
| rs10886429 | Imputed | A | DOM | 429 | 1.47 | 0.1974 | 0.9985 | 2.165 | 1.952 | 0.05092 | 0.4134 | 0.29138 | 0.31967 | 0.27033 | 18 | 81 | 84 | 22 | 89 | 135 |
| rs10886449 | Imputed | G | DOM | 430 | 1.441 | 0.1971 | 0.9794 | 2.121 | 1.854 | 0.06367 | 0.3355 | 0.27674 | 0.30163 | 0.25813 | 16 | 79 | 89 | 21 | 85 | 140 |
| rs10886451 | Imputed | G | DOM | 430 | 1.441 | 0.1971 | 0.9794 | 2.121 | 1.854 | 0.06367 | 0.3355 | 0.27674 | 0.30163 | 0.25813 | 16 | 79 | 89 | 21 | 85 | 140 |
| rs10886452 | Imputed | A | ADD | 430 | 1.433 | 0.1969 | 0.9742 | 2.108 | 1.827 | 0.06765 | 0.4183 | 0.29535 | 0.32337 | 0.27439 | 19 | 81 | 84 | 22 | 91 | 133 |
| rs10886456 | Imputed | G | DOM | 430 | 1.441 | 0.1971 | 0.9794 | 2.121 | 1.854 | 0.06367 | 0.3355 | 0.27674 | 0.30163 | 0.25813 | 16 | 79 | 89 | 21 | 85 | 140 |
| rs10886463 | Imputed | G | DOM | 431 | 1.444 | 0.1968 | 0.9818 | 2.123 | 1.867 | 0.06193 | 0.4176 | 0.29466 | 0.32337 | 0.27126 | 16 | 81 | 89 | 21 | 85 | 140 |
| rs10886465 | Imputed | A | DOM | 431 | 1.444 | 0.1968 | 0.9818 | 2.123 | 1.867 | 0.06193 | 0.3545 | 0.29582 | 0.32065 | 0.2753 | 19 | 81 | 84 | 22 | 90 | 134 |
| rs10886526 | Imputed | C | DOM | 430 | 1.458 | 0.197 | 0.9908 | 2.145 | 1.913 | 0.05576 | 0.4158 | 0.29419 | 0.32065 | 0.27439 | 18 | 82 | 84 | 23 | 89 | 134 |
| rs10922903 | Imputed | C | REC | 430 | 0.6266 | 0.2724 | 0.3674 | 1.069 | -1.716 | 0.08622 | 0.2973 | 0.41395 | 0.39946 | 0.4248 | 25 | 97 | 62 | 47 | 115 | 84 |
| rs10941126 | Imputed | G | ADD | 431 | 0.309 | 0.5694 | 0.1012 | 0.9434 | -2.062 | 0.03918 | 1 | 0.0232 | 0.01087 | 0.03239 | 0 | 4 | 180 | 0 | 16 | 231 |
| rs10941126 | Imputed | G | DOM | 431 | 0.309 | 0.5694 | 0.1012 | 0.9434 | -2.062 | 0.03918 | 1 | 0.0232 | 0.01087 | 0.03239 | 0 | 4 | 180 | 0 | 16 | 231 |
| rs10947980 | Imputed | A | ADD | 431 | 0.6089 | 0.157 | 0.4476 | 0.8282 | -3.161 | 0.00157 | 0.3433 | 0.28422 | 0.22554 | 0.32794 | 15 | 53 | 116 | 24 | 114 | 109 |
| rs11059376 | Imputed | T | ADD | 412 | 1.592 | 0.1898 | 1.097 | 2.309 | 2.45 | 0.01428 | 0.8625 | 0.17233 | 0.21023 | 0.14407 | 7 | 60 | 109 | 4 | 60 | 172 |
| rs11072995 | Imputed | T | GEN | 430 | | | | | 5.185 | 0.07483 | 0.5795 | 0.22209 | 0.2459 | 0.20445 | 15 | 60 | 108 | 8 | 85 | 154 |
| rs11072995 | Imputed | T | REC | 430 | 2.796 | 0.4515 | 1.154 | 6.774 | 2.277 | 0.0228 | 0.2973 | 0.22209 | 0.2459 | 0.20445 | 15 | 60 | 108 | 8 | 85 | 154 |
| rs11081202 | Genotyped | G | GEN | 431 | | | | | 6.987 | 0.0304 | 0.2973 | 0.29466 | 0.33152 | 0.26721 | 26 | 70 | 88 | 16 | 100 | 131 |
| rs11081202 | Genotyped | G | REC | 431 | 2.426 | 0.3357 | 1.256 | 4.684 | 2.64 | 0.00829 | 0.739 | 0.29466 | 0.33152 | 0.26721 | 26 | 70 | 88 | 16 | 100 | 131 |
| rs10965 | Imputed | G | GEN | 413 | | | | | 4.153 | 0.1254 | 0.7696 | 0.3293 | 0.36782 | 0.30126 | 22 | 84 | 68 | 21 | 102 | 116 |
| rs11124962 | Imputed | A | DOM | 431 | 1.812 | 0.2023 | 1.219 | 2.693 | 2.937 | 0.00331 | 0.7398 | 0.20766 | 0.24728 | 0.17814 | 7 | 77 | 100 | 10 | 68 | 169 |
| rs11116596 | Imputed | T | ADD | 431 | 0.7035 | 0.1964 | 0.4787 | 1.034 | -1.791 | 0.07336 | 0.4337 | 0.32019 | 0.2962 | 0.33806 | 20 | 69 | 95 | 26 | 115 | 106 |
| rs11178531 | Imputed | A | ADD | 431 | 0.7781 | 0.1437 | 0.5871 | 1.031 | -1.746 | 0.0808 | 0.4337 | 0.43735 | 0.40217 | 0.46356 | 32 | 84 | 68 | 46 | 137 | 64 |
| rs11178531 | Imputed | A | DOM | 431 | 0.6138 | 0.212 | 0.4051 | 0.93 | -2.303 | 0.0213 | 0.1092 | 0.43735 | 0.40217 | 0.46356 | 32 | 84 | 68 | 46 | 137 | 64 |
| rs11178583 | Imputed | A | ADD | 430 | 0.6776 | 0.1506 | 0.5044 | 0.9103 | -2.584 | 0.00976 | 0.1092 | 0.40116 | 0.35054 | 0.43902 | 20 | 89 | 75 | 41 | 134 | 71 |
| rs11178583 | Imputed | A | DOM | 430 | 0.6103 | 0.2074 | 0.4065 | 0.9164 | -2.381 | 0.01726 | 0.1086 | 0.40116 | 0.35054 | 0.43902 | 20 | 89 | 75 | 41 | 135 | 71 |
| rs11178589 | Imputed | T | DOM | 431 | 0.6759 | 0.1506 | 0.5031 | 0.908 | -2.601 | 0.0093 | 0.1086 | 0.40139 | 0.35054 | 0.43927 | 20 | 89 | 75 | 41 | 135 | 71 |
| rs11178589 | Imputed | T | DOM | 431 | 0.6066 | 0.2072 | 0.4042 | 0.9105 | -2.413 | 0.01583 | 0.1086 | 0.40139 | 0.35054 | 0.43927 | 20 | 89 | 75 | 41 | 135 | 71 |
| rs11178594 | Imputed | C | ADD | 431 | 0.6841 | 0.1503 | 0.5096 | 0.9184 | -2.527 | 0.01152 | 0.132 | 0.40023 | 0.35054 | 0.43725 | 20 | 89 | 75 | 41 | 134 | 72 |
| rs11178594 | Imputed | C | DOM | 431 | 0.62 | 0.207 | 0.4133 | 0.9302 | -2.31 | 0.0209 | 0.132 | 0.40023 | 0.35054 | 0.43725 | 20 | 89 | 75 | 41 | 134 | 72 |
| rs11178602 | Imputed | T | ADD | 431 | 0.6841 | 0.1503 | 0.5096 | 0.9184 | -2.527 | 0.01152 | 0.132 | 0.40023 | 0.35054 | 0.43725 | 20 | 89 | 75 | 41 | 134 | 72 |
| rs11178602 | Imputed | T | DOM | 431 | 0.62 | 0.207 | 0.4133 | 0.9302 | -2.31 | 0.0209 | 0.132 | 0.40023 | 0.35054 | 0.43725 | 20 | 89 | 75 | 41 | 134 | 72 |
| rs11178648 | Imputed | T | ADD | 431 | 0.6858 | 0.1487 | 0.5125 | 0.9178 | -2.537 | 0.01119 | 0.3138 | 0.39559 | 0.34511 | 0.4332 | 21 | 85 | 78 | 41 | 132 | 74 |

TABLE 15-continued

| SNP rs # | SOURCE | AL-LELE (A1) | MOD-EL | NMISS | OR | SE | L95 | U95 | STAT | P | HW_PVA-LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs11178648 | Imputed | T | DOM | 431 | 0.6021 | 0.2055 | 0.4025 | 0.9008 | -2.468 | 0.01358 | 0.3138 | 0.39559 | 0.34511 | 0.4332 | 21 | 85 | 78 | 41 | 132 | 74 |
| rs11198877 | Imputed | T | DOM | 431 | 1.444 | 0.1968 | 0.9818 | 2.123 | 1.867 | 0.06193 | 0.4176 | 0.29466 | 0.32337 | 0.27328 | 19 | 81 | 84 | 22 | 91 | 134 |
| rs11198842 | Imputed | T | DOM | 430 | 1.458 | 0.197 | 0.9908 | 2.145 | 1.913 | 0.05576 | 0.4158 | 0.29419 | 0.32065 | 0.27439 | 18 | 82 | 84 | 23 | 89 | 134 |
| rs11221075 | Imputed | A | ADD | 426 | 0.7175 | 0.2252 | 0.4614 | 1.116 | -1.474 | 0.1405 | 0.8093 | 0.11385 | 0.09669 | 0.12653 | 2 | 31 | 148 | 4 | 54 | 187 |
| rs11242020 | Imputed | T | DOM | 430 | 0.7107 | 0.1967 | 0.4834 | 1.045 | -1.736 | 0.08258 | 0.7399 | 0.32093 | 0.29781 | 0.33806 | 20 | 69 | 94 | 26 | 115 | 106 |
| rs11242021 | Imputed | T | DOM | 429 | 0.6887 | 0.197 | 0.4682 | 1.013 | -1.893 | 0.05831 | 1 | 0.31702 | 0.28962 | 0.3374 | 18 | 70 | 95 | 25 | 116 | 105 |
| rs11242022 | Imputed | T | DOM | 428 | 0.6944 | 0.1971 | 0.4719 | 1.022 | -1.85 | 0.06431 | 1 | 0.31659 | 0.28962 | 0.33673 | 18 | 70 | 95 | 25 | 115 | 105 |
| rs11242023 | Imputed | T | DOM | 428 | 0.6944 | 0.1971 | 0.4719 | 1.022 | -1.85 | 0.06431 | 1 | 0.31659 | 0.28962 | 0.33673 | 18 | 70 | 95 | 25 | 115 | 105 |
| rs1149349 | Imputed | T | DOM | 431 | 1.606 | 0.2234 | 1.037 | 2.489 | 2.122 | 0.03382 | 1 | 0.13689 | 0.16033 | 0.11943 | 9 | 55 | 127 | 6 | 47 | 194 |
| rs1149350 | Imputed | A | ADD | 430 | 1.546 | 0.1741 | 1.099 | 2.176 | 2.504 | 0.0123 | 0.1416 | 0.1814 | 0.22283 | 0.15041 | 9 | 64 | 111 | 10 | 54 | 182 |
| rs1149350 | Imputed | A | DOM | 430 | 1.835 | 0.2102 | 1.215 | 2.77 | 2.886 | 0.0039 | 0.1416 | 0.1814 | 0.22283 | 0.15041 | 9 | 64 | 111 | 10 | 54 | 182 |
| rs1576627 | Imputed | T | ADD | 427 | 1.4 | 0.1931 | 0.9592 | 2.045 | 1.744 | 0.08112 | 0.1506 | 0.13817 | 0.16298 | 0.11992 | 7 | 45 | 129 | 5 | 49 | 192 |
| rs1576627 | Imputed | T | DOM | 427 | 1.426 | 0.2259 | 0.9158 | 2.22 | 1.571 | 0.1162 | 0.1506 | 0.13817 | 0.16298 | 0.11992 | 7 | 45 | 129 | 5 | 49 | 192 |
| rs1630050 | Imputed | G | GEN | 431 |  |  |  |  | 6.07 | 0.04808 | 0.7883 | 0.23202 | 0.25272 | 0.2166 | 16 | 61 | 107 | 8 | 91 | 148 |
| rs1630050 | Imputed | G | REC | 431 | 2.977 | 0.4471 | 1.239 | 7.15 | 2.44 | 0.01469 | 0.7883 | 0.23202 | 0.25272 | 0.2166 | 16 | 61 | 107 | 8 | 91 | 148 |
| rs1633024 | Imputed | C | GEN | 431 |  |  |  |  | 6.07 | 0.04808 | 0.7883 | 0.23202 | 0.25272 | 0.2166 | 16 | 61 | 107 | 8 | 91 | 148 |
| rs1633024 | Imputed | C | REC | 431 | 2.977 | 0.4471 | 1.239 | 7.15 | 2.44 | 0.01469 | 0.7883 | 0.23202 | 0.25272 | 0.2166 | 16 | 61 | 107 | 8 | 91 | 148 |
| rs1636298 | Imputed | G | GEN | 431 |  |  |  |  | 6.084 | 0.04773 | 0.8893 | 0.22274 | 0.25 | 0.20243 | 15 | 62 | 108 | 7 | 86 | 154 |
| rs1636298 | Imputed | G | REC | 431 | 3.183 | 0.4709 | 1.265 | 8.011 | 2.459 | 0.01395 | 0.8893 | 0.22274 | 0.25 | 0.20243 | 15 | 62 | 108 | 7 | 86 | 154 |
| rs1637363 | Imputed | C | GEN | 430 |  |  |  |  | 6.108 | 0.04718 | 0.893 | 0.23372 | 0.25272 | 0.21951 | 16 | 61 | 107 | 8 | 92 | 146 |
| rs1637363 | Imputed | C | REC | 430 | 2.964 | 0.4471 | 1.234 | 7.119 | 2.43 | 0.01509 | 0.893 | 0.23372 | 0.25272 | 0.21951 | 16 | 61 | 107 | 8 | 92 | 146 |
| rs1637813 | Imputed | A | GEN | 431 |  |  |  |  | 6.07 | 0.04808 | 0.7883 | 0.23202 | 0.25272 | 0.2166 | 16 | 61 | 107 | 8 | 91 | 148 |
| rs1637813 | Imputed | A | REC | 431 | 2.977 | 0.4471 | 1.239 | 7.15 | 2.44 | 0.01469 | 0.7883 | 0.23202 | 0.25272 | 0.2166 | 16 | 61 | 107 | 8 | 91 | 148 |
| rs1638043 | Imputed | C | GEN | 430 |  |  |  |  | 6.108 | 0.04718 | 0.893 | 0.23372 | 0.25272 | 0.21951 | 16 | 61 | 107 | 8 | 92 | 146 |
| rs1638043 | Imputed | C | REC | 430 | 2.964 | 0.4471 | 1.234 | 7.119 | 2.43 | 0.01509 | 0.893 | 0.23372 | 0.25272 | 0.21951 | 16 | 61 | 107 | 8 | 92 | 146 |
| rs1638115 | Imputed | A | GEN | 430 |  |  |  |  | 5.185 | 0.07483 | 0.5795 | 0.22209 | 0.2459 | 0.20445 | 15 | 60 | 108 | 8 | 85 | 154 |
| rs1638115 | Imputed | A | REC | 430 | 2.796 | 0.4515 | 1.154 | 6.774 | 2.277 | 0.0228 | 0.5795 | 0.22209 | 0.2459 | 0.20445 | 15 | 60 | 108 | 8 | 85 | 154 |
| rs1638444 | Imputed | C | GEN | 431 |  |  |  |  | 6.093 | 0.04752 | 1 | 0.22506 | 0.25272 | 0.20445 | 15 | 63 | 106 | 7 | 87 | 153 |
| rs1682946 | Imputed | A | ADD | 96 | 5.356 | 0.4472 | 2.229 | 12.87 | 3.753 | 0.00018 | 1 | 0.19792 | 0.32927 | 0.1 | 3 | 21 | 17 | 0 | 11 | 44 |
| rs1682946 | Imputed | A | DOM | 96 | 5.538 | 0.4642 | 2.23 | 13.76 | 3.688 | 0.00023 | 1 | 0.19792 | 0.32927 | 0.1 | 3 | 21 | 17 | 0 | 11 | 44 |
| rs11717157 | Imputed | A | ADD | 430 | 1.45 | 0.1393 | 1.104 | 1.906 | 2.67 | 0.00759 | 0.5855 | 0.34535 | 0.39946 | 0.30488 | 34 | 79 | 71 | 28 | 94 | 124 |
| rs11717157 | Imputed | T | GEN | 96 |  |  |  |  | 7.13 | 0.0283 | 0.02491 | 0.34535 | 0.39946 | 0.30488 | 34 | 79 | 71 | 28 | 94 | 124 |
| rs11724055 | Imputed | A | DOM | 431 | 0.7804 | 0.2073 | 0.5199 | 1.172 | -1.196 | 0.2317 | 0.6351 | 0.18794 | 0.1712 | 0.2004 | 5 | 53 | 126 | 8 | 83 | 156 |
| rs11743355 | Imputed | C | ADD | 431 | 0.309 | 0.5694 | 0.1012 | 0.9434 | -2.062 | 0.03918 | 1 | 0.0232 | 0.01087 | 0.03239 | 0 | 4 | 180 | 0 | 16 | 231 |
| rs11743355 | Imputed | C | DOM | 431 | 0.309 | 0.5694 | 0.1012 | 0.9434 | -2.062 | 0.03918 | 1 | 0.0232 | 0.01087 | 0.03239 | 0 | 4 | 180 | 0 | 16 | 231 |
| rs11746806 | Imputed | T | ADD | 431 | 0.309 | 0.5694 | 0.1012 | 0.9434 | -2.062 | 0.03918 | 1 | 0.0232 | 0.01087 | 0.03239 | 0 | 4 | 180 | 0 | 16 | 231 |
| rs11746806 | Imputed | T | DOM | 431 | 0.309 | 0.5694 | 0.1012 | 0.9434 | -2.062 | 0.03918 | 1 | 0.0232 | 0.01087 | 0.03239 | 0 | 4 | 180 | 0 | 16 | 231 |
| rs11746959 | Imputed | C | ADD | 431 | 0.309 | 0.5694 | 0.1012 | 0.9434 | -2.062 | 0.03918 | 1 | 0.0232 | 0.01087 | 0.03239 | 0 | 4 | 180 | 0 | 16 | 231 |
| rs11746959 | Imputed | C | DOM | 431 | 0.309 | 0.5694 | 0.1012 | 0.9434 | -2.062 | 0.03918 | 1 | 0.0232 | 0.01087 | 0.03239 | 0 | 4 | 180 | 0 | 16 | 231 |
| rs11749272 | Imputed | T | DOM | 431 | 0.7035 | 0.1964 | 0.4787 | 1.034 | -1.791 | 0.07336 | 0.7398 | 0.32019 | 0.2962 | 0.33806 | 20 | 69 | 95 | 26 | 115 | 106 |
| rs11839636 | Imputed | C | GEN | 431 |  |  |  |  | 7.984 | 0.01846 | 0.5855 | 0.32831 | 0.3587 | 0.30567 | 30 | 72 | 82 | 19 | 113 | 115 |
| rs11839785 | Imputed | C | GEN | 431 |  |  |  |  | 7.984 | 0.01846 | 0.5855 | 0.32831 | 0.3587 | 0.30567 | 30 | 72 | 82 | 19 | 113 | 115 |
| rs11853619 | Imputed | C | GEN | 431 |  |  |  |  | 6.084 | 0.04773 | 0.8893 | 0.22274 | 0.25 | 0.20243 | 15 | 62 | 107 | 7 | 86 | 154 |
| rs11853619 | Imputed | C | REC | 431 | 3.183 | 0.4709 | 1.265 | 8.011 | 2.459 | 0.01395 | 0.8893 | 0.22274 | 0.25 | 0.20243 | 15 | 62 | 107 | 7 | 86 | 154 |
| rs11856780 | Imputed | A | GEN | 431 |  |  |  |  | 6.084 | 0.04773 | 0.8893 | 0.22274 | 0.25 | 0.20243 | 15 | 62 | 107 | 7 | 86 | 154 |
| rs11856780 | Imputed | A | REC | 431 | 3.183 | 0.4709 | 1.265 | 8.011 | 2.459 | 0.01395 | 0.8893 | 0.22274 | 0.25 | 0.20243 | 15 | 62 | 107 | 7 | 86 | 154 |

TABLE 15-continued

| SNP rs # | SOURCE | AL-LELE (A1) | MOD-EL | NMISS | OR | SE | L95 | U95 | STAT | P | HW_PVALUE | AL-LELE FREQ | PRA-VA_AL-LELE FREQ | PLA-CEBO_AL-LELE FREQ | PRA-VA_A1_HZ_COUNT | PRA-VA_HET_COUNT | PRA-VA_A2_HZ_COUNT | PLA-CEBO_A1_HZ_COUNT | PLA-CEBO_HET_COUNT | PLA-CEBO_A2_HZ_COUNT |
|---|---|---|---|---|---|---|---|---|---|---|---|---|---|---|---|---|---|---|---|---|
| rs11901899 | Imputed | A | DOM | 426 | 1.822 | 0.199 | 1.234 | 2.692 | 3.016 | 0.00256 | 0.5562 | 0.28873 | 0.34254 | 0.24898 | 20 | 84 | 77 | 18 | 86 | 141 |
| rs11903290 | Imputed | C | REC | 425 | 1.901 | 0.3376 | 0.9811 | 3.684 | 1.903 | 0.057 | 0.909 | 0.30471 | 0.32597 | 0.28893 | 23 | 72 | 86 | 17 | 107 | 120 |
| rs11909480 | Imputed | G | ADD | 431 | 0.5964 | 0.404 | 0.2701 | 1.317 | -1.279 | 0.2008 | 0.3857 | 0.03364 | 0.02446 | 0.04049 | 0 | 9 | 175 | 1 | 18 | 228 |
| rs11909480 | Imputed | G | DOM | 431 | 0.61 | 0.4187 | 0.2685 | 1.386 | -1.181 | 0.2377 | 0.3857 | 0.03364 | 0.02446 | 0.04049 | 0 | 9 | 175 | 1 | 18 | 228 |
| rs11910289 | Imputed | T | ADD | 428 | 2.254 | 0.3513 | 1.132 | 4.487 | 2.313 | 0.02074 | 0.5361 | 0.04206 | 0.06011 | 0.02857 | 1 | 20 | 162 | 0 | 14 | 231 |
| rs11910289 | Imputed | T | DOM | 428 | 2.226 | 0.3621 | 1.095 | 4.527 | 2.21 | 0.02707 | 0.5361 | 0.04206 | 0.06011 | 0.02857 | 1 | 20 | 162 | 0 | 14 | 231 |
| rs11920375 | Genotyped | C | GEN | 431 | | | | | 6.381 | 0.04115 | 0.02563 | 0.34571 | 0.39674 | 0.30769 | 33 | 80 | 71 | 29 | 94 | 124 |
| rs11926319 | Imputed | G | DOM | 429 | 0.5229 | 0.2621 | 0.3128 | 0.874 | -2.474 | 0.01336 | 0.7867 | 0.10023 | 0.07065 | 0.12245 | 0 | 26 | 158 | 3 | 54 | 188 |
| rs11933744 | Imputed | T | REC | 431 | 3.01 | 0.47 | 1.198 | 7.563 | 2.345 | 0.01904 | 1 | 0.22738 | 0.25272 | 0.2085 | 15 | 63 | 106 | 7 | 89 | 151 |
| rs11934919 | Imputed | C | REC | 431 | 3.01 | 0.47 | 1.198 | 7.563 | 2.345 | 0.01904 | 1 | 0.22738 | 0.25272 | 0.2085 | 15 | 63 | 106 | 7 | 89 | 151 |
| rs11934957 | Imputed | C | REC | 431 | 3.01 | 0.47 | 1.198 | 7.563 | 2.345 | 0.01904 | 1 | 0.22738 | 0.25272 | 0.2085 | 15 | 63 | 106 | 7 | 89 | 151 |
| rs11959206 | Imputed | A | REC | 428 | 0.5862 | 0.2628 | 0.3502 | 0.9812 | -2.032 | 0.04213 | 0.3793 | 0.44509 | 0.42896 | 0.45714 | 26 | 105 | 52 | 54 | 116 | 75 |
| rs12038613 | Imputed | C | REC | 429 | 0.5999 | 0.2756 | 0.3495 | 1.03 | -1.854 | 0.06381 | 0.6194 | 0.41492 | 0.39891 | 0.42683 | 24 | 98 | 61 | 47 | 116 | 83 |
| rs12151417 | Imputed | T | DOM | 428 | 1.573 | 0.1977 | 1.067 | 2.317 | 2.29 | 0.02204 | 0.04209 | 0.28037 | 0.32418 | 0.24797 | 15 | 88 | 79 | 10 | 102 | 134 |
| rs12153185 | Imputed | T | REC | 426 | 0.6973 | 0.1977 | 0.4733 | 1.027 | -1.824 | 0.06815 | 0.8238 | 0.32042 | 0.29396 | 0.34016 | 19 | 69 | 94 | 26 | 114 | 104 |
| rs12182651 | Imputed | T | DOM | 431 | 2.24 | 0.3143 | 1.21 | 4.147 | 2.566 | 0.0103 | 0.1777 | 0.05916 | 0.08152 | 0.04251 | 1 | 28 | 155 | 2 | 17 | 228 |
| rs12235345 | Imputed | C | DOM | 430 | 1.42 | 0.2727 | 0.8321 | 2.423 | 1.286 | 0.1985 | 1 | 0.07674 | 0.08696 | 0.06911 | 1 | 32 | 152 | 2 | 30 | 214 |
| rs12324786 | Imputed | T | GEN | 430 | | | | | 5.185 | 0.07483 | 0.5795 | 0.22209 | 0.2459 | 0.20445 | 15 | 60 | 108 | 8 | 85 | 154 |
| rs12324786 | Imputed | T | REC | 430 | 2.796 | 0.4515 | 1.154 | 6.774 | 2.277 | 0.0228 | 0.5795 | 0.22209 | 0.2459 | 0.20445 | 15 | 60 | 108 | 8 | 85 | 154 |
| rs12336958 | Imputed | G | DOM | 403 | 1.46 | 0.211 | 0.9657 | 2.208 | 1.794 | 0.07276 | 0.3339 | 0.366 | 0.39759 | 0.34388 | 22 | 88 | 56 | 27 | 109 | 101 |
| rs12407412 | Imputed | C | ADD | 431 | 1.382 | 0.1928 | 0.9468 | 2.016 | 1.676 | 0.09367 | 0.1056 | 0.13689 | 0.16033 | 0.11943 | 7 | 45 | 132 | 5 | 49 | 193 |
| rs12407412 | Imputed | C | DOM | 431 | 1.401 | 0.2256 | 0.9007 | 2.181 | 1.496 | 0.1346 | 0.1056 | 0.13689 | 0.16033 | 0.11943 | 7 | 45 | 132 | 5 | 49 | 193 |
| rs12418971 | Imputed | C | GEN | 423 | | | | | 1.464 | 0.481 | 0.2341 | 0.24232 | 0.2486 | 0.2377 | 11 | 67 | 101 | 9 | 98 | 137 |
| rs12418971 | Imputed | C | REC | 423 | 1.699 | 0.4623 | 0.6866 | 4.204 | 1.147 | 0.2515 | 0.2341 | 0.24232 | 0.2486 | 0.2377 | 11 | 67 | 101 | 9 | 98 | 137 |
| rs12241967 | Imputed | T | DOM | 431 | 0.5915 | 0.3332 | 0.3078 | 1.136 | -1.576 | 0.115 | 0.519 | 0.33875 | 0.33152 | 0.34413 | 15 | 92 | 77 | 31 | 108 | 108 |
| rs12420184 | Imputed | G | DOM | 430 | 0.6518 | 0.2209 | 0.4227 | 1.005 | -1.938 | 0.05266 | 0.2101 | 0.16163 | 0.12772 | 0.18699 | 3 | 41 | 140 | 12 | 68 | 166 |
| rs12433968 | Imputed | T | DOM | 396 | 0.7213 | 0.2052 | 0.4825 | 1.078 | -1.592 | 0.1114 | 1 | 0.28914 | 0.26946 | 0.30349 | 15 | 60 | 92 | 18 | 103 | 108 |
| rs12445477 | Imputed | A | DOM | 423 | 0.4063 | 0.2966 | 0.2272 | 0.7267 | -3.036 | 0.0024 | 0.5364 | 0.08629 | 0.05307 | 0.11066 | 1 | 17 | 161 | 3 | 48 | 193 |
| rs12447191 | Imputed | C | ADD | 431 | 0.6489 | 0.1758 | 0.4598 | 0.9158 | -2.461 | 0.01387 | 0.6616 | 0.20766 | 0.16848 | 0.23684 | 10 | 42 | 132 | 10 | 97 | 140 |
| rs12447191 | Genotyped | C | DOM | 431 | 0.5081 | 0.2092 | 0.3372 | 0.7656 | -3.237 | 0.00121 | 0.6616 | 0.20766 | 0.16848 | 0.23684 | 10 | 42 | 132 | 10 | 97 | 140 |
| rs12465349 | Genotyped | T | REC | 426 | 1.587 | 0.2245 | 1.022 | 2.464 | 2.056 | 0.03975 | 1 | 0.50587 | 0.55163 | 0.47107 | 56 | 91 | 37 | 53 | 122 | 67 |
| rs12247340 | Imputed | A | ADD | 431 | 1.51 | 0.1734 | 1.075 | 2.122 | 2.377 | 0.01746 | 0.1479 | 0.18329 | 0.22283 | 0.15385 | 9 | 64 | 111 | 10 | 56 | 181 |
| rs12247340 | Imputed | A | DOM | 431 | 1.767 | 0.2092 | 1.173 | 2.663 | 2.721 | 0.0065 | 0.1479 | 0.18329 | 0.22283 | 0.15385 | 9 | 64 | 111 | 10 | 56 | 181 |
| rs12247341 | Imputed | C | ADD | 430 | 1.524 | 0.1738 | 1.084 | 2.143 | 2.426 | 0.01527 | 0.1445 | 0.18256 | 0.22283 | 0.15244 | 9 | 64 | 111 | 10 | 55 | 181 |
| rs12247341 | Imputed | C | DOM | 430 | 1.795 | 0.2098 | 1.19 | 2.707 | 2.788 | 0.0053 | 0.1445 | 0.18256 | 0.22283 | 0.15244 | 9 | 64 | 111 | 10 | 55 | 181 |
| rs12247343 | Imputed | C | ADD | 430 | 1.681 | 0.2249 | 1.081 | 2.612 | 2.308 | 0.02099 | 0.8388 | 0.13488 | 0.16033 | 0.11585 | 12 | 55 | 127 | 6 | 45 | 195 |
| rs12509758 | Imputed | T | DOM | 430 | 1.856 | 0.204 | 1.244 | 2.768 | 3.03 | 0.00245 | 0.7673 | 0.20465 | 0.25543 | 0.16667 | 12 | 70 | 102 | 7 | 68 | 171 |
| rs12515472 | Imputed | A | DOM | 431 | 1.531 | 0.205 | 1.144 | 2.287 | 2.076 | 0.03785 | 0.3479 | 0.18794 | 0.21196 | 0.17004 | 8 | 70 | 110 | 8 | 68 | 171 |
| rs12548906 | Imputed | G | ADD | 420 | 1.496 | 0.1799 | 1.052 | 2.129 | 2.241 | 0.02504 | 0.1402 | 0.20833 | 0.24444 | 0.18125 | 7 | 74 | 99 | 6 | 75 | 159 |
| rs12596240 | Imputed | G | REC | 430 | 0.6708 | 0.2061 | 0.4479 | 1.005 | -1.937 | 0.05268 | 0.08793 | 0.4 | 0.38043 | 0.41463 | 28 | 84 | 72 | 32 | 140 | 74 |
| rs12618781 | Imputed | A | DOM | 407 | 0.5446 | 0.2216 | 0.3528 | 0.8408 | -2.743 | 0.00609 | 0.7652 | 0.45332 | 0.41124 | 0.48319 | 32 | 75 | 62 | 50 | 56 | 58 |
| rs12678600 | Imputed | A | DOM | 431 | 0.6479 | 0.1972 | 0.4402 | 0.9536 | -2.201 | 0.02773 | 0.7429 | 0.32599 | 0.28261 | 0.3583 | 14 | 76 | 94 | 30 | 117 | 100 |
| rs12692229 | Imputed | T | ADD | 430 | 1.315 | 0.1467 | 0.9861 | 1.753 | 1.864 | 0.06226 | 0.8275 | 0.33023 | 0.36413 | 0.30488 | 26 | 82 | 76 | 22 | 106 | 118 |
| rs12713324 | Imputed | T | DOM | 427 | 1.584 | 0.1981 | 1.074 | 2.335 | 2.321 | 0.02028 | 0.08929 | 0.27518 | 0.31868 | 0.24286 | 15 | 86 | 81 | 10 | 99 | 136 |
| rs12719415 | Imputed | T | DOM | 429 | 0.6887 | 0.197 | 0.4682 | 1.013 | -1.893 | 0.05831 | 1 | 0.31702 | 0.28962 | 0.3374 | 18 | 70 | 95 | 25 | 116 | 105 |
| rs12820589 | Imputed | G | ADD | 418 | 1.758 | 0.1836 | 1.227 | 2.519 | 3.073 | 0.00212 | 0.4989 | 0.17584 | 0.225 | 0.13866 | 9 | 63 | 108 | 6 | 54 | 178 |

TABLE 15-continued

| SNP rs # | SOURCE | AL-LELE (A1) | MOD-EL | NMISS | OR | SE | L95 | U95 | STAT | P | HW_PVA-LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs12820589 | Imputed | G | DOM | 418 | 1.936 | 0.214 | 1.273 | 2.946 | 3.088 | 0.00202 | 0.4989 | 0.17584 | 0.225 | 0.13866 | 9 | 63 | 108 | 6 | 54 | 178 |
| rs12831292 | Imputed | G | ADD | 431 | 0.6841 | 0.1503 | 0.5096 | 0.9184 | -2.527 | 0.01152 | 0.132 | 0.40023 | 0.35054 | 0.43725 | 20 | 89 | 75 | 41 | 134 | 72 |
| rs12831292 | Imputed | G | DOM | 431 | 0.62 | 0.207 | 0.4133 | 0.9302 | -2.31 | 0.0209 | 0.132 | 0.40023 | 0.35054 | 0.43725 | 20 | 89 | 75 | 41 | 134 | 72 |
| rs13012636 | Imputed | G | REC | 425 | 1.901 | 0.3376 | 0.9811 | 3.684 | 1.903 | 0.057 | 0.909 | 0.30471 | 0.32597 | 0.28893 | 23 | 72 | 86 | 17 | 107 | 120 |
| rs13038146 | Imputed | C | ADD | 431 | 1.407 | 0.1412 | 1.067 | 1.855 | 2.418 | 0.01561 | 0.1149 | 0.35267 | 0.39674 | 0.31984 | 30 | 86 | 68 | 31 | 96 | 120 |
| rs13038146 | Imputed | C | GEN | 431 |  |  |  |  | 6.605 | 0.0368 | 0.1149 | 0.35267 | 0.39674 | 0.31984 | 30 | 86 | 68 | 31 | 96 | 120 |
| rs13038146 | Imputed | C | REC | 431 | 1.414 | 0.279 | 0.8186 | 2.444 | 1.243 | 0.214 | 0.1149 | 0.35267 | 0.39674 | 0.31984 | 30 | 86 | 68 | 31 | 96 | 120 |
| rs13099860 | Imputed | A | DOM | 358 | 0.6221 | 0.23 | 0.3963 | 0.9764 | -2.064 | 0.03904 | 0.02583 | 0.46229 | 0.41503 | 0.49756 | 32 | 63 | 58 | 55 | 94 | 56 |
| rs13102419 | Imputed | T | REC | 429 | 1.668 | 0.2387 | 1.045 | 2.663 | 2.144 | 0.03201 | 0.7714 | 0.46503 | 0.49728 | 0.44082 | 48 | 87 | 49 | 43 | 130 | 72 |
| rs13194907 | Imputed | A | ADD | 431 | 1.964 | 0.3063 | 1.077 | 3.579 | 2.203 | 0.02757 | 1 | 0.05568 | 0.07609 | 0.04049 | 0 | 28 | 156 | 1 | 18 | 228 |
| rs13194907 | Imputed | A | DOM | 431 | 2.136 | 0.3162 | 1.15 | 3.97 | 2.401 | 0.01635 | 1 | 0.05568 | 0.07609 | 0.04049 | 0 | 28 | 156 | 1 | 18 | 228 |
| rs13195745 | Imputed | A | ADD | 431 | 1.964 | 0.3063 | 1.077 | 3.579 | 2.203 | 0.02757 | 1 | 0.05568 | 0.07609 | 0.04049 | 0 | 28 | 156 | 1 | 18 | 228 |
| rs13195745 | Imputed | A | DOM | 431 | 2.136 | 0.3162 | 1.15 | 3.97 | 2.401 | 0.01635 | 1 | 0.05568 | 0.07609 | 0.04049 | 0 | 28 | 156 | 1 | 18 | 228 |
| rs13265054 | Imputed | T | DOM | 421 | 0.6754 | 0.199 | 0.4573 | 0.9976 | -1.972 | 0.04863 | 0.8246 | 0.32423 | 0.28453 | 0.35417 | 14 | 75 | 92 | 29 | 112 | 99 |
| rs13273002 | Imputed | A | GEN | 429 |  |  |  |  | 3.598 | 0.1655 | 0.88 | 0.19814 | 0.1712 | 0.21837 | 3 | 57 | 124 | 13 | 81 | 151 |
| rs13282131 | Imputed | C | ADD | 431 | 1.415 | 0.1363 | 1.084 | 1.849 | 2.549 | 0.0108 | 0.2104 | 0.47332 | 0.52446 | 0.43522 | 53 | 87 | 44 | 50 | 115 | 82 |
| rs13282131 | Imputed | C | DOM | 431 |  |  |  |  | 6.498 | 0.03882 | 0.2104 | 0.47332 | 0.52446 | 0.43522 | 53 | 87 | 44 | 50 | 115 | 82 |
| rs13282131 | Imputed | C | REC | 431 | 1.595 | 0.2279 | 1.02 | 2.493 | 2.048 | 0.04058 | 0.2104 | 0.47332 | 0.52446 | 0.43522 | 53 | 87 | 44 | 50 | 115 | 82 |
| rs1330052 | Imputed | G | GEN | 431 |  |  |  |  | 11.32 | 0.00349 | 0.4097 | 0.37007 | 0.39674 | 0.3502 | 38 | 70 | 76 | 25 | 123 | 99 |
| rs1335721 | Imputed | A | REC | 429 | 0.5999 | 0.2756 | 0.3495 | 1.03 | -1.854 | 0.06381 | 0.6194 | 0.41492 | 0.39891 | 0.42683 | 24 | 98 | 61 | 47 | 116 | 83 |
| rs1336382 | Imputed | T | DOM | 430 | 1.458 | 0.197 | 0.9908 | 2.145 | 1.913 | 0.05576 | 0.4158 | 0.29419 | 0.32065 | 0.27439 | 18 | 82 | 84 | 23 | 89 | 134 |
| rs1336383 | Imputed | T | DOM | 430 | 1.458 | 0.197 | 0.9908 | 2.145 | 1.913 | 0.05576 | 0.4158 | 0.29419 | 0.32065 | 0.27439 | 18 | 82 | 84 | 23 | 89 | 134 |
| rs1336407 | Imputed | T | DOM | 430 | 1.458 | 0.197 | 0.9908 | 2.145 | 1.913 | 0.05576 | 0.4158 | 0.29419 | 0.32065 | 0.27439 | 18 | 82 | 84 | 23 | 89 | 134 |
| rs1336409 | Imputed | T | DOM | 430 | 1.458 | 0.197 | 0.9908 | 2.145 | 1.913 | 0.05576 | 0.4158 | 0.29419 | 0.32065 | 0.27439 | 18 | 82 | 84 | 23 | 89 | 134 |
| rs1336596 | Imputed | A | DOM | 430 | 0.6728 | 0.2004 | 0.4543 | 0.9965 | -1.978 | 0.04797 | 0.2989 | 0.36512 | 0.33967 | 0.38415 | 23 | 79 | 82 | 29 | 131 | 86 |
| rs13387284 | Imputed | A | REC | 400 | 0.5278 | 0.2223 | 0.3414 | 0.816 | -2.875 | 0.00404 | 0.7625 | 0.44625 | 0.39458 | 0.48291 | 28 | 75 | 63 | 50 | 126 | 58 |
| rs13401462 | Imputed | C | ADD | 424 | 2.137 | 0.2339 | 1.351 | 3.38 | 3.245 | 0.00117 | 0.6266 | 0.48113 | 0.53352 | 0.44286 | 47 | 97 | 35 | 54 | 109 | 82 |
| rs13409045 | Imputed | T | ADD | 431 | 0.6931 | 0.1457 | 0.521 | 0.9221 | -2.517 | 0.01184 | 0.6898 | 0.40371 | 0.35598 | 0.43927 | 22 | 87 | 75 | 46 | 125 | 76 |
| rs1349284 | Imputed | C | GEN | 431 |  |  |  |  | 0.02279 | 0.04132 | 0.34107 | 0.39674 | 0.2996 | 0.2996 | 33 | 80 | 71 | 27 | 94 | 126 |
| rs1355715 | Imputed | T | ADD | 430 | 0.5755 | 0.3625 | 0.2828 | 1.171 | -1.524 | 0.1275 | 1 | 0.04535 | 0.03261 | 0.05488 | 0 | 12 | 172 | 0 | 27 | 219 |
| rs1357696 | Imputed | A | GEN | 426 |  |  |  |  | 5.96 | 0.05078 | 0.03445 | 0.35563 | 0.40489 | 0.31818 | 34 | 81 | 69 | 30 | 94 | 118 |
| rs1357698 | Imputed | A | GEN | 426 |  |  |  |  | 5.96 | 0.05078 | 0.03445 | 0.35563 | 0.40489 | 0.31818 | 34 | 81 | 69 | 30 | 94 | 118 |
| rs1357699 | Imputed | T | GEN | 426 |  |  |  |  | 5.96 | 0.05078 | 0.03445 | 0.35563 | 0.40489 | 0.31818 | 34 | 81 | 69 | 30 | 94 | 118 |
| rs1363273 | Imputed | C | REC | 404 | 0.5817 | 0.2679 | 0.344 | 0.9834 | -2.023 | 0.04312 | 0.6881 | 0.44554 | 0.42105 | 0.46352 | 25 | 94 | 52 | 53 | 110 | 70 |
| rs1373601 | Imputed | A | DOM | 400 | 0.5287 | 0.2065 | 0.3527 | 0.7925 | -3.086 | 0.00203 | 0.00407 | 0.32125 | 0.27326 | 0.35746 | 23 | 48 | 101 | 31 | 101 | 96 |
| rs1375829 | Imputed | C | GEN | 431 |  |  |  |  | -2.11 | 0.02279 | 0.04132 | 0.34107 | 0.39674 | 0.2996 | 33 | 80 | 71 | 27 | 94 | 126 |
| rs1395748 | Imputed | G | DOM | 431 | 0.6603 | 0.1967 | 0.4491 | 0.9708 | -2.11 | 0.03482 | 0.6452 | 0.29698 | 0.26902 | 0.31781 | 18 | 63 | 103 | 22 | 113 | 112 |
| rs1414865 | Imputed | T | DOM | 430 | 1.433 | 0.1969 | 0.9742 | 2.108 | 1.827 | 0.06765 | 0.4183 | 0.29535 | 0.32337 | 0.2996 | 33 | 81 | 71 | 22 | 94 | 133 |
| rs1414873 | Imputed | A | DOM | 430 | 1.458 | 0.197 | 0.9908 | 2.145 | 1.913 | 0.05576 | 0.4158 | 0.29419 | 0.32065 | 0.27439 | 19 | 84 | 84 | 23 | 91 | 134 |
| rs1414876 | Imputed | C | DOM | 430 | 1.458 | 0.197 | 0.9908 | 2.145 | 1.913 | 0.05576 | 0.4158 | 0.29419 | 0.32065 | 0.27439 | 18 | 82 | 84 | 23 | 89 | 134 |
| rs1424643 | Imputed | G | ADD | 423 | 1.554 | 0.1651 | 1.124 | 2.148 | 2.669 | 0.00761 | 0.0693 | 0.27896 | 0.32402 | 0.2459 | 15 | 86 | 78 | 10 | 100 | 134 |
| rs1424643 | Imputed | G | DOM | 423 | 1.592 | 0.199 | 1.078 | 2.351 | 2.336 | 0.01947 | 0.0693 | 0.27896 | 0.32402 | 0.2459 | 15 | 86 | 78 | 10 | 100 | 134 |
| rs1424648 | Imputed | T | DOM | 431 | 1.619 | 0.1972 | 1.1 | 2.383 | 2.444 | 0.01451 | 0.04199 | 0.28074 | 0.32065 | 0.25101 | 13 | 92 | 79 | 12 | 102 | 135 |
| rs1429321 | Imputed | A | ADD | 426 | 1.545 | 0.1979 | 1.048 | 2.277 | 2.198 | 0.02793 | 0.04156 | 0.28169 | 0.32418 | 0.25 | 15 | 88 | 79 | 10 | 102 | 132 |
| rs1429326 | Imputed | T | ADD | 423 | 1.514 | 0.1654 | 1.094 | 2.093 | 2.505 | 0.01223 | 0.08559 | 0.27305 | 0.31421 | 0.24167 | 14 | 87 | 82 | 10 | 96 | 134 |
| rs1429326 | Imputed | T | DOM | 423 | 1.573 | 0.1984 | 1.066 | 2.321 | 2.284 | 0.02236 | 0.08559 | 0.27305 | 0.31421 | 0.24167 | 14 | 87 | 82 | 10 | 96 | 134 |

TABLE 15-continued

| SNP rs # | SOURCE | AL-LELE (A1) | MOD-EL | NMISS | OR | SE | L95 | U95 | STAT | P | HW_PVALUE | AL-LELE FREQ | PRA-VA_AL-LELE FREQ | PLA-CEBO_AL-LELE FREQ | PRA-VA_A1_HZ_COUNT | PRA-VA_HET_COUNT | PRA-VA_A2_HZ_COUNT | PLA-CEBO_A1_HZ_COUNT | PLA-CEBO_HET_COUNT | PLA-CEBO_A2_HZ_COUNT |
|---|---|---|---|---|---|---|---|---|---|---|---|---|---|---|---|---|---|---|---|---|
| rs1444741 | Imputed | A | DOM | 407 | 0.5155 | 0.205 | 0.3449 | 0.7703 | -3.233 | 0.00122 | 0.00416 | 0.31818 | 0.26857 | 0.3556 | 23 | 48 | 104 | 31 | 103 | 98 |
| rs1449916 | Imputed | C | DOM | 338 | 0.4287 | 0.2519 | 0.2617 | 0.7025 | -3.362 | 0.00077 | 0.3854 | 0.49556 | 0.41045 | 0.55147 | 25 | 60 | 49 | 62 | 101 | 41 |
| rs1459523 | Imputed | A | ADD | 430 | 1.45 | 0.1393 | 1.104 | 1.906 | 2.67 | 0.00759 | 0.02491 | 0.34535 | 0.39946 | 0.30488 | 34 | 79 | 71 | 28 | 94 | 124 |
| rs1459523 | Imputed | A | GEN | 430 | | | | | 7.13 | 0.0283 | 0.02491 | 0.34535 | 0.39946 | 0.30488 | 34 | 79 | 71 | 28 | 94 | 124 |
| rs1466352 | Imputed | T | GEN | 431 | | | | | 6.792 | 0.0335 | 0.0334 | 0.34687 | 0.39946 | 0.30769 | 34 | 79 | 71 | 28 | 96 | 123 |
| rs1466353 | Imputed | G | GEN | 431 | | | | | 6.792 | 0.0335 | 0.0334 | 0.34687 | 0.39946 | 0.30769 | 34 | 79 | 71 | 28 | 96 | 123 |
| rs1476714 | Imputed | A | DOM | 429 | 0.6887 | 0.197 | 0.4682 | 1.013 | -1.893 | 0.05831 | 1 | 0.31702 | 0.28962 | 0.3374 | 18 | 70 | 95 | 25 | 116 | 105 |
| rs1486723 | Imputed | C | REC | 431 | 0.6161 | 0.3308 | 0.3222 | 1.178 | -1.464 | 0.1431 | 0.6673 | 0.33387 | 0.33424 | 0.34211 | 15 | 93 | 76 | 32 | 105 | 110 |
| rs1495375 | Imputed | A | ADD | 431 | 0.6996 | 0.1493 | 0.5222 | 0.9374 | -2.393 | 0.0167 | 0.1622 | 0.40371 | 0.35598 | 0.43927 | 21 | 89 | 74 | 42 | 133 | 72 |
| rs1495375 | Imputed | A | DOM | 431 | 0.6354 | 0.2073 | 0.4232 | 0.9539 | -2.188 | 0.02869 | 0.1622 | 0.40371 | 0.35598 | 0.43927 | 21 | 89 | 74 | 42 | 133 | 72 |
| rs1495381 | Imputed | T | GEN | 431 | | | | | 4.34 | 0.1142 | 0.9218 | 0.42923 | 0.45652 | 0.40891 | 43 | 82 | 59 | 37 | 128 | 82 |
| rs1495381 | Imputed | T | REC | 431 | 1.661 | 0.2511 | 1.015 | 2.717 | 2.021 | 0.04331 | 0.9218 | 0.42923 | 0.45652 | 0.40891 | 43 | 82 | 59 | 37 | 128 | 82 |
| rs1498061 | Imputed | C | ADD | 201 | 0.614 | 0.2646 | 0.3655 | 1.031 | -1.843 | 0.06527 | 0.2527 | 0.19154 | 0.14881 | 0.22222 | 1 | 23 | 60 | 9 | 34 | 74 |
| rs1498992 | Imputed | G | DOM | 430 | 0.7209 | 0.1965 | 0.4905 | 1.06 | -1.666 | 0.09577 | 0.9083 | 0.29651 | 0.27174 | 0.31504 | 15 | 70 | 99 | 22 | 111 | 113 |
| rs1499001 | Imputed | T | ADD | 428 | 0.7112 | 0.1982 | 0.4823 | 1.049 | -1.719 | 0.08562 | 0.8032 | 0.26168 | 0.23913 | 0.27869 | 12 | 64 | 108 | 16 | 104 | 124 |
| rs1512988 | Imputed | A | ADD | 429 | 0.6768 | 0.1508 | 0.5037 | 0.9096 | -2.589 | 0.00964 | 0.1315 | 0.40093 | 0.34973 | 0.43902 | 20 | 88 | 75 | 41 | 134 | 71 |
| rs1512988 | Imputed | A | DOM | 429 | 0.6068 | 0.2078 | 0.4038 | 0.9117 | -2.405 | 0.01618 | 0.1315 | 0.40093 | 0.34973 | 0.43902 | 20 | 88 | 75 | 41 | 134 | 71 |
| rs1512989 | Imputed | T | ADD | 429 | 0.6768 | 0.1508 | 0.5037 | 0.9096 | -2.589 | 0.00964 | 0.1315 | 0.40093 | 0.34973 | 0.43902 | 20 | 88 | 75 | 41 | 134 | 71 |
| rs1512989 | Imputed | T | DOM | 429 | 0.6068 | 0.2078 | 0.4038 | 0.9117 | -2.405 | 0.01618 | 0.1315 | 0.40093 | 0.34973 | 0.43902 | 20 | 88 | 75 | 41 | 134 | 71 |
| rs1512991 | Imputed | T | ADD | 431 | 0.7609 | 0.1446 | 0.5731 | 1.01 | -1.89 | 0.05873 | 0.4308 | 0.42691 | 0.38859 | 0.45547 | 20 | 83 | 71 | 44 | 137 | 66 |
| rs1512991 | Imputed | T | DOM | 431 | 0.5996 | 0.2103 | 0.3971 | 0.9055 | -2.432 | 0.01501 | 0.4308 | 0.42691 | 0.38859 | 0.45547 | 30 | 83 | 71 | 44 | 137 | 66 |
| rs1512991 | Imputed | T | GEN | 431 | | | | | 6.036 | 0.04889 | 0.4308 | 0.42691 | 0.38859 | 0.45547 | 30 | 83 | 71 | 44 | 137 | 66 |
| rs1524303 | Imputed | T | GEN | 429 | | | | | 6.951 | 0.03095 | 0.02511 | 0.34615 | 0.39946 | 0.30612 | 34 | 79 | 71 | 28 | 94 | 123 |
| rs1524306 | Imputed | C | ADD | 431 | 1.457 | 0.1392 | 1.109 | 1.914 | 2.705 | 0.00682 | 0.0248 | 0.34455 | 0.39946 | 0.30364 | 34 | 79 | 71 | 28 | 94 | 125 |
| rs1524306 | Imputed | C | GEN | 431 | | | | | 7.32 | 0.02573 | 0.0248 | 0.34455 | 0.39946 | 0.30364 | 34 | 79 | 71 | 28 | 94 | 125 |
| rs1524310 | Imputed | G | ADD | 428 | 1.471 | 0.1406 | 1.117 | 1.937 | 2.744 | 0.00606 | 0.04097 | 0.34229 | 0.39835 | 0.30081 | 33 | 79 | 70 | 27 | 94 | 125 |
| rs1524310 | Imputed | G | GEN | 428 | | | | | 7.531 | 0.02315 | 0.04097 | 0.34229 | 0.39835 | 0.30081 | 33 | 79 | 70 | 27 | 94 | 125 |
| rs1524321 | Imputed | C | GEN | 423 | | | | | 7.53 | 0.02317 | 0.06463 | 0.33806 | 0.39286 | 0.29668 | 32 | 79 | 71 | 25 | 93 | 123 |
| rs1527059 | Imputed | A | DOM | 428 | 0.7558 | 0.266 | 0.4487 | 1.273 | -1.052 | 0.2927 | 0.7591 | 0.08762 | 0.07418 | 0.09756 | 0 | 27 | 155 | 2 | 44 | 200 |
| rs152707 | Imputed | T | ADD | 431 | 0.7681 | 0.1426 | 0.5808 | 1.016 | -1.85 | 0.06428 | 0.7628 | 0.39559 | 0.36141 | 0.42105 | 25 | 83 | 76 | 44 | 120 | 83 |
| rs152707 | Imputed | A | GEN | 431 | | | | | 3.606 | 0.1648 | 0.7628 | 0.39559 | 0.36141 | 0.42105 | 25 | 83 | 76 | 44 | 120 | 83 |
| rs152712 | Genotyped | C | ADD | 431 | 0.7606 | 0.1429 | 0.5748 | 1.007 | -1.914 | 0.05557 | 0.8406 | 0.39675 | 0.36141 | 0.42308 | 25 | 83 | 76 | 44 | 121 | 82 |
| rs152712 | Genotyped | C | GEN | 431 | | | | | 3.917 | 0.1411 | 0.8406 | 0.39675 | 0.36141 | 0.42308 | 25 | 83 | 76 | 44 | 121 | 82 |
| rs1533994 | Imputed | T | GEN | 431 | | | | | 6.792 | 0.0335 | 0.0334 | 0.34687 | 0.39946 | 0.30769 | 34 | 79 | 71 | 28 | 96 | 123 |
| rs1535866 | Imputed | G | DOM | 431 | 1.83 | 0.206 | 1.222 | 2.74 | 2.933 | 0.00336 | 0.531 | 0.1891 | 0.22554 | 0.16194 | 5 | 73 | 106 | 8 | 64 | 175 |
| rs1563773 | Imputed | T | ADD | 429 | | | | | 6.416 | 0.04044 | 0.04296 | 0.34848 | 0.39946 | 0.3102 | 34 | 79 | 71 | 28 | 96 | 121 |
| rs1563774 | Imputed | T | GEN | 431 | | | | | 6.792 | 0.0335 | 0.0334 | 0.34687 | 0.39946 | 0.30769 | 34 | 79 | 71 | 28 | 96 | 123 |
| rs1567740 | Imputed | T | ADD | 430 | 0.6776 | 0.1506 | 0.5044 | 0.9103 | -2.584 | 0.00976 | 0.1092 | 0.40116 | 0.35054 | 0.43902 | 20 | 89 | 75 | 41 | 134 | 71 |
| rs1567740 | Imputed | T | DOM | 430 | 0.6103 | 0.2074 | 0.4065 | 0.9164 | -2.381 | 0.01726 | 0.1092 | 0.40116 | 0.35054 | 0.43902 | 20 | 89 | 75 | 41 | 134 | 71 |
| rs1572573 | Imputed | A | GEN | 413 | 1.458 | 0.2093 | 0.9676 | 2.198 | 1.802 | 0.07148 | 0.1958 | 0.18523 | 0.20904 | 0.16737 | 4 | 66 | 107 | 6 | 67 | 163 |
| rs1577497 | Imputed | C | REC | 429 | 0.5999 | 0.2756 | 0.3495 | 1.03 | -1.854 | 0.06381 | 0.6194 | 0.41492 | 0.39891 | 0.42683 | 34 | 98 | 61 | 47 | 116 | 83 |
| rs1581514 | Imputed | T | ADD | 418 | 1.482 | 0.1411 | 1.124 | 1.954 | 2.79 | 0.00527 | 0.0181 | 0.34928 | 0.4073 | 0.30625 | 34 | 77 | 67 | 28 | 91 | 121 |
| rs1581514 | Imputed | T | GEN | 418 | | | | | 7.786 | 0.02039 | 0.0181 | 0.34928 | 0.4073 | 0.30625 | 34 | 77 | 67 | 28 | 91 | 121 |
| rs1582321 | Imputed | T | DOM | 431 | 0.6673 | 0.206 | 0.4456 | 0.9992 | -1.964 | 0.04955 | 0.41498 | 0.40023 | 0.38043 | 0.41498 | 28 | 84 | 72 | 32 | 141 | 74 |
| rs1582322 | Imputed | A | DOM | 426 | 0.6832 | 0.2069 | 0.4554 | 1.025 | -1.841 | 0.06568 | 0.107 | 0.40023 | 0.38187 | 0.41393 | 28 | 83 | 71 | 32 | 138 | 74 |
| rs1582323 | Imputed | A | DOM | 427 | 0.6891 | 0.2068 | 0.4595 | 1.034 | -1.8 | 0.07179 | 0.1066 | 0.40047 | 0.38251 | 0.41393 | 28 | 84 | 71 | 32 | 138 | 74 |

TABLE 15-continued

| SNP rs # | SOURCE | ALLELE (A1) | MODEL | NMISS | OR | SE | L95 | U95 | STAT | P | HW_PVALUE | ALLELE FREQ | PRAVA_ALLELE FREQ | PLACEBO_ALLELE FREQ | PRAVA_A1_HZ_COUNT | PRAVA_HET_COUNT | PRAVA_A2_HZ_COUNT | PLACEBO_A1_HZ_COUNT | PLACEBO_HET_COUNT | PLACEBO_A2_HZ_COUNT |
|---|---|---|---|---|---|---|---|---|---|---|---|---|---|---|---|---|---|---|---|---|
| rs1592485 | Imputed | C | DOM | 430 | 0.6849 | 0.2064 | 0.4571 | 1.026 | −1.834 | 0.06669 | 0.1326 | 0.40349 | 0.38315 | 0.4187 | 28 | 85 | 71 | 34 | 138 | 74 |
| rs1600954 | Imputed | T | ADD | 418 | 1.458 | 0.1435 | 1.1 | 1.931 | 2.627 | 0.00863 | 0.9216 | 0.45574 | 0.50833 | 0.41597 | 48 | 87 | 45 | 38 | 122 | 78 |
| rs1600954 | Imputed | T | GEN | 418 | | | | | 7.629 | 0.02204 | 0.9216 | 0.45574 | 0.50833 | 0.41597 | 48 | 87 | 45 | 38 | 122 | 78 |
| rs1693862 | Imputed | G | DOM | 417 | 0.6482 | 0.201 | 0.4371 | 0.9612 | −2.157 | 0.03103 | 0.5372 | 0.27218 | 0.23276 | 0.30041 | 9 | 63 | 102 | 19 | 108 | 116 |
| rs16964300 | Imputed | G | ADD | 431 | 0.6489 | 0.1758 | 0.4598 | 0.9158 | −2.461 | 0.01387 | 0.6616 | 0.20766 | 0.16848 | 0.23684 | 10 | 42 | 132 | 10 | 97 | 140 |
| rs16964300 | Imputed | G | DOM | 431 | 0.5081 | 0.2092 | 0.3372 | 0.7656 | −3.237 | 0.00121 | 0.6616 | 0.20766 | 0.16848 | 0.23684 | 10 | 42 | 132 | 10 | 97 | 140 |
| rs16986282 | Imputed | G | DOM | 429 | 0.6518 | 0.4222 | 0.2849 | 1.491 | −1.014 | 0.3106 | 0.3657 | 0.03263 | 0.02459 | 0.03862 | 0 | 9 | 174 | 1 | 17 | 228 |
| rs17007620 | Imputed | G | ADD | 387 | 1.684 | 0.1701 | 1.206 | 2.35 | 3.063 | 0.00219 | 1 | 0.25452 | 0.30838 | 0.21364 | 14 | 75 | 78 | 11 | 72 | 137 |
| rs17007620 | Imputed | G | DOM | 387 | 1.898 | 0.2093 | 1.259 | 2.861 | 3.062 | 0.0022 | 1 | 0.23452 | 0.30838 | 0.21364 | 14 | 75 | 78 | 11 | 72 | 137 |
| rs17014326 | Imputed | G | DOM | 429 | 0.6773 | 0.1968 | 0.4605 | 0.9961 | −1.98 | 0.04771 | 0.5678 | 0.30303 | 0.27717 | 0.32245 | 19 | 64 | 101 | 23 | 112 | 110 |
| rs17047957 | Imputed | C | DOM | 430 | 1.575 | 0.2288 | 1.006 | 2.466 | 1.986 | 0.047 | 0.1374 | 0.1314 | 0.15847 | 0.111134 | 6 | 46 | 131 | 5 | 45 | 197 |
| rs17051261 | Imputed | A | REC | 431 | 1.6 | 0.2523 | 0.9755 | 2.623 | 1.862 | 0.06263 | 0.7675 | 0.42442 | 0.44565 | 0.40854 | 42 | 80 | 62 | 37 | 127 | 82 |
| rs17073341 | Imputed | A | ADD | 431 | 1.335 | 0.3929 | 0.618 | 2.883 | 0.735 | 0.4624 | 1 | 0.03248 | 0.03804 | 0.02834 | 0 | 14 | 170 | 0 | 14 | 233 |
| rs17073341 | Imputed | A | DOM | 431 | 1.335 | 0.3929 | 0.618 | 2.883 | 0.735 | 0.4624 | 1 | 0.03248 | 0.03804 | 0.02834 | 0 | 14 | 170 | 0 | 14 | 233 |
| rs17138702 | Imputed | G | ADD | 429 | 0.7112 | 0.2144 | 0.4672 | 1.083 | −1.59 | 0.1119 | 0.6615 | 0.12704 | 0.10383 | 0.14431 | 1 | 36 | 146 | 7 | 57 | 182 |
| rs17189710 | Imputed | T | ADD | 431 | 1.407 | 0.1412 | 1.067 | 1.855 | 2.418 | 0.01561 | 0.1149 | 0.35267 | 0.31984 | 0.31984 | 30 | 86 | 68 | 31 | 96 | 120 |
| rs17189710 | Imputed | T | GEN | 431 | | | | | 6.605 | 0.0368 | 0.1149 | 0.35267 | 0.39674 | 0.31984 | 30 | 86 | 68 | 31 | 96 | 120 |
| rs17189710 | Imputed | T | REC | 431 | 1.414 | 0.279 | 0.8186 | 2.444 | 1.243 | 0.214 | 0.1149 | 0.35267 | 0.39674 | 0.31984 | 30 | 86 | 68 | 31 | 96 | 120 |
| rs17310176 | Imputed | T | ADD | 431 | 0.8153 | 0.1969 | 0.5542 | 1.199 | −1.037 | 0.2997 | 0.02653 | 0.17053 | 0.15761 | 0.18016 | 2 | 54 | 128 | 4 | 81 | 162 |
| rs17310176 | Imputed | T | DOM | 431 | 0.8122 | 0.2102 | 0.5379 | 1.226 | −0.989 | 0.3224 | 0.02653 | 0.17053 | 0.15761 | 0.18016 | 2 | 54 | 128 | 4 | 81 | 162 |
| rs17358860 | Imputed | A | DOM | 431 | 0.7804 | 0.2073 | 0.5199 | 1.172 | −1.196 | 0.2317 | 0.6351 | 0.18794 | 0.1712 | 0.2004 | 5 | 53 | 126 | 8 | 83 | 156 |
| rs17370541 | Imputed | T | GEN | 417 | | | | | 4.709 | 0.09495 | 0.9164 | 0.3693 | 0.38764 | 0.35565 | 31 | 76 | 71 | 25 | 120 | 94 |
| rs17370541 | Imputed | T | REC | 417 | 1.782 | 0.2901 | 1.009 | 3.147 | 1.991 | 0.04643 | 0.9164 | 0.3693 | 0.38764 | 0.35565 | 31 | 76 | 71 | 25 | 120 | 94 |
| rs17526574 | Imputed | G | GEN | 431 | | | | | 7.984 | 0.01846 | 0.5855 | 0.32831 | 0.3587 | 0.30567 | 30 | 72 | 82 | 19 | 113 | 115 |
| rs17530747 | Imputed | T | DOM | 422 | 0.7249 | 0.1996 | 0.4902 | 1.072 | −1.612 | 0.107 | 1 | 0.34834 | 0.33152 | 0.36134 | 20 | 74 | 86 | 27 | 118 | 93 |
| rs17649114 | Imputed | C | DOM | 429 | 1.27 | 0.2011 | 0.8563 | 1.884 | 1.189 | 0.2346 | 0.7799 | 0.22145 | 0.24176 | 0.20648 | 10 | 68 | 104 | 12 | 78 | 157 |
| rs17766172 | Imputed | A | REC | 419 | 0.6013 | 0.3147 | 0.3245 | 1.114 | −1.616 | 0.1061 | 0.4468 | 0.3401 | 0.31768 | 0.35714 | 17 | 83 | 71 | 35 | 100 | 103 |
| rs1818885 | Imputed | G | GEN | 431 | | | | | 7.055 | 0.02938 | 0.02563 | 0.34571 | 0.39946 | 0.30567 | 34 | 79 | 71 | 28 | 95 | 124 |
| rs1832222 | Imputed | G | ADD | 430 | 1.458 | 0.197 | 0.9908 | 2.145 | 1.913 | 0.05576 | 0.4158 | 0.29419 | 0.32065 | 0.27439 | 32 | 82 | 84 | 23 | 89 | 134 |
| rs1861327 | Imputed | G | ADD | 431 | 0.6673 | 0.206 | 0.4456 | 0.9992 | −1.964 | 0.04955 | 0.08774 | 0.40023 | 0.38043 | 0.41498 | 28 | 80 | 72 | 32 | 141 | 74 |
| rs1868581 | Imputed | G | ADD | 431 | 1.471 | 0.1402 | 1.117 | 1.936 | 2.75 | 0.00596 | 0.04132 | 0.34107 | 0.39674 | 0.2996 | 33 | 80 | 71 | 27 | 94 | 126 |
| rs1868581 | Imputed | G | GEN | 431 | | | | | 7.563 | 0.02279 | 0.04132 | 0.34107 | 0.39674 | 0.2996 | 33 | 80 | 71 | 27 | 94 | 126 |
| rs1874313 | Imputed | A | ADD | 430 | 0.671 | 0.151 | 0.4991 | 0.9022 | −2.642 | 0.00825 | 0.1082 | 0.40233 | 0.35054 | 0.44106 | 20 | 89 | 75 | 41 | 135 | 70 |
| rs1874313 | Imputed | A | DOM | 430 | 0.5994 | 0.208 | 0.3987 | 0.9009 | −3.007 | 0.01383 | 0.1082 | 0.40233 | 0.35054 | 0.44106 | 20 | 89 | 75 | 41 | 135 | 70 |
| rs1876409 | Imputed | C | DOM | 428 | 0.6523 | 0.1975 | 0.443 | 0.9607 | −1.782 | 0.03053 | 0.8167 | 0.29673 | 0.26923 | 0.31707 | 18 | 62 | 102 | 21 | 114 | 111 |
| rs1913201 | Imputed | T | DOM | 431 | 0.7714 | 0.144 | 0.5817 | 1.023 | −2.163 | 0.07146 | 0.554 | 0.42774 | 0.39071 | 0.45528 | 31 | 81 | 71 | 44 | 136 | 66 |
| rs1913201 | Imputed | T | ADD | 431 | 0.5986 | 0.2106 | 0.3961 | 0.9045 | −1.803 | 0.01484 | 0.554 | 0.42774 | 0.39071 | 0.45528 | 31 | 81 | 71 | 44 | 136 | 66 |
| rs1913201 | Imputed | T | GEN | 429 | | | | | −2.436 | 0.04484 | 0.554 | 0.40023 | 0.39071 | 0.45528 | 31 | 81 | 71 | 44 | 136 | 66 |
| rs1916922 | Imputed | T | GEN | 415 | | | | | 6.21 | 0.03549 | 0.2165 | 0.32289 | 0.375 | 0.28452 | 27 | 78 | 71 | 22 | 92 | 125 |
| rs1936871 | Genotyped | G | DOM | 431 | 0.7159 | 0.1987 | 0.485 | 1.057 | −1.682 | 0.09248 | 0.4071 | 0.36659 | 0.3288 | 0.39474 | 21 | 79 | 84 | 41 | 113 | 93 |
| rs1961157 | Imputed | T | REC | 431 | 0.4785 | 0.2451 | 0.296 | 0.7736 | −3.007 | 0.00264 | 1 | 0.48376 | 0.42935 | 0.52429 | 30 | 98 | 56 | 71 | 117 | 59 |
| rs1987179 | Imputed | T | ADD | 431 | 0.7399 | 0.1691 | 0.5312 | 1.031 | −1.782 | 0.07475 | 0.8902 | 0.2239 | 0.19565 | 0.24494 | 10 | 52 | 122 | 12 | 97 | 138 |
| rs1987179 | Imputed | T | DOM | 431 | 0.6359 | 0.2028 | 0.4273 | 0.9464 | −2.232 | 0.02564 | 0.8902 | 0.2239 | 0.19565 | 0.24494 | 10 | 52 | 122 | 12 | 97 | 138 |
| rs1990023 | Imputed | T | ADD | 429 | 0.7035 | 0.1964 | 0.4787 | 1.034 | −1.791 | 0.07336 | 0.7398 | 0.32019 | 0.2962 | 0.33806 | 20 | 69 | 95 | 26 | 115 | 106 |
| rs1995025 | Imputed | C | DOM | 431 | 1.335 | 0.2271 | 0.8555 | 2.084 | 1.273 | 0.203 | 0.674 | 0.12993 | 0.1413 | 0.12146 | 2 | 48 | 134 | 6 | 48 | 193 |
| rs2016194 | Imputed | G | DOM | 429 | 0.6887 | 0.197 | 0.4682 | 1.013 | −1.893 | 0.05831 | 1 | 0.31702 | 0.28962 | 0.3374 | 18 | 70 | 95 | 25 | 116 | 105 |

TABLE 15-continued

| SNP rs # | SOURCE | AL-LELE (A1) | MOD-EL | NMISS | OR | SE | L95 | U95 | STAT | P | HW_PVA-LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs2023651 | Imputed | T | ADD | 429 | 0.5946 | 0.1842 | 0.4144 | 0.8532 | −2.822 | 0.00477 | 0.7575 | 0.19347 | 0.14946 | 0.22653 | 3 | 49 | 132 | 14 | 83 | 148 |
| rs2024902 | Imputed | A | ADD | 431 | 1.964 | 0.3063 | 1.077 | 3.579 | 2.203 | 0.02757 | 1 | 0.05568 | 0.07609 | 0.04049 | 0 | 28 | 156 | 1 | 18 | 228 |
| rs2024902 | Imputed | A | DOM | 431 | 2.136 | 0.3162 | 1.15 | 3.97 | 2.401 | 0.01635 | 1 | 0.05568 | 0.07609 | 0.04049 | 0 | 28 | 156 | 1 | 18 | 228 |
| rs2025107 | Imputed | A | DOM | 431 | 2.24 | 0.3143 | 1.21 | 4.147 | 2.566 | 0.0103 | 0.1777 | 0.05916 | 0.08152 | 0.04251 | 1 | 28 | 155 | 2 | 17 | 228 |
| rs2025108 | Imputed | T | DOM | 431 | 2.069 | 0.3044 | 1.14 | 3.758 | 2.389 | 0.01687 | 0.2262 | 0.06265 | 0.08424 | 0.04656 | 1 | 29 | 154 | 2 | 19 | 226 |
| rs2031987 | Imputed | T | GEN | 431 | | | | | 7.984 | 0.01846 | 0.5855 | 0.32831 | 0.3587 | 0.30567 | 30 | 72 | 82 | 19 | 113 | 115 |
| rs2052428 | Imputed | C | DOM | 426 | 0.6505 | 0.2223 | 0.4208 | 1.006 | −1.935 | 0.05303 | 0.06403 | 0.46479 | 0.45278 | 0.47358 | 39 | 85 | 56 | 43 | 147 | 56 |
| rs2053230 | Imputed | C | ADD | 269 | 0.6927 | 0.629 | 0.2019 | 2.376 | −0.584 | 0.5594 | 1 | 0.0223 | 0.01724 | 0.02614 | 0 | 4 | 112 | 0 | 8 | 145 |
| rs2062448 | Imputed | T | DOM | 429 | 0.5357 | 0.2593 | 0.3223 | 0.8905 | −2.407 | 0.01607 | 0.2895 | 0.1014 | 0.07377 | 0.12195 | 0 | 27 | 156 | 2 | 56 | 188 |
| rs2063420 | Imputed | C | REC | 430 | 1.886 | 0.2499 | 1.156 | 3.079 | 2.54 | 0.01109 | 0.6935 | 0.42791 | 0.46721 | 0.39879 | 45 | 81 | 57 | 36 | 125 | 86 |
| rs2063591 | Imputed | C | ADD | 429 | 0.7822 | 0.144 | 0.5899 | 1.037 | −1.705 | 0.08815 | 0.4321 | 0.4359 | 0.40164 | 0.46138 | 32 | 83 | 68 | 45 | 137 | 64 |
| rs2063591 | Imputed | C | DOM | 429 | 0.6108 | 0.2122 | 0.403 | 0.9258 | −2.324 | 0.02015 | 0.4321 | 0.4359 | 0.40164 | 0.46138 | 32 | 83 | 68 | 45 | 137 | 64 |
| rs208026 | Genotyped | A | DOM | 431 | 1.516 | 0.1978 | 1.029 | 2.233 | 2.102 | 0.03554 | 0.295 | 0.24362 | 0.27989 | 0.2166 | 12 | 79 | 93 | 9 | 130 | 149 |
| rs208029 | Imputed | T | DOM | 426 | 1.45 | 0.2007 | 0.9788 | 2.15 | 1.853 | 0.06389 | 0.4837 | 0.223 | 0.25138 | 0.20204 | 9 | 73 | 99 | 9 | 81 | 155 |
| rs208757 | Imputed | G | DOM | 425 | 1.473 | 0.2014 | 0.9925 | 2.186 | 1.923 | 0.05453 | 1 | 0.22235 | 0.24862 | 0.20287 | 9 | 72 | 100 | 12 | 75 | 157 |
| rs2095586 | Imputed | A | DOM | 430 | 1.458 | 0.197 | 0.9908 | 2.145 | 1.913 | 0.05576 | 0.4158 | 0.29419 | 0.32065 | 0.27439 | 22 | 82 | 84 | 23 | 89 | 134 |
| rs2095606 | Imputed | A | DOM | 424 | 0.6502 | 0.2018 | 0.4378 | 0.9657 | −2.133 | 0.03293 | 0.209 | 0.36439 | 0.33607 | 0.38589 | 15 | 79 | 82 | 28 | 130 | 83 |
| rs2102374 | Imputed | A | ADD | 431 | 0.7364 | 0.156 | 0.5424 | 0.9998 | −1.961 | 0.04987 | 0.5472 | 0.27494 | 0.23913 | 0.30162 | 15 | 58 | 111 | 20 | 109 | 118 |
| rs2102374 | Imputed | A | DOM | 431 | 0.6065 | 0.198 | 0.4114 | 0.894 | −2.526 | 0.01155 | 0.5472 | 0.27494 | 0.23913 | 0.30162 | 15 | 58 | 111 | 20 | 109 | 118 |
| rs2108426 | Imputed | C | DOM | 429 | 0.6887 | 0.197 | 0.4682 | 1.013 | −1.893 | 0.05831 | 1 | 0.31702 | 0.28962 | 0.3374 | 18 | 70 | 95 | 25 | 116 | 105 |
| rs2110664 | Imputed | A | DOM | 421 | 1.806 | 0.2004 | 1.219 | 2.675 | 2.95 | 0.00318 | 0.4046 | 0.28622 | 0.33989 | 0.24691 | 20 | 81 | 77 | 18 | 84 | 141 |
| rs2132242 | Imputed | A | ADD | 431 | 0.6841 | 0.1503 | 0.5096 | 0.9184 | −2.527 | 0.01152 | 0.132 | 0.40023 | 0.35054 | 0.43725 | 20 | 89 | 75 | 41 | 134 | 72 |
| rs2132242 | Imputed | A | DOM | 431 | 0.62 | 0.207 | 0.4133 | 0.9302 | −2.31 | 0.0209 | 0.132 | 0.40023 | 0.35054 | 0.43725 | 20 | 89 | 75 | 41 | 134 | 72 |
| rs2158958 | Imputed | A | DOM | 429 | 0.6887 | 0.197 | 0.4682 | 1.013 | −1.893 | 0.05831 | 1 | 0.31702 | 0.28962 | 0.3374 | 18 | 70 | 95 | 25 | 116 | 105 |
| rs2158961 | Imputed | G | DOM | 431 | 0.7035 | 0.1964 | 0.4787 | 1.034 | −1.791 | 0.07336 | 0.8246 | 0.31903 | 0.29348 | 0.33806 | 19 | 70 | 95 | 26 | 115 | 106 |
| rs2163046 | Imputed | A | ADD | 430 | 1.511 | 0.1971 | 1.027 | 2.224 | 2.095 | 0.0362 | 0.03049 | 0.27791 | 0.31694 | 0.24899 | 14 | 88 | 81 | 10 | 103 | 134 |
| rs2180286 | Imputed | G | DOM | 431 | 0.7195 | 0.2291 | 0.4592 | 1.127 | −1.437 | 0.1507 | 0.3351 | 0.51856 | 0.47826 | 0.54858 | 42 | 92 | 50 | 79 | 113 | 55 |
| rs2180684 | Imputed | A | DOM | 427 | 1.612 | 0.2668 | 0.9556 | 2.719 | 1.79 | 0.07349 | 0.525 | 0.08431 | 0.10165 | 0.07143 | 3 | 35 | 146 | 3 | 29 | 213 |
| rs2188079 | Imputed | C | ADD | 430 | 1.535 | 0.1452 | 1.154 | 2.04 | 2.948 | 0.00319 | 0.6891 | 0.40116 | 0.45902 | 0.3583 | 36 | 96 | 51 | 31 | 115 | 101 |
| rs2188079 | Imputed | C | GEN | 430 | | | | | 8.853 | 0.01196 | 0.6891 | 0.40116 | 0.45902 | 0.3583 | 36 | 96 | 51 | 31 | 115 | 101 |
| rs2190598 | Imputed | T | DOM | 429 | 0.6887 | 0.197 | 0.4682 | 1.013 | −1.893 | 0.05831 | 1 | 0.31702 | 0.28962 | 0.3374 | 18 | 70 | 95 | 25 | 116 | 105 |
| rs2190600 | Imputed | A | DOM | 423 | 0.6884 | 0.1986 | 0.4665 | 1.016 | −1.88 | 0.0601 | 0.8235 | 0.32151 | 0.29444 | 0.34156 | 19 | 68 | 93 | 26 | 114 | 103 |
| rs2224184 | Genotyped | T | DOM | 431 | 0.7175 | 0.2276 | 0.4593 | 1.121 | −1.458 | 0.1447 | 0.289 | 0.51508 | 0.47554 | 0.54453 | 42 | 91 | 51 | 78 | 113 | 56 |
| rs2247066 | Imputed | A | DOM | 431 | 0.6603 | 0.1967 | 0.4491 | 0.9708 | −2.11 | 0.03482 | 0.6452 | 0.29698 | 0.26902 | 0.31781 | 18 | 63 | 103 | 22 | 96 | 112 |
| rs2248236 | Imputed | C | ADD | 430 | 0.7444 | 0.1691 | 0.5344 | 1.037 | −1.746 | 0.08088 | 0.8894 | 0.22326 | 0.19565 | 0.2439 | 10 | 52 | 128 | 12 | 96 | 138 |
| rs2248236 | Imputed | C | DOM | 430 | 0.6416 | 0.2031 | 0.431 | 0.9552 | −2.186 | 0.02885 | 0.8894 | 0.22326 | 0.19565 | 0.2439 | 10 | 52 | 128 | 12 | 96 | 138 |
| rs2265733 | Imputed | C | DOM | 431 | 0.7364 | 0.156 | 0.5424 | 0.9998 | −1.961 | 0.04987 | 0.5472 | 0.27494 | 0.23913 | 0.30162 | 15 | 58 | 111 | 20 | 109 | 118 |
| rs2270584 | Imputed | C | ADD | 431 | 0.6065 | 0.198 | 0.4114 | 0.894 | −2.526 | 0.01155 | 0.5472 | 0.27494 | 0.23913 | 0.30162 | 15 | 58 | 111 | 20 | 109 | 118 |
| rs2270584 | Imputed | A | ADD | 431 | 0.6858 | 0.1487 | 0.5125 | 0.9178 | −2.537 | 0.01119 | 0.3138 | 0.39559 | 0.34511 | 0.4332 | 21 | 85 | 78 | 41 | 132 | 74 |
| rs2270586 | Imputed | A | ADD | 431 | 0.6021 | 0.2055 | 0.4025 | 0.9008 | −2.468 | 0.01358 | 0.3138 | 0.39559 | 0.34511 | 0.4332 | 21 | 85 | 78 | 41 | 132 | 74 |
| rs2270586 | Imputed | A | DOM | 431 | 0.6858 | 0.1487 | 0.5125 | 0.9178 | −2.537 | 0.01119 | 0.3138 | 0.39559 | 0.34511 | 0.4332 | 21 | 85 | 78 | 41 | 132 | 74 |
| rs229775 | Imputed | A | DOM | 431 | 0.6021 | 0.2055 | 0.4025 | 0.9008 | −2.468 | 0.01358 | 0.3138 | 0.33875 | 0.33152 | 0.34413 | 15 | 92 | 77 | 31 | 108 | 108 |
| rs229815 | Imputed | T | REC | 428 | 0.5915 | 0.3332 | 0.3078 | 1.136 | −1.576 | 0.115 | 0.519 | 0.33762 | 0.32787 | 0.3449 | 14 | 92 | 77 | 31 | 107 | 107 |
| rs229829 | Imputed | C | REC | 431 | 0.5493 | 0.3402 | 0.282 | 1.07 | −1.761 | 0.07822 | 0.4505 | 0.37587 | 0.36141 | 0.38664 | 20 | 93 | 71 | 39 | 113 | 95 |
| rs229831 | Imputed | A | REC | 431 | 0.6223 | 0.2965 | 0.3481 | 1.113 | −1.6 | 0.1096 | 0.7583 | 0.31439 | 0.30978 | 0.31781 | 14 | 86 | 84 | 27 | 103 | 117 |
| rs229831 | Imputed | A | REC | 431 | 0.646 | 0.3469 | 0.3273 | 1.275 | −1.26 | 0.2077 | 0.8231 | | | | | | | | | |

TABLE 15-continued

| SNP rs # | SOURCE | AL-LELE (A1) | MOD-EL | NMISS | OR | SE | L95 | U95 | STAT | P | HW_PVA LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs2317057 | Imputed | T | ADD | 363 | 0.7197 | 0.1827 | 0.5031 | 1.029 | -1.801 | 0.07173 | 0.03577 | 0.20523 | 0.17208 | 0.22967 | 4 | 45 | 105 | 18 | 60 | 131 |
| rs2322100 | Genotyped | T | REC | 431 | 2.767 | 0.3609 | 1.364 | 5.612 | 2.82 | 0.0048 | 0.4748 | 0.28074 | 0.31522 | 0.25506 | 24 | 68 | 92 | 13 | 100 | 134 |
| rs2322101 | Imputed | A | REC | 429 | 2.779 | 0.3611 | 1.369 | 5.639 | 2.83 | 0.00465 | 0.4732 | 0.28089 | 0.31694 | 0.25407 | 24 | 68 | 91 | 13 | 99 | 134 |
| rs2327929 | Imputed | G | REC | 431 | 1.493 | 0.244 | 0.9255 | 2.408 | 1.642 | 0.1005 | 0.5607 | 0.45244 | 0.46467 | 0.44332 | 43 | 85 | 56 | 42 | 135 | 70 |
| rs2332844 | Imputed | A | ADD | 240 | 1.78 | 0.4323 | 0.7629 | 4.154 | 1.334 | 0.1823 | 1 | 0.94167 | 0.95009 | 0.92692 | 101 | 9 | 0 | 111 | 19 | 0 |
| rs2332844 | Imputed | A | REC | 240 | 1.78 | 0.4323 | 0.7629 | 4.154 | 1.334 | 0.1823 | 1 | 0.94167 | 0.95009 | 0.92692 | 101 | 9 | 0 | 111 | 19 | 0 |
| rs2349170 | Imputed | G | DOM | 430 | 1.327 | 0.204 | 0.8895 | 1.979 | 1.386 | 0.1657 | 0.1032 | 0.20581 | 0.22011 | 0.19512 | 9 | 63 | 112 | 15 | 66 | 165 |
| rs2356722 | Imputed | G | DOM | 431 | 0.6675 | 0.1966 | 0.4541 | 0.9812 | -2.057 | 0.03972 | 0.9089 | 0.30162 | 0.27446 | 0.32186 | 18 | 65 | 101 | 22 | 115 | 110 |
| rs2364956 | Imputed | T | DOM | 423 | 1.693 | 0.1737 | 1.204 | 2.379 | 3.031 | 0.00244 | 0.00724 | 0.17849 | 0.22652 | 0.14256 | 10 | 62 | 109 | 12 | 45 | 185 |
| rs2373793 | Imputed | G | ADD | 430 | 1.58 | 0.174 | 1.124 | 2.223 | 2.629 | 0.00855 | 0.7647 | 0.2 | 0.23913 | 0.17073 | 8 | 72 | 104 | 10 | 64 | 172 |
| rs2373793 | Imputed | G | DOM | 430 | 1.878 | 0.2064 | 1.253 | 2.815 | 3.055 | 0.00225 | 0.7647 | 0.2 | 0.23913 | 0.17073 | 8 | 72 | 104 | 10 | 64 | 172 |
| rs238252 | Imputed | G | ADD | 427 | 1.531 | 0.1916 | 1.052 | 2.229 | 2.223 | 0.02622 | 0.8581 | 0.15925 | 0.19126 | 0.13525 | 6 | 58 | 119 | 4 | 58 | 182 |
| rs238252 | Imputed | G | DOM | 427 | 1.593 | 0.2148 | 1.046 | 2.427 | 2.169 | 0.03007 | 0.8581 | 0.15925 | 0.19126 | 0.13525 | 6 | 58 | 119 | 4 | 58 | 182 |
| rs2383903 | Imputed | G | DOM | 430 | 0.6499 | 0.1976 | 0.4413 | 0.9572 | -2.181 | 0.02915 | 0.5438 | 0.27209 | 0.23497 | 0.2996 | 10 | 66 | 107 | 19 | 110 | 118 |
| rs2387945 | Imputed | G | DOM | 431 | 1.335 | 0.2271 | 0.8555 | 2.084 | 1.273 | 0.203 | 0.674 | 0.12993 | 0.1413 | 0.12146 | 2 | 48 | 134 | 6 | 48 | 193 |
| rs2389863 | Imputed | A | DOM | 426 | 0.6341 | 0.2035 | 0.4255 | 0.9449 | -2.238 | 0.0252 | 0.89 | 0.22535 | 0.19672 | 0.24691 | 10 | 52 | 121 | 12 | 96 | 135 |
| rs2389866 | Imputed | C | DOM | 431 | 0.6359 | 0.2028 | 0.4273 | 0.9464 | -2.232 | 0.02564 | 0.8902 | 0.2239 | 0.19565 | 0.24494 | 10 | 52 | 122 | 12 | 97 | 138 |
| rs2389869 | Imputed | C | DOM | 431 | 0.6359 | 0.2028 | 0.4273 | 0.9464 | -2.232 | 0.02564 | 0.8902 | 0.2239 | 0.19565 | 0.24494 | 10 | 52 | 122 | 12 | 97 | 138 |
| rs2389870 | Genotyped | C | DOM | 431 | 0.7988 | 0.2067 | 0.5327 | 1.198 | -1.087 | 0.2772 | 0.7543 | 0.19026 | 0.17663 | 0.2004 | 6 | 53 | 125 | 8 | 83 | 156 |
| rs2418494 | Imputed | G | ADD | 423 | 0.7065 | 0.1402 | 0.5367 | 0.93 | -2.477 | 0.01323 | 0.6254 | 0.53073 | 0.47778 | 0.56996 | 46 | 80 | 54 | 76 | 125 | 42 |
| rs2418494 | Imputed | G | GEN | 423 | | | | | 8.762 | 0.01252 | 0.6254 | 0.53073 | 0.47778 | 0.56996 | 46 | 80 | 54 | 76 | 125 | 42 |
| rs2418541 | Imputed | A | DOM | 431 | 0.7035 | 0.1964 | 0.4787 | 1.034 | -1.791 | 0.07336 | 0.7398 | 0.32019 | 0.2962 | 0.33806 | 20 | 69 | 95 | 26 | 115 | 106 |
| rs2418542 | Imputed | A | DOM | 431 | 0.7035 | 0.1964 | 0.4787 | 1.034 | -1.791 | 0.07336 | 0.7398 | 0.32019 | 0.2962 | 0.33806 | 20 | 69 | 95 | 26 | 115 | 106 |
| rs2423556 | Imputed | C | DOM | 431 | 0.7195 | 0.2291 | 0.4592 | 1.127 | -1.437 | 0.1507 | 0.3351 | 0.51856 | 0.47826 | 0.54858 | 42 | 92 | 50 | 79 | 113 | 55 |
| rs2437688 | Imputed | C | DOM | 431 | 1.486 | 0.2416 | 0.9251 | 2.385 | 1.638 | 0.1014 | 0.5494 | 0.08701 | 0.10598 | 0.07287 | 3 | 33 | 148 | 1 | 34 | 212 |
| rs2456809 | Imputed | G | ADD | 426 | 0.6547 | 0.1977 | 0.4444 | 0.9645 | -2.143 | 0.03215 | 0.7299 | 0.30047 | 0.27473 | 0.31967 | 19 | 62 | 101 | 21 | 114 | 109 |
| rs2456811 | Imputed | T | ADD | 431 | 0.7364 | 0.156 | 0.5424 | 0.9998 | -1.961 | 0.04987 | 0.5472 | 0.27494 | 0.23913 | 0.30162 | 15 | 58 | 111 | 20 | 109 | 118 |
| rs2456811 | Imputed | T | DOM | 431 | 0.6065 | 0.198 | 0.4114 | 0.894 | -2.526 | 0.01155 | 0.5472 | 0.27494 | 0.23913 | 0.30162 | 15 | 58 | 111 | 20 | 109 | 118 |
| rs2476976 | Imputed | C | DOM | 429 | 1.409 | 0.1971 | 0.9578 | 2.074 | 1.741 | 0.08162 | 0.293 | 0.29138 | 0.31522 | 0.27347 | 15 | 80 | 86 | 23 | 88 | 134 |
| rs2484911 | Imputed | A | DOM | 431 | 1.477 | 0.1971 | 1.004 | 2.173 | 1.979 | 0.04785 | 0.2786 | 0.274941 | 0.29891 | 0.25709 | 15 | 80 | 89 | 22 | 83 | 142 |
| rs2488557 | Imputed | C | DOM | 428 | 0.6282 | 0.2326 | 0.3982 | 0.991 | -1.999 | 0.04561 | 0.3091 | 0.13902 | 0.10656 | 0.16327 | 2 | 35 | 146 | 9 | 62 | 174 |
| rs250162 | Imputed | C | ADD | 425 | 0.5822 | 0.1715 | 0.416 | 0.8149 | -3.153 | 0.00162 | 0.5202 | 0.25176 | 0.1989 | 0.29098 | 8 | 56 | 117 | 16 | 110 | 118 |
| rs250162 | Imputed | C | DOM | 425 | 0.5055 | 0.2024 | 0.3399 | 0.7517 | -3.37 | 0.00075 | 0.5202 | 0.25176 | 0.1989 | 0.29098 | 8 | 56 | 117 | 16 | 110 | 118 |
| rs2560708 | Imputed | T | ADD | 427 | 0.5918 | 0.2008 | 0.3992 | 0.8772 | -2.612 | 0.00899 | 0.5877 | 0.15808 | 0.12088 | 0.18571 | 2 | 40 | 140 | 10 | 71 | 164 |
| rs2611841 | Imputed | G | ADD | 397 | 0.5505 | 0.2134 | 0.3623 | 0.8365 | -2.797 | 0.00516 | 0.773 | 0.22418 | 0.18235 | 0.25551 | 8 | 46 | 116 | 13 | 90 | 124 |
| rs2622499 | Imputed | G | DOM | 431 | 0.6359 | 0.2028 | 0.4273 | 0.9464 | -2.232 | 0.02564 | 0.8902 | 0.2239 | 0.19565 | 0.24494 | 10 | 52 | 122 | 12 | 97 | 138 |
| rs264129 | Imputed | T | DOM | 414 | 0.7088 | 0.2008 | 0.4781 | 1.051 | -1.714 | 0.08655 | 0.9112 | 0.32729 | 0.30226 | 0.34599 | 19 | 69 | 89 | 26 | 112 | 99 |
| rs2642936 | Imputed | A | DOM | 427 | 1.703 | 0.1807 | 1.195 | 2.427 | 2.947 | 0.00321 | 1 | 0.18735 | 0.23077 | 0.1551 | 10 | 64 | 108 | 5 | 66 | 174 |
| rs2660633 | Imputed | A | DOM | 428 | 0.6523 | 0.1975 | 0.443 | 0.9607 | -2.163 | 0.03053 | 0.8167 | 0.29673 | 0.26923 | 0.31707 | 18 | 62 | 102 | 21 | 114 | 111 |
| rs2660634 | Imputed | C | DOM | 428 | 0.6523 | 0.1975 | 0.443 | 0.9607 | -2.163 | 0.03053 | 0.8167 | 0.29673 | 0.26923 | 0.31707 | 18 | 62 | 102 | 21 | 114 | 111 |
| rs2660648 | Imputed | A | ADD | 431 | 0.7364 | 0.156 | 0.5424 | 0.894 | -1.961 | 0.04987 | 0.5472 | 0.274941 | 0.23913 | 0.30162 | 15 | 58 | 111 | 20 | 109 | 118 |
| rs2660648 | Imputed | A | DOM | 431 | 0.6065 | 0.198 | 0.4114 | 0.9355 | -2.526 | 0.01155 | 0.5472 | 0.274941 | 0.23913 | 0.30162 | 15 | 58 | 111 | 20 | 109 | 118 |
| rs2681505 | Imputed | T | ADD | 431 | 0.6724 | 0.1684 | 0.4834 | 0.9355 | -2.356 | 0.01848 | 0.6967 | 0.24594 | 0.20652 | 0.2753 | 7 | 62 | 115 | 17 | 102 | 128 |
| rs277411 | Imputed | G | DOM | 430 | 0.2825 | 0.5064 | 0.1047 | 0.7621 | -2.496 | 0.01254 | 0.01107 | 0.03488 | 0.01902 | 0.04675 | 2 | 3 | 179 | 0 | 21 | 224 |
| rs2832634 | Imputed | G | ADD | 430 | 2.272 | 0.3513 | 1.141 | 4.523 | 2.335 | 0.01952 | 0.5344 | 0.04186 | 0.06011 | 0.02834 | 1 | 20 | 162 | 0 | 14 | 233 |
| rs2832637 | Imputed | T | ADD | 430 | 2.272 | 0.3513 | 1.141 | 4.523 | 2.335 | 0.01952 | 0.5344 | 0.04186 | 0.06011 | 0.02834 | 1 | 20 | 162 | 0 | 14 | 233 |

TABLE 15-continued

| SNP rs # | SOURCE | AL-LELE (A1) | MOD-EL | NMISS | OR | SE | L95 | U95 | STAT | P | HW_PVALUE | AL-LELE FREQ | PRA-VA_AL-LELE FREQ | PLA-CEBO_AL-LELE FREQ | PRA-VA_A1_HZ_COUNT | PRA-VA_HET_COUNT | PRA-VA_A2_HZ_COUNT | PLA-CEBO_A1_HZ_COUNT | PLA-CEBO_HET_COUNT | PLA-CEBO_A2_HZ_COUNT |
|---|---|---|---|---|---|---|---|---|---|---|---|---|---|---|---|---|---|---|---|---|
| rs2843167 | Imputed | A | DOM | 430 | 0.6655 | 0.1968 | 0.4525 | 0.9788 | −2.069 | 0.03855 | 0.6437 | 0.29651 | 0.27174 | 0.31504 | 19 | 62 | 103 | 21 | 113 | 112 |
| rs2876227 | Imputed | C | ADD | 420 | 1.382 | 0.142 | 1.046 | 1.825 | 2.277 | 0.02278 | 0.11 | 0.35595 | 0.39779 | 0.32427 | 30 | 84 | 67 | 31 | 93 | 115 |
| rs2876227 | Imputed | C | GEN | 420 | | | | | 5.885 | 0.05274 | 0.11 | 0.35595 | 0.39779 | 0.32427 | 30 | 84 | 67 | 31 | 93 | 115 |
| rs2882097 | Imputed | A | DOM | 430 | 1.458 | 0.197 | 0.9908 | 2.145 | 1.913 | 0.05576 | 0.4158 | 0.29419 | 0.32065 | 0.27439 | 18 | 82 | 84 | 23 | 89 | 115 |
| rs2909862 | Imputed | G | DOM | 381 | 1.471 | 0.2415 | 0.9162 | 2.361 | 1.597 | 0.1102 | 0.06435 | 0.46457 | 0.48171 | 0.45161 | 30 | 98 | 36 | 43 | 110 | 134 |
| rs3001945 | Imputed | T | DOM | 408 | 1.39 | 0.2492 | 0.8531 | 2.266 | 1.323 | 0.186 | 0.7949 | 0.10662 | 0.1185 | 0.09787 | 1 | 39 | 133 | 4 | 38 | 193 |
| rs3011020 | Imputed | C | ADD | 431 | 1.335 | 0.2271 | 0.8555 | 2.084 | 1.273 | 0.203 | 0.674 | 0.12993 | 0.1413 | 0.12146 | 2 | 48 | 134 | 6 | 48 | 193 |
| rs36071725 | Genotyped | C | GEN | 431 | 1.458 | 0.1473 | 1.093 | 1.946 | 2.562 | 0.01039 | 0.9158 | 0.35035 | 0.39674 | 0.31579 | 26 | 94 | 64 | 26 | 104 | 117 |
| rs36071725 | Genotyped | C | GEN | 431 | | | | | 7.178 | 0.02762 | 0.9158 | 0.35035 | 0.39674 | 0.31579 | 26 | 94 | 64 | 26 | 104 | 117 |
| rs373983 | Imputed | G | DOM | 424 | 1.332 | 0.2094 | 0.8836 | 2.008 | 1.369 | 0.171 | 1 | 0.41038 | 0.425 | 0.39959 | 29 | 95 | 56 | 42 | 111 | 91 |
| rs3743794 | Imputed | G | DOM | 426 | 0.6969 | 0.2073 | 0.4642 | 1.046 | −1.742 | 0.08148 | 0.1305 | 0.40258 | 0.38462 | 0.41598 | 28 | 84 | 70 | 33 | 137 | 74 |
| rs3756154 | Imputed | C | ADD | 431 | 0.7399 | 0.1691 | 0.5312 | 1.031 | −1.782 | 0.07475 | 0.8902 | 0.2239 | 0.19565 | 0.24494 | 10 | 52 | 122 | 12 | 97 | 138 |
| rs3756154 | Imputed | C | DOM | 431 | 0.6359 | 0.2028 | 0.4273 | 0.9464 | −2.232 | 0.02564 | 0.8902 | 0.2239 | 0.19565 | 0.24494 | 10 | 52 | 122 | 12 | 97 | 138 |
| rs3775850 | Imputed | A | DOM | 431 | 0.7804 | 0.2073 | 0.5199 | 1.172 | −1.196 | 0.2317 | 0.6351 | 0.18794 | 0.1712 | 0.2004 | 5 | 53 | 126 | 8 | 83 | 156 |
| rs3775851 | Imputed | C | DOM | 431 | 0.7804 | 0.2073 | 0.5199 | 1.172 | −1.196 | 0.2317 | 0.6351 | 0.18794 | 0.1712 | 0.2004 | 5 | 53 | 126 | 8 | 83 | 156 |
| rs3793044 | Imputed | C | ADD | 431 | 1.892 | 0.308 | 1.035 | 3.461 | 2.071 | 0.0384 | 1 | 0.05452 | 0.07337 | 0.04049 | 0 | 27 | 157 | 1 | 18 | 228 |
| rs3793044 | Imputed | C | DOM | 431 | 2.057 | 0.3182 | 1.102 | 3.838 | 2.266 | 0.02342 | 1 | 0.05452 | 0.07337 | 0.04049 | 0 | 27 | 157 | 1 | 18 | 228 |
| rs3793053 | Imputed | C | DOM | 425 | 2.254 | 0.3145 | 1.217 | 4.175 | 2.583 | 0.00979 | 0.1831 | 0.06 | 0.08287 | 0.04303 | 1 | 28 | 152 | 2 | 17 | 225 |
| rs3796246 | Imputed | G | DOM | 431 | 0.4542 | 0.2717 | 0.2667 | 0.7737 | −2.904 | 0.00368 | 0.7838 | 0.09629 | 0.0625 | 0.12146 | 0 | 23 | 161 | 3 | 54 | 190 |
| rs3806003 | Imputed | A | ADD | 431 | 1.892 | 0.308 | 1.035 | 3.461 | 2.071 | 0.0384 | 1 | 0.05452 | 0.07337 | 0.04049 | 0 | 27 | 157 | 1 | 18 | 228 |
| rs3806003 | Imputed | A | DOM | 431 | 2.057 | 0.3182 | 1.102 | 3.838 | 2.266 | 0.02342 | 1 | 0.05452 | 0.07337 | 0.04049 | 0 | 27 | 157 | 1 | 18 | 228 |
| rs3806004 | Imputed | T | DOM | 431 | 2.24 | 0.3143 | 1.21 | 4.147 | 2.566 | 0.0103 | 0.1777 | 0.05916 | 0.08152 | 0.04251 | 1 | 28 | 155 | 2 | 17 | 228 |
| rs3806004 | Imputed | T | DOM | 431 | 2.24 | 0.3143 | 1.21 | 4.147 | 2.566 | 0.0103 | 0.1777 | 0.05916 | 0.08152 | 0.04251 | 1 | 28 | 155 | 2 | 17 | 228 |
| rs3806010 | Imputed | A | DOM | 431 | 2.24 | 0.3143 | 1.21 | 4.147 | 2.566 | 0.0103 | 0.1777 | 0.05916 | 0.08152 | 0.04251 | 1 | 28 | 155 | 2 | 17 | 228 |
| rs3806014 | Imputed | A | DOM | 431 | 2.24 | 0.3143 | 1.21 | 4.147 | 2.566 | 0.0103 | 0.1777 | 0.05916 | 0.08152 | 0.04251 | 1 | 28 | 155 | 2 | 17 | 228 |
| rs3806015 | Imputed | A | DOM | 431 | 2.24 | 0.3143 | 1.21 | 4.147 | 2.566 | 0.0103 | 0.1777 | 0.05916 | 0.08152 | 0.04251 | 1 | 28 | 155 | 2 | 17 | 228 |
| rs3806018 | Imputed | A | DOM | 431 | 2.24 | 0.3143 | 1.21 | 4.147 | 2.566 | 0.0103 | 0.1777 | 0.05916 | 0.08152 | 0.04251 | 1 | 28 | 155 | 2 | 17 | 228 |
| rs3806019 | Imputed | A | DOM | 431 | 2.254 | 0.3145 | 1.217 | 4.175 | 2.583 | 0.00979 | 0.1831 | 0.06 | 0.08287 | 0.04303 | 1 | 28 | 152 | 2 | 17 | 225 |
| rs3806024 | Imputed | T | GEN | 425 | | | | | 6.343 | 0.04195 | 0.03262 | 0.34859 | 0.39946 | 0.30992 | 34 | 79 | 71 | 28 | 94 | 120 |
| rs3915080 | Imputed | A | ADD | 426 | 0.6915 | 0.1524 | 0.513 | 0.9322 | −2.421 | 0.01549 | 0.07006 | 0.4078 | 0.35955 | 0.44286 | 20 | 88 | 70 | 41 | 135 | 69 |
| rs3942254 | Imputed | T | DOM | 423 | 0.6256 | 0.2108 | 0.4139 | 0.9456 | −2.225 | 0.02605 | 0.07006 | 0.4078 | 0.35955 | 0.44286 | 20 | 88 | 70 | 41 | 135 | 69 |
| rs3942254 | Imputed | T | DOM | 423 | 1.52 | 0.1971 | 1.033 | 2.237 | 2.125 | 0.03357 | 0.4125 | 0.29002 | 0.32065 | 0.26721 | 18 | 82 | 84 | 22 | 88 | 137 |
| rs3945085 | Imputed | A | ADD | 431 | 0.6593 | 0.2103 | 0.4366 | 0.9956 | −1.981 | 0.0476 | 0.15182 | 0.1314 | 0.10383 | 0.15182 | 6 | 36 | 146 | 9 | 57 | 181 |
| rs3976737 | Imputed | G | ADD | 430 | 1.557 | 0.2271 | 0.9976 | 2.43 | 1.949 | 0.05125 | 0.2068 | 0.30626 | 0.33424 | 0.28543 | 21 | 89 | 78 | 21 | 99 | 127 |
| rs399485 | Genotyped | T | DOM | 431 | 1.467 | 0.1973 | 0.9965 | 2.159 | 1.942 | 0.05212 | 0.6505 | 0.30626 | 0.33424 | 0.28543 | 21 | 89 | 78 | 21 | 99 | 127 |
| rs4029119 | Imputed | G | ADD | 429 | 0.361 | 0.577 | 0.1165 | 1.118 | −1.766 | 0.0774 | 1 | 0.02098 | 0.01087 | 0.02857 | 0 | 4 | 180 | 0 | 14 | 231 |
| rs4029119 | Imputed | G | DOM | 429 | 0.361 | 0.577 | 0.1165 | 1.118 | −1.766 | 0.0774 | 1 | 0.02098 | 0.01087 | 0.02857 | 0 | 4 | 180 | 0 | 14 | 231 |
| rs4076201 | Imputed | G | GEN | 430 | | | | | 6.108 | 0.04718 | 0.893 | 0.23372 | 0.25272 | 0.21951 | 16 | 61 | 107 | 8 | 92 | 146 |
| rs4076201 | Imputed | G | REC | 430 | 2.964 | 0.4471 | 1.234 | 7.119 | 2.43 | 0.01509 | 0.893 | 0.23372 | 0.25272 | 0.21951 | 16 | 61 | 107 | 8 | 92 | 146 |
| rs41395945 | Imputed | G | ADD | 430 | 2.272 | 0.3513 | 1.141 | 4.523 | 2.335 | 0.01952 | 0.5344 | 0.04186 | 0.06011 | 0.02834 | 1 | 20 | 162 | 0 | 14 | 233 |
| rs41395945 | Imputed | G | DOM | 430 | 2.245 | 0.362 | 1.104 | 4.564 | 2.234 | 0.02549 | 0.5344 | 0.04186 | 0.06011 | 0.02834 | 1 | 20 | 162 | 0 | 14 | 233 |
| rs4146972 | Genotyped | T | DOM | 431 | 0.5314 | 0.2341 | 0.3358 | 0.8408 | −2.7 | 0.00692 | 0.1486 | 0.13341 | 0.16033 | 0.11336 | 6 | 47 | 131 | 5 | 46 | 196 |
| rs4238087 | Imputed | G | ADD | 425 | 0.5471 | 0.2243 | 0.3525 | 0.8491 | −2.689 | 0.00716 | 0.1486 | 0.13765 | 0.1 | 0.16531 | 1 | 34 | 145 | 3 | 75 | 167 |
| rs4251569 | Imputed | T | DOM | 425 | 0.5314 | 0.2341 | 0.3358 | 0.8408 | −2.7 | 0.00692 | 0.1486 | 0.13765 | 0.1 | 0.16531 | 1 | 34 | 145 | 3 | 75 | 167 |
| rs4251569 | Imputed | T | GEN | 425 | | | | | 6.108 | 0.04718 | 0.1486 | 0.13765 | 0.1 | 0.16531 | 1 | 34 | 145 | 3 | 75 | 167 |
| rs4273613 | Imputed | T | ADD | 431 | 0.309 | 0.5694 | 0.1012 | 0.9434 | −2.062 | 0.03918 | 1 | 0.0232 | 0.01087 | 0.03239 | 0 | 4 | 180 | 0 | 16 | 231 |
| rs4273613 | Imputed | T | DOM | 431 | 0.309 | 0.5694 | 0.1012 | 0.9434 | −2.062 | 0.03918 | 1 | 0.0232 | 0.01087 | 0.03239 | 0 | 4 | 180 | 0 | 16 | 231 |

TABLE 15-continued

| SNP rs # | SOURCE | AL-LELE (A1) | MOD-EL | NMISS | OR | SE | L95 | U95 | STAT | P | HW_PVA LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs4291049 | Imputed | T | REC | 428 | 0.5862 | 0.2628 | 0.3502 | 0.9812 | -2.032 | 0.04213 | 0.3793 | 0.44509 | 0.42896 | 0.45714 | 26 | 105 | 52 | 54 | 116 | 75 |
| rs4315598 | Imputed | T | ADD | 431 | 1.407 | 0.1412 | 1.067 | 1.855 | 2.418 | 0.01561 | 0.1149 | 0.35267 | 0.39674 | 0.31984 | 30 | 86 | 68 | 31 | 96 | 120 |
| rs4315598 | Imputed | T | GEN | 431 | | | | | 6.605 | 0.0368 | 0.1149 | 0.35267 | 0.39674 | 0.31984 | 30 | 86 | 68 | 31 | 96 | 120 |
| rs4315598 | Imputed | T | REC | 431 | 1.414 | 0.279 | 0.8186 | 2.444 | 1.243 | 0.214 | 0.1149 | 0.35267 | 0.39674 | 0.31984 | 30 | 86 | 68 | 31 | 96 | 120 |
| rs4321395 | Imputed | A | DOM | 400 | 0.5278 | 0.2223 | 0.3414 | 0.816 | -2.875 | 0.00404 | 0.7625 | 0.44625 | 0.39458 | 0.48291 | 28 | 75 | 63 | 50 | 126 | 58 |
| rs4321596 | Genotyped | T | REC | 431 | 3.01 | 0.5138 | 1.099 | 8.238 | 2.145 | 0.03199 | 0.6475 | 0.19606 | 0.21196 | 0.18421 | 12 | 54 | 118 | 6 | 79 | 162 |
| rs4324417 | Imputed | T | DOM | 431 | 1.541 | 0.2104 | 1.02 | 2.328 | 2.055 | 0.03989 | 0.7663 | 0.41763 | 0.44022 | 0.40081 | 32 | 98 | 54 | 45 | 108 | 94 |
| rs4328619 | Genotyped | G | DOM | 431 | 0.6446 | 0.2226 | 0.4167 | 0.9973 | -1.972 | 0.04857 | 0.8472 | 0.49536 | 0.44837 | 0.53036 | 37 | 91 | 56 | 70 | 122 | 55 |
| rs4338909 | Imputed | T | ADD | 431 | 1.42 | 0.1425 | 1.074 | 1.878 | 2.462 | 0.01381 | 0.9195 | 0.39211 | 0.44022 | 0.35628 | 36 | 90 | 58 | 31 | 114 | 102 |
| rs4370878 | Imputed | G | DOM | 431 | 1.497 | 0.197 | 1.017 | 2.202 | 2.046 | 0.04075 | 0.4153 | 0.29118 | 0.32065 | 0.26923 | 18 | 82 | 84 | 22 | 89 | 136 |
| rs4379434 | Genotyped | T | DOM | 431 | 1.603 | 0.203 | 1.077 | 2.386 | 2.323 | 0.02015 | 0.6081 | 0.37471 | 0.4375 | 0.32794 | 38 | 85 | 61 | 25 | 112 | 110 |
| rs4416407 | Imputed | T | DOM | 429 | 1.502 | 0.2225 | 0.9712 | 2.324 | 1.829 | 0.06743 | 0.06631 | 0.49068 | 0.51913 | 0.46951 | 50 | 90 | 43 | 63 | 105 | 78 |
| rs4417899 | Imputed | C | REC | 429 | 0.6657 | 0.2225 | 0.4304 | 1.03 | -1.829 | 0.06743 | 0.06631 | 0.50932 | 0.48087 | 0.53049 | 43 | 90 | 50 | 78 | 105 | 63 |
| rs4442732 | Imputed | A | ADD | 335 | 0.7543 | 0.1867 | 0.5231 | 1.088 | -1.511 | 0.1309 | 0.4915 | 0.27313 | 0.24632 | 0.29146 | 8 | 51 | 77 | 14 | 88 | 97 |
| rs4444612 | Imputed | G | ADD | 431 | 1.407 | 0.1412 | 1.067 | 1.855 | 2.418 | 0.01561 | 0.1149 | 0.35267 | 0.39674 | 0.31984 | 30 | 86 | 68 | 31 | 96 | 120 |
| rs4444612 | Imputed | G | GEN | 431 | | | | | 6.605 | 0.0368 | 0.1149 | 0.35267 | 0.39674 | 0.31984 | 30 | 86 | 68 | 31 | 96 | 120 |
| rs4444612 | Imputed | G | REC | 431 | 1.414 | 0.279 | 0.8186 | 2.444 | 1.243 | 0.214 | 0.1149 | 0.35267 | 0.39674 | 0.31984 | 30 | 86 | 68 | 31 | 96 | 120 |
| rs4450660 | Imputed | C | DOM | 430 | 1.776 | 0.2015 | 1.196 | 2.636 | 2.849 | 0.00438 | 0.5652 | 0.21279 | 0.25137 | 0.18421 | 7 | 78 | 98 | 10 | 71 | 166 |
| rs4509702 | Imputed | C | DOM | 431 | 1.497 | 0.197 | 1.017 | 2.202 | 2.046 | 0.04075 | 0.4153 | 0.29118 | 0.32065 | 0.26923 | 18 | 82 | 84 | 22 | 89 | 136 |
| rs4526920 | Imputed | G | GEN | 431 | | | | | 7.984 | 0.01846 | 0.5855 | 0.32831 | 0.3587 | 0.30567 | 30 | 72 | 82 | 19 | 113 | 115 |
| rs4533145 | Imputed | T | DOM | 430 | 0.6617 | 0.2453 | 0.4092 | 1.07 | -1.683 | 0.09231 | 1 | 0.11395 | 0.0929 | 0.12955 | 2 | 30 | 151 | 3 | 58 | 186 |
| rs4557006 | Imputed | A | ADD | 395 | 0.5409 | 0.225 | 0.348 | 0.8407 | -2.731 | 0.00631 | 0.6853 | 0.45063 | 0.40123 | 0.48498 | 28 | 74 | 60 | 50 | 126 | 57 |
| rs4570530 | Imputed | C | DOM | 431 | 1.497 | 0.197 | 1.017 | 2.202 | 2.046 | 0.04075 | 0.4153 | 0.29118 | 0.32065 | 0.26923 | 18 | 82 | 84 | 22 | 89 | 136 |
| rs4615971 | Imputed | C | DOM | 429 | 1.474 | 0.1973 | 1.001 | 2.17 | 1.965 | 0.04937 | 0.3529 | 0.29371 | 0.32065 | 0.27347 | 18 | 82 | 84 | 23 | 88 | 134 |
| rs4628119 | Imputed | A | DOM | 431 | 0.5304 | 0.202 | 0.357 | 0.7881 | -3.139 | 0.0017 | 0.1465 | 0.24014 | 0.20109 | 0.26923 | 9 | 56 | 119 | 10 | 113 | 124 |
| rs4664443 | Imputed | G | ADD | 431 | 0.6931 | 0.1457 | 0.521 | 0.9221 | -2.517 | 0.01184 | 0.6898 | 0.40371 | 0.35598 | 0.43927 | 22 | 87 | 75 | 46 | 125 | 76 |
| rs4688259 | Imputed | C | DOM | 429 | 1.502 | 0.2225 | 0.9712 | 2.324 | 1.829 | 0.06743 | 0.06631 | 0.49068 | 0.51913 | 0.46951 | 50 | 90 | 43 | 63 | 105 | 78 |
| rs4688632 | Imputed | G | REC | 426 | 0.6718 | 0.2217 | 0.435 | 1.038 | -1.794 | 0.07285 | 0.3819 | 0.52465 | 0.49727 | 0.54527 | 44 | 94 | 45 | 78 | 109 | 56 |
| rs4695284 | Imputed | A | ADD | 231 | 1.566 | 0.2722 | 0.9182 | 2.669 | 1.647 | 0.09965 | 0.7943 | 0.14719 | 0.17935 | 0.1259 | 3 | 27 | 62 | 1 | 33 | 105 |
| rs4700302 | Imputed | A | ADD | 368 | 0.5418 | 0.2966 | 0.303 | 0.9689 | -2.067 | 0.03877 | 1 | 0.08152 | 0.05806 | 0.09859 | 0 | 18 | 137 | 2 | 38 | 173 |
| rs4702720 | Imputed | A | ADD | 363 | 0.7075 | 0.1961 | 0.4817 | 1.039 | -1.765 | 0.07759 | 0.7438 | 0.19835 | 0.16774 | 0.22115 | 3 | 46 | 106 | 10 | 72 | 126 |
| rs4702720 | Imputed | A | DOM | 363 | 0.7149 | 0.2239 | 0.461 | 1.109 | -1.499 | 0.1339 | 0.7438 | 0.19835 | 0.16774 | 0.22115 | 3 | 46 | 106 | 10 | 72 | 126 |
| rs4711091 | Genotyped | G | GEN | 431 | | | | | 3.583 | 0.1667 | 0.63 | 0.47564 | 0.51359 | 0.44737 | 48 | 93 | 43 | 52 | 117 | 78 |
| rs4714484 | Imputed | A | ADD | 431 | 0.5609 | 0.1882 | 0.3879 | 0.8112 | -3.071 | 0.00213 | 0.1396 | 0.17749 | 0.12772 | 0.21457 | 6 | 35 | 143 | 12 | 82 | 153 |
| rs4736802 | Imputed | G | ADD | 430 | 1.614 | 0.2031 | 1.084 | 2.404 | 2.357 | 0.01841 | 0.6067 | 0.37442 | 0.4375 | 0.32724 | 38 | 85 | 61 | 25 | 111 | 110 |
| rs4760785 | Imputed | A | ADD | 429 | 0.7714 | 0.144 | 0.5817 | 1.023 | -1.803 | 0.07146 | 0.554 | 0.42774 | 0.39071 | 0.45528 | 31 | 81 | 71 | 44 | 136 | 66 |
| rs4760785 | Imputed | A | DOM | 429 | 0.5986 | 0.2106 | 0.3961 | 0.9045 | -2.436 | 0.01484 | 0.554 | 0.42774 | 0.39071 | 0.45528 | 31 | 81 | 71 | 44 | 136 | 66 |
| rs4760894 | Imputed | T | GEN | 429 | | | | | 6.21 | 0.04484 | 0.554 | 0.42774 | 0.39071 | 0.45528 | 31 | 81 | 71 | 44 | 136 | 66 |
| rs4760894 | Imputed | T | ADD | 429 | 0.7714 | 0.144 | 0.5817 | 1.023 | -1.803 | 0.07146 | 0.554 | 0.42774 | 0.39071 | 0.45528 | 31 | 81 | 71 | 44 | 136 | 66 |
| rs4760894 | Imputed | T | DOM | 429 | 0.5986 | 0.2106 | 0.3961 | 0.9045 | -2.436 | 0.01484 | 0.554 | 0.42774 | 0.39071 | 0.45528 | 31 | 81 | 71 | 44 | 136 | 66 |
| rs4760895 | Imputed | A | GEN | 429 | | | | | 6.21 | 0.04484 | 0.554 | 0.42774 | 0.39071 | 0.45528 | 31 | 81 | 71 | 44 | 136 | 66 |
| rs4760895 | Imputed | A | ADD | 429 | 0.7714 | 0.144 | 0.5817 | 1.023 | -1.803 | 0.07146 | 0.554 | 0.42774 | 0.39071 | 0.45528 | 31 | 81 | 71 | 44 | 136 | 66 |
| rs4760895 | Imputed | A | DOM | 429 | 0.5986 | 0.2106 | 0.3961 | 0.8045 | -2.436 | 0.01484 | 0.554 | 0.42774 | 0.39071 | 0.45528 | 31 | 81 | 71 | 44 | 136 | 66 |
| rs4764738 | Imputed | A | ADD | 425 | 1.555 | 0.1426 | 1.176 | 2.056 | 3.095 | 0.00197 | 1 | 0.49412 | 0.55801 | 0.44672 | 57 | 88 | 36 | 47 | 124 | 73 |
| rs4764738 | Imputed | A | GEN | 425 | | | | | 9.814 | 0.00739 | 1 | 0.49412 | 0.55801 | 0.44672 | 57 | 88 | 36 | 47 | 124 | 73 |

TABLE 15-continued

| SNP rs # | SOURCE | AL-LELE (A1) | MOD-EL | NMISS | OR | SE | L95 | U95 | STAT | P | HW_PVALUE | AL-LELE FREQ | PRA-VA_AL-LELE FREQ | PLA-CEBO_AL-LELE FREQ | PRA-VA_A1_HZ_COUNT | PRA-VA_HET_COUNT | PRA-VA_A2_HZ_COUNT | PLA-CEBO_A1_HZ_COUNT | PLA-CEBO_HET_COUNT | PLA-CEBO_A2_HZ_COUNT |
|---|---|---|---|---|---|---|---|---|---|---|---|---|---|---|---|---|---|---|---|---|
| rs4764974 | Imputed | T | ADD | 430 | 1.512 | 0.1414 | 1.146 | 1.995 | 2.923 | 0.00347 | 1 | 0.49186 | 0.55163 | 0.44715 | 57 | 89 | 38 | 47 | 126 | 73 |
| rs4764974 | Imputed | T | GEN | 430 |  |  |  |  | 8.948 | 0.0114 | 1 | 0.49186 | 0.55163 | 0.44715 | 57 | 89 | 38 | 47 | 126 | 73 |
| rs4798366 | Imputed | G | REC | 426 | 2.304 | 0.315 | 1.243 | 4.271 | 2.65 | 0.00806 | 0.8267 | 0.33099 | 0.36264 | 0.30738 | 29 | 74 | 79 | 19 | 112 | 113 |
| rs483159 | Imputed | T | DOM | 418 | 1.412 | 0.2046 | 0.9455 | 2.108 | 1.686 | 0.09181 | 0.6559 | 0.20694 | 0.23034 | 0.18958 | 7 | 68 | 103 | 9 | 73 | 158 |
| rs4836502 | Imputed | T | DOM | 429 | 0.6887 | 0.197 | 0.4682 | 1.013 | -1.893 | 0.05831 | 1 | 0.31702 | 0.28962 | 0.3374 | 18 | 70 | 95 | 25 | 116 | 105 |
| rs4836507 | Imputed | C | DOM | 423 | 0.6884 | 0.1986 | 0.4665 | 1.016 | -1.88 | 0.0601 | 0.8235 | 0.32151 | 0.29444 | 0.34156 | 19 | 68 | 93 | 26 | 114 | 103 |
| rs4836744 | Imputed | A | ADD | 429 | 0.7704 | 0.1539 | 0.5698 | 1.042 | -1.694 | 0.09021 | 0.1943 | 0.33566 | 0.30435 | 0.35918 | 17 | 78 | 89 | 25 | 126 | 94 |
| rs4836744 | Imputed | A | DOM | 429 | 0.6637 | 0.1983 | 0.4499 | 0.979 | -2.067 | 0.03872 | 0.1943 | 0.33566 | 0.30435 | 0.35918 | 17 | 78 | 89 | 25 | 126 | 94 |
| rs4848944 | Genotyped | C | REC | 431 | 0.464 | 0.245 | 0.287 | 0.75 | -3.134 | 0.00172 | 0.6299 | 0.48028 | 0.42935 | 0.51822 | 30 | 98 | 56 | 72 | 112 | 63 |
| rs4851529 | Imputed | A | DOM | 431 | 0.5663 | 0.2029 | 0.3805 | 0.8429 | -2.802 | 0.00507 | 0.5411 | 0.38399 | 0.35326 | 0.40688 | 28 | 74 | 82 | 32 | 137 | 78 |
| rs4851531 | Imputed | T | DOM | 430 | 0.5588 | 0.2033 | 0.3751 | 0.8325 | -2.862 | 0.00421 | 0.4774 | 0.38488 | 0.35326 | 0.40854 | 28 | 74 | 82 | 32 | 137 | 77 |
| rs4858046 | Genotyped | T | GEN | 431 |  |  |  |  | 6.792 | 0.0335 | 0.0334 | 0.34687 | 0.39946 | 0.30769 | 34 | 79 | 71 | 28 | 96 | 123 |
| rs4878214 | Imputed | A | ADD | 343 | 0.7413 | 0.1824 | 0.5185 | 1.06 | -1.641 | 0.1007 | 0.6774 | 0.26531 | 0.23179 | 0.29167 | 8 | 54 | 89 | 14 | 84 | 94 |
| rs4880803 | Imputed | A | ADD | 421 | 0.7588 | 0.1519 | 0.5634 | 1.022 | -1.818 | 0.06914 | 0.9124 | 0.33017 | 0.29558 | 0.35625 | 13 | 81 | 87 | 32 | 107 | 101 |
| rs489441 | Imputed | G | DOM | 408 | 1.6 | 0.1627 | 1.163 | 2.2 | 2.888 | 0.00387 | 0.2387 | 0.29779 | 0.35174 | 0.25847 | 19 | 83 | 70 | 12 | 98 | 126 |
| rs489441 | Imputed | G | DOM | 408 | 1.651 | 0.2035 | 1.108 | 2.46 | 2.463 | 0.01378 | 0.2215 | 0.29779 | 0.35174 | 0.25847 | 19 | 83 | 70 | 12 | 98 | 126 |
| rs4896568 | Imputed | T | DOM | 430 | 0.5426 | 0.2032 | 0.3643 | 0.8081 | -3.008 | 0.00263 | 0.6787 | 0.2314 | 0.19022 | 0.2622 | 7 | 56 | 121 | 11 | 107 | 128 |
| rs4938851 | Imputed | T | DOM | 431 | 1.301 | 0.2004 | 0.8785 | 1.927 | 1.313 | 0.1891 | 0.1753 | 0.2239 | 0.24728 | 0.20648 | 11 | 69 | 104 | 12 | 78 | 157 |
| rs4964416 | Imputed | C | DOM | 428 | 0.6799 | 0.2267 | 0.436 | 1.06 | -1.702 | 0.08872 | 0.7663 | 0.48715 | 0.46961 | 0.5 | 41 | 88 | 52 | 53 | 141 | 53 |
| rs5756669 | Imputed | C | DOM | 431 | 1.541 | 0.2104 | 1.02 | 2.328 | 2.055 | 0.03989 | 0.1149 | 0.41763 | 0.44022 | 0.40081 | 32 | 98 | 54 | 45 | 108 | 94 |
| rs6033138 | Imputed | C | ADD | 431 | 1.407 | 0.1412 | 1.067 | 1.855 | 2.418 | 0.01561 | 0.1149 | 0.35267 | 0.39674 | 0.31984 | 30 | 86 | 68 | 31 | 96 | 120 |
| rs6033138 | Imputed | C | GEN | 431 |  |  |  |  | 6.605 | 0.0368 | 0.1149 | 0.35267 | 0.39674 | 0.31984 | 30 | 86 | 68 | 31 | 96 | 120 |
| rs6040619 | Imputed | C | REC | 431 | 1.414 | 0.279 | 0.8186 | 2.444 | 1.243 | 0.214 | 0.202 | 0.34895 | 0.39946 | 0.3107 | 30 | 85 | 68 | 27 | 97 | 119 |
| rs6040619 | Imputed | C | ADD | 427 | 1.488 | 0.1435 | 1.123 | 1.972 | 2.771 | 0.00559 | 0.202 | 0.34895 | 0.39946 | 0.3107 | 31 | 85 | 68 | 27 | 97 | 119 |
| rs6040619 | Imputed | C | GEN | 427 |  |  |  |  | 7.811 | 0.02013 | 0.202 | 0.34895 | 0.39946 | 0.3107 | 31 | 85 | 68 | 27 | 97 | 119 |
| rs6040625 | Imputed | C | REC | 427 | 1.688 | 0.2858 | 0.964 | 2.956 | 1.832 | 0.06702 | 0.2386 | 0.34706 | 0.39617 | 0.30992 | 30 | 85 | 68 | 27 | 96 | 119 |
| rs6040625 | Imputed | C | ADD | 425 | 1.479 | 0.1442 | 1.115 | 1.962 | 2.714 | 0.00665 | 0.2386 | 0.34706 | 0.39617 | 0.30992 | 30 | 85 | 68 | 27 | 96 | 119 |
| rs6040625 | Imputed | T | GEN | 425 |  |  |  |  | 7.591 | 0.02248 | 0.2386 | 0.34706 | 0.39617 | 0.30992 | 30 | 85 | 68 | 27 | 96 | 119 |
| rs6040630 | Imputed | A | REC | 431 | 1.634 | 0.2879 | 0.9294 | 2.873 | 1.706 | 0.08806 | 0.1692 | 0.35151 | 0.39617 | 0.30992 | 30 | 85 | 68 | 27 | 96 | 119 |
| rs6040630 | Imputed | A | ADD | 431 | 1.42 | 0.1417 | 1.076 | 1.875 | 2.476 | 0.01327 | 0.1692 | 0.35151 | 0.39617 | 0.31781 | 30 | 86 | 68 | 30 | 97 | 120 |
| rs6040630 | Imputed | A | GEN | 431 |  |  |  |  | 6.71 | 0.03491 | 0.1692 | 0.35151 | 0.39617 | 0.31781 | 30 | 86 | 68 | 30 | 97 | 120 |
| rs6040633 | Imputed | A | REC | 431 | 1.462 | 0.2807 | 0.8433 | 2.534 | 1.353 | 0.1762 | 0.1149 | 0.35267 | 0.39674 | 0.31984 | 30 | 86 | 68 | 31 | 96 | 120 |
| rs6040633 | Imputed | A | ADD | 431 | 1.407 | 0.1412 | 1.067 | 1.855 | 2.418 | 0.01561 | 0.1149 | 0.35267 | 0.39674 | 0.31984 | 30 | 86 | 68 | 31 | 96 | 120 |
| rs6040633 | Imputed | A | GEN | 431 |  |  |  |  | 6.605 | 0.0368 | 0.1149 | 0.35267 | 0.39674 | 0.31984 | 30 | 86 | 68 | 31 | 96 | 120 |
| rs6040634 | Imputed | T | REC | 431 | 1.414 | 0.279 | 0.8186 | 2.444 | 1.243 | 0.214 | 0.1149 | 0.35267 | 0.39674 | 0.31984 | 30 | 86 | 68 | 31 | 96 | 120 |
| rs6040634 | Imputed | T | ADD | 431 | 1.407 | 0.1412 | 1.067 | 1.855 | 2.418 | 0.01561 | 0.1149 | 0.35267 | 0.39674 | 0.31984 | 30 | 86 | 68 | 31 | 96 | 120 |
| rs6040634 | Imputed | T | GEN | 431 |  |  |  |  | 6.605 | 0.0368 | 0.1149 | 0.35267 | 0.39674 | 0.31984 | 30 | 86 | 68 | 31 | 96 | 120 |
| rs6040636 | Imputed | T | REC | 431 | 1.414 | 0.279 | 0.8186 | 2.444 | 1.243 | 0.214 | 0.1149 | 0.35267 | 0.39674 | 0.31984 | 30 | 86 | 68 | 31 | 96 | 120 |
| rs6040636 | Imputed | T | ADD | 431 | 1.407 | 0.1412 | 1.067 | 1.855 | 2.418 | 0.01561 | 0.1149 | 0.35267 | 0.39674 | 0.31984 | 30 | 86 | 68 | 31 | 96 | 120 |
| rs6040636 | Imputed | T | GEN | 431 |  |  |  |  | 6.605 | 0.0368 | 0.1149 | 0.35267 | 0.39674 | 0.31984 | 30 | 86 | 68 | 31 | 96 | 120 |
| rs6040638 | Imputed | C | REC | 431 | 1.414 | 0.279 | 0.8186 | 2.444 | 1.243 | 0.214 | 0.1149 | 0.35267 | 0.39674 | 0.31984 | 30 | 86 | 68 | 31 | 96 | 120 |
| rs6040638 | Imputed | C | ADD | 431 | 1.407 | 0.1412 | 1.067 | 1.855 | 2.418 | 0.01561 | 0.1149 | 0.35267 | 0.39674 | 0.31984 | 30 | 86 | 68 | 31 | 96 | 120 |
| rs6040638 | Imputed | C | GEN | 431 |  |  |  |  | 6.605 | 0.0368 | 0.1149 | 0.35267 | 0.39674 | 0.31984 | 30 | 86 | 68 | 31 | 96 | 120 |
| rs6040644 | Imputed | A | ADD | 431 | 1.407 | 0.1412 | 1.067 | 1.855 | 2.418 | 0.01561 | 0.1149 | 0.35267 | 0.39674 | 0.31984 | 30 | 86 | 68 | 31 | 96 | 120 |
| rs6040644 | Imputed | A | GEN | 431 |  |  |  |  | 6.605 | 0.0368 | 0.1149 | 0.35267 | 0.39674 | 0.31984 | 30 | 86 | 68 | 31 | 96 | 120 |

TABLE 15-continued

| SNP rs # | SOURCE | AL-LELE (A1) | MOD-EL | NMISS | OR | SE | L95 | U95 | STAT | P | HW_PVA LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs6040644 | Imputed | A | REC | 431 | 1.414 | 0.279 | 0.8186 | 2.444 | 1.243 | 0.214 | 0.1149 | 0.35267 | 0.39674 | 0.31984 | 30 | 86 | 68 | 31 | 96 | 120 |
| rs6040667 | Imputed | T | ADD | 427 | 1.391 | 0.1412 | 1.055 | 1.835 | 2.338 | 0.0194 | 0.09068 | 0.35246 | 0.3956 | 0.32041 | 30 | 84 | 68 | 31 | 95 | 119 |
| rs6040667 | Imputed | T | GEN | 427 |  |  |  |  | 6.078 | 0.04788 | 0.09068 | 0.35246 | 0.3956 | 0.32041 | 30 | 84 | 68 | 31 | 95 | 119 |
| rs6040668 | Imputed | T | REC | 427 | 1.416 | 0.2791 | 0.8195 | 2.447 | 1.247 | 0.2125 | 0.09068 | 0.35545 | 0.3956 | 0.32041 | 30 | 84 | 68 | 31 | 95 | 119 |
| rs6040668 | Imputed | C | ADD | 422 | 1.386 | 0.1419 | 1.049 | 1.83 | 2.3 | 0.02147 | 0.1109 | 0.35545 | 0.39779 | 0.32365 | 30 | 84 | 67 | 31 | 94 | 116 |
| rs6040668 | Imputed | C | GEN | 422 |  |  |  |  | 5.936 | 0.05141 | 0.1109 | 0.35545 | 0.39779 | 0.32365 | 30 | 84 | 67 | 31 | 94 | 116 |
| rs6040668 | Imputed | C | REC | 422 | 1.401 | 0.2794 | 0.8101 | 2.422 | 1.206 | 0.2277 | 0.1109 | 0.35545 | 0.39779 | 0.32365 | 30 | 84 | 67 | 31 | 94 | 116 |
| rs6043066 | Genotyped | G | DOM | 431 | 1.208 | 0.1979 | 0.8196 | 1.781 | 0.955 | 0.3397 | 0.8951 | 0.23898 | 0.24185 | 0.23684 | 7 | 75 | 102 | 18 | 81 | 148 |
| rs6048146 | Imputed | G | DOM | 431 | 3.484 | 0.6015 | 1.072 | 11.33 | 2.075 | 0.03796 | 1 | 0.01624 | 0.02717 | 0.0081 | 0 | 10 | 174 | 0 | 4 | 243 |
| rs6082725 | Genotyped | T | DOM | 431 | 3.484 | 0.6015 | 1.072 | 11.33 | 2.075 | 0.03796 | 1 | 0.01624 | 0.02717 | 0.0081 | 0 | 10 | 174 | 0 | 4 | 243 |
| rs6131206 | Imputed | C | ADD | 429 | 1.424 | 0.1456 | 1.07 | 1.894 | 2.425 | 0.01529 | 0.1797 | 0.31585 | 0.35989 | 0.2834 | 25 | 81 | 76 | 24 | 92 | 131 |
| rs6131208 | Imputed | T | ADD | 429 | 1.398 | 0.1412 | 1.06 | 1.843 | 2.371 | 0.01776 | 0.1119 | 0.35198 | 0.3956 | 0.31984 | 30 | 84 | 68 | 31 | 96 | 120 |
| rs6131208 | Imputed | T | GEN | 429 |  |  |  |  | 6.201 | 0.04504 | 0.1119 | 0.35198 | 0.3956 | 0.31984 | 30 | 84 | 68 | 31 | 96 | 120 |
| rs6131208 | Imputed | T | REC | 429 | 1.431 | 0.2791 | 0.828 | 2.472 | 1.284 | 0.1993 | 0.1119 | 0.35198 | 0.3956 | 0.31984 | 30 | 84 | 68 | 31 | 96 | 120 |
| rs6134243 | Imputed | C | ADD | 431 | 1.407 | 0.1412 | 1.067 | 1.855 | 2.418 | 0.01561 | 0.1149 | 0.35267 | 0.39674 | 0.31984 | 30 | 86 | 68 | 31 | 96 | 120 |
| rs6134243 | Imputed | C | GEN | 431 |  |  |  |  | 6.605 | 0.0368 | 0.1149 | 0.35267 | 0.39674 | 0.31984 | 30 | 86 | 68 | 31 | 96 | 120 |
| rs6134243 | Imputed | C | REC | 431 | 1.414 | 0.279 | 0.8186 | 2.444 | 1.243 | 0.214 | 0.1149 | 0.35267 | 0.39674 | 0.31984 | 30 | 86 | 68 | 31 | 96 | 120 |
| rs6136020 | Imputed | A | DOM | 431 | 0.7169 | 0.227 | 0.4595 | 1.119 | -1.466 | 0.1426 | 0.2387 | 0.14385 | 0.12228 | 0.15992 | 4 | 37 | 143 | 8 | 63 | 176 |
| rs613799 | Imputed | C | ADD | 414 | 1.45 | 0.2012 | 0.9772 | 2.15 | 1.845 | 0.06502 | 0.3305 | 0.2814 | 0.30398 | 0.26471 | 15 | 77 | 84 | 22 | 82 | 134 |
| rs644041 | Imputed | G | ADD | 401 | 1.555 | 0.164 | 1.127 | 2.144 | 2.69 | 0.00715 | 0.2323 | 0.29676 | 0.34706 | 0.25974 | 18 | 82 | 70 | 12 | 96 | 123 |
| rs644041 | Imputed | G | DOM | 401 | 1.611 | 0.2049 | 1.078 | 2.407 | 2.327 | 0.01999 | 0.2323 | 0.29676 | 0.34706 | 0.25974 | 18 | 82 | 70 | 12 | 96 | 123 |
| rs647645 | Imputed | C | ADD | 430 | 0.7227 | 0.1429 | 0.5462 | 0.9563 | -2.273 | 0.02304 | 0.5622 | 0.48372 | 0.44022 | 0.51626 | 29 | 104 | 51 | 68 | 118 | 60 |
| rs647645 | Imputed | C | GEN | 430 |  |  |  |  | 8.278 | 0.01594 | 0.5622 | 0.48372 | 0.44022 | 0.51626 | 29 | 104 | 51 | 68 | 118 | 60 |
| rs647645 | Imputed | C | REC | 430 | 0.4895 | 0.2484 | 0.3008 | 0.7965 | -2.876 | 0.00403 | 0.5622 | 0.48372 | 0.44022 | 0.51626 | 29 | 104 | 51 | 68 | 118 | 60 |
| rs6495554 | Imputed | G | GEN | 431 |  |  |  |  | 6.084 | 0.04773 | 0.8893 | 0.22274 | 0.25 | 0.20243 | 15 | 62 | 107 | 7 | 86 | 154 |
| rs6495554 | Imputed | C | REC | 431 | 3.183 | 0.4709 | 1.265 | 8.011 | 2.459 | 0.01395 | 0.8893 | 0.22274 | 0.25 | 0.20243 | 15 | 62 | 107 | 7 | 86 | 154 |
| rs6495555 | Imputed | G | GEN | 431 |  |  |  |  | 6.084 | 0.04773 | 0.8893 | 0.22274 | 0.25 | 0.20243 | 15 | 62 | 107 | 7 | 86 | 154 |
| rs6495555 | Imputed | C | REC | 431 | 3.183 | 0.4709 | 1.265 | 8.011 | 2.459 | 0.01395 | 0.8893 | 0.22274 | 0.25 | 0.20243 | 15 | 62 | 107 | 7 | 86 | 154 |
| rs6544728 | Imputed | C | DOM | 429 | 1.888 | 0.2031 | 1.268 | 2.811 | 3.128 | 0.00176 | 0.7694 | 0.20746 | 0.25 | 0.17611 | 15 | 77 | 98 | 10 | 67 | 170 |
| rs6550705 | Imputed | T | ADD | 430 | 1.45 | 0.1393 | 1.104 | 1.906 | 2.67 | 0.00759 | 0.02491 | 0.34535 | 0.39946 | 0.30488 | 34 | 79 | 71 | 28 | 94 | 124 |
| rs6550705 | Imputed | C | GEN | 430 |  |  |  |  | 7.13 | 0.0283 | 0.02491 | 0.34535 | 0.39946 | 0.30488 | 34 | 79 | 71 | 28 | 94 | 124 |
| rs6550707 | Imputed | T | DOM | 431 |  |  |  |  | 6.869 | 0.03224 | 0.03283 | 0.34651 | 0.29891 | 0.30691 | 34 | 80 | 89 | 28 | 95 | 123 |
| rs6593441 | Imputed | A | DOM | 404 | 1.477 | 0.1971 | 1.004 | 2.173 | 1.979 | 0.04785 | 0.2786 | 0.27494 | 0.25709 | 0.09471 | 8 | 43 | 126 | 3 | 83 | 142 |
| rs668732 | Imputed | A | DOM | 431 | 1.885 | 0.2414 | 1.175 | 3.026 | 2.627 | 0.00862 | 0.04333 | 0.12624 | 0.16667 | 0.44534 | 42 | 99 | 43 | 22 | 37 | 187 |
| rs671041 | Imputed | A | ADD | 431 | 1.56 | 0.2218 | 1.01 | 2.409 | 2.004 | 0.04506 | 0.9229 | 0.46752 | 0.49728 | 0.25709 | 15 | 81 | 88 | 53 | 114 | 80 |
| rs6719700 | Imputed | A | ADD | 412 | 1.507 | 0.1971 | 1.024 | 2.217 | 2.08 | 0.03752 | 0.3349 | 0.2761 | 0.30163 | 0.22246 | 10 | 83 | 83 | 22 | 83 | 142 |
| rs6719700 | Imputed | A | DOM | 412 | 1.583 | 0.1792 | 1.114 | 2.249 | 2.562 | 0.0104 | 0.00157 | 0.25243 | 0.29261 | 0.22246 | 10 | 83 | 83 | 4 | 97 | 135 |
| rs6722640 | Imputed | C | ADD | 431 | 1.517 | 0.2015 | 1.022 | 2.252 | 2.07 | 0.03845 | 0.00157 | 0.25243 | 0.29261 | 0.22246 | 10 | 83 | 83 | 4 | 97 | 135 |
| rs6743092 | Imputed | T | DOM | 431 | 0.5555 | 0.2033 | 0.373 | 0.8273 | -2.892 | 0.00382 | 0.4151 | 0.38399 | 0.35326 | 0.40688 | 28 | 74 | 82 | 31 | 139 | 77 |
| rs6743092 | Imputed | T | ADD | 431 | 1.365 | 0.1398 | 1.038 | 1.796 | 2.226 | 0.02603 | 0.9233 | 0.471 | 0.51359 | 0.43927 | 49 | 91 | 44 | 47 | 123 | 77 |
| rs6743092 | Imputed | T | GEN | 431 |  |  |  |  | 4.984 | 0.08273 | 0.9233 | 0.471 | 0.51359 | 0.43927 | 49 | 91 | 44 | 47 | 123 | 77 |
| rs6744759 | Imputed | G | REC | 431 | 1.555 | 0.2336 | 0.9841 | 2.458 | 1.891 | 0.05858 | 0.9086 | 0.30425 | 0.32597 | 0.28807 | 23 | 72 | 86 | 17 | 106 | 120 |
| rs6746170 | Imputed | A | REC | 424 | 1.89 | 0.3377 | 0.9751 | 3.664 | 1.885 | 0.0594 | 0.7693 | 0.20941 | 0.24862 | 0.18033 | 7 | 76 | 98 | 10 | 68 | 166 |
| rs6759922 | Imputed | A | DOM | 399 | 1.805 | 0.2035 | 1.211 | 2.69 | 2.901 | 0.00372 | 0.7616 | 0.44737 | 0.39697 | 0.48291 | 28 | 75 | 62 | 50 | 126 | 58 |
| rs6769864 | Imputed | T | GEN | 431 | 0.537 | 0.2229 | 0.3469 | 0.8311 | -2.79 | 0.00527 | 0.02563 | 0.34571 | 0.39946 | 0.30567 | 34 | 79 | 71 | 28 | 95 | 124 |
|  |  |  |  |  |  |  |  |  | 7.055 | 0.02938 |  |  |  |  |  |  |  |  |  |  |

TABLE 15-continued

| SNP rs # | SOURCE | AL-LELE (A1) | MOD-EL | NMISS | OR | SE | L95 | U95 | STAT | P | HW_PVA-LUE | AL-LELE FREQ | PRA-VA_AL-LELE FREQ | PLA-CEBO_AL-LELE FREQ | PRA-VA_A1_HZ_COUNT | PRA-VA_HET_COUNT | PRA-VA_A2_HZ_COUNT | PLA-CEBO_A1_HZ_COUNT | PLA-CEBO_HET_COUNT | PLA-CEBO_A2_HZ_COUNT |
|---|---|---|---|---|---|---|---|---|---|---|---|---|---|---|---|---|---|---|---|---|
| rs6773932 | Imputed | C | GEN | 426 | | | | | 5.96 | 0.05078 | 0.03445 | 0.35563 | 0.40489 | 0.31818 | 34 | 81 | 69 | 30 | 94 | 118 |
| rs6774353 | Imputed | A | GEN | 431 | | | | | 7.055 | 0.02938 | 0.02563 | 0.34571 | 0.39946 | 0.30567 | 34 | 79 | 71 | 28 | 95 | 124 |
| rs6781670 | Imputed | C | GEN | 431 | | | | | 7.563 | 0.02279 | 0.04132 | 0.34107 | 0.39674 | 0.2996 | 33 | 80 | 71 | 27 | 94 | 126 |
| rs6786431 | Imputed | A | GEN | 426 | | | | | 5.96 | 0.05078 | 0.03445 | 0.35563 | 0.40489 | 0.31818 | 34 | 81 | 69 | 30 | 94 | 118 |
| rs6789091 | Imputed | T | GEN | 426 | | | | | 5.96 | 0.05078 | 0.03445 | 0.35563 | 0.40489 | 0.31818 | 34 | 81 | 69 | 30 | 94 | 118 |
| rs6791296 | Imputed | T | ADD | 414 | 0.6404 | 0.2337 | 0.4051 | 1.012 | -1.907 | 0.05647 | 0.6349 | 0.11836 | 0.09483 | 0.13542 | 2 | 29 | 143 | 2 | 61 | 177 |
| rs6792662 | Imputed | G | DOM | 429 | 1.502 | 0.2225 | 0.9712 | 2.324 | 1.829 | 0.06743 | 0.06631 | 0.49068 | 0.51913 | 0.46951 | 50 | 90 | 43 | 63 | 105 | 78 |
| rs6797574 | Imputed | G | GEN | 426 | | | | | 5.96 | 0.05078 | 0.03445 | 0.35563 | 0.40489 | 0.31818 | 34 | 81 | 69 | 30 | 94 | 118 |
| rs6797882 | Imputed | G | GEN | 426 | | | | | 5.96 | 0.05078 | 0.03445 | 0.35563 | 0.40489 | 0.31818 | 34 | 81 | 69 | 30 | 94 | 118 |
| rs6805139 | Imputed | G | DOM | 428 | 1.519 | 0.2225 | 0.9819 | 2.348 | 1.878 | 0.06041 | 0.2865 | 0.47897 | 0.51099 | 0.45528 | 47 | 92 | 43 | 57 | 110 | 79 |
| rs6806043 | Imputed | C | ADD | 430 | 1.47 | 0.1394 | 1.118 | 1.931 | 2.761 | 0.00577 | 0.02491 | 0.34535 | 0.40164 | 0.30364 | 34 | 79 | 70 | 28 | 94 | 125 |
| rs6806043 | Imputed | C | GEN | 430 | | | | | 7.621 | 0.02214 | 0.02491 | 0.34535 | 0.40164 | 0.30364 | 34 | 79 | 70 | 28 | 94 | 125 |
| rs6850716 | Imputed | C | GEN | 431 | | | | | 4.671 | 0.09677 | 1 | 0.19838 | 0.21739 | 0.18421 | 12 | 56 | 116 | 5 | 81 | 161 |
| rs6867153 | Imputed | A | REC | 428 | 0.5862 | 0.2628 | 0.3502 | 0.9812 | -2.032 | 0.04213 | 0.3793 | 0.44509 | 0.42896 | 0.45714 | 26 | 105 | 52 | 54 | 116 | 75 |
| rs687047 | Imputed | C | ADD | 431 | 0.7129 | 0.2248 | 0.4589 | 1.107 | -1.506 | 0.1321 | 0.8081 | 0.11253 | 0.09511 | 0.12551 | 2 | 31 | 151 | 4 | 54 | 189 |
| rs6871041 | Imputed | G | DOM | 425 | 0.6929 | 0.1978 | 0.4702 | 1.021 | -1.855 | 0.06367 | 0.7349 | 0.30941 | 0.28177 | 0.32992 | 16 | 70 | 95 | 23 | 115 | 106 |
| rs688358 | Imputed | A | ADD | 427 | 0.6788 | 0.2285 | 0.4338 | 1.062 | -1.695 | 0.08999 | 0.6295 | 0.11124 | 0.09116 | 0.12602 | 2 | 29 | 150 | 4 | 54 | 188 |
| rs6888012 | Imputed | A | REC | 428 | 0.5862 | 0.2628 | 0.3502 | 0.9812 | -2.032 | 0.04213 | 0.3793 | 0.44509 | 0.42896 | 0.45714 | 26 | 105 | 52 | 54 | 116 | 75 |
| rs6908481 | Imputed | A | REC | 431 | 0.7129 | 0.2609 | 0.4589 | 1.107 | 1.938 | 0.05267 | 0.5523 | 0.41939 | 0.42857 | 0.4126 | 38 | 80 | 64 | 34 | 135 | 77 |
| rs7032231 | Imputed | A | ADD | 429 | 1.467 | 0.1469 | 1.1 | 1.957 | 2.609 | 0.00908 | 0.6651 | 0.3345 | 0.38251 | 0.29878 | 25 | 90 | 68 | 25 | 97 | 124 |
| rs7067638 | Imputed | T | DOM | 431 | 1.82 | 0.2397 | 1.138 | 2.911 | 2.498 | 0.01249 | 0.03157 | 0.11717 | 0.15489 | 0.08907 | 3 | 41 | 135 | 3 | 38 | 206 |
| rs7077799 | Imputed | A | DOM | 430 | 1.458 | 0.197 | 0.9908 | 2.145 | 1.913 | 0.05576 | 0.4158 | 0.29419 | 0.32065 | 0.27439 | 18 | 82 | 84 | 23 | 89 | 134 |
| rs7082163 | Imputed | A | ADD | 431 | 1.817 | 0.2063 | 1.213 | 2.722 | 2.895 | 0.0038 | 0.03378 | 0.1186 | 0.15847 | 0.08907 | 8 | 42 | 133 | 3 | 38 | 206 |
| rs7082163 | Imputed | A | DOM | 430 | 1.875 | 0.239 | 1.173 | 2.995 | 2.629 | 0.00856 | 0.03378 | 0.1186 | 0.15847 | 0.08907 | 8 | 42 | 133 | 3 | 38 | 206 |
| rs7089661 | Imputed | C | ADD | 430 | 1.458 | 0.197 | 0.9908 | 2.145 | 1.913 | 0.05576 | 0.4158 | 0.29419 | 0.32065 | 0.27439 | 18 | 82 | 84 | 23 | 89 | 134 |
| rs7101319 | Imputed | C | ADD | 430 | 1.817 | 0.2063 | 1.213 | 2.722 | 2.895 | 0.0038 | 0.03378 | 0.1186 | 0.15847 | 0.08907 | 8 | 42 | 133 | 3 | 38 | 206 |
| rs7101319 | Imputed | C | DOM | 430 | 1.875 | 0.239 | 1.173 | 2.995 | 2.629 | 0.00856 | 0.03378 | 0.1186 | 0.15847 | 0.08907 | 8 | 42 | 133 | 3 | 38 | 206 |
| rs710832 | Genotyped | A | GEN | 431 | | | | | 6.307 | 0.0427 | 0.1673 | 0.2587 | 0.24185 | 0.27126 | 4 | 81 | 99 | 19 | 96 | 132 |
| rs710832 | Genotyped | A | REC | 431 | 0.256 | 0.5608 | 0.0853 | 0.7684 | -2.43 | 0.01511 | 0.1673 | 0.2587 | 0.24185 | 0.27126 | 4 | 81 | 99 | 19 | 96 | 132 |
| rs7134262 | Imputed | T | GEN | 418 | | | | | 3.095 | 0.2128 | 0.4064 | 0.38038 | 0.39888 | 0.36667 | 30 | 82 | 66 | 26 | 124 | 90 |
| rs7134262 | Imputed | T | REC | 418 | 1.627 | 0.2899 | 0.9217 | 2.871 | 1.679 | 0.09319 | 0.4064 | 0.38038 | 0.39888 | 0.36667 | 30 | 82 | 66 | 26 | 124 | 90 |
| rs7134671 | Imputed | T | GEN | 428 | | | | | 10.66 | 0.00484 | 0.03787 | 0.37033 | 0.4235 | 0.33061 | 42 | 71 | 70 | 27 | 108 | 110 |
| rs7138300 | Imputed | C | ADD | 429 | 0.7714 | 0.144 | 0.5817 | 1.023 | -1.803 | 0.07146 | 0.554 | 0.42774 | 0.39071 | 0.45528 | 31 | 81 | 71 | 44 | 136 | 66 |
| rs7138300 | Imputed | C | DOM | 429 | 0.5986 | 0.2106 | 0.3961 | 0.9045 | -2.436 | 0.01484 | 0.554 | 0.42774 | 0.39071 | 0.45528 | 31 | 81 | 71 | 44 | 136 | 66 |
| rs7138300 | Imputed | C | GEN | 429 | | | | | 6.21 | 0.04484 | 0.554 | 0.42774 | 0.39071 | 0.45528 | 31 | 81 | 71 | 44 | 136 | 66 |
| rs7163931 | Imputed | G | GEN | 431 | | | | | 6.084 | 0.04773 | 0.8893 | 0.22274 | 0.25 | 0.20243 | 15 | 62 | 107 | 7 | 86 | 154 |
| rs7163931 | Imputed | G | REC | 431 | 0.5774 | 0.203 | 0.3878 | 0.8595 | 2.459 | 0.01395 | 0.8893 | 0.22274 | 0.25 | 0.20243 | 15 | 62 | 107 | 7 | 86 | 154 |
| rs7171486 | Genotyped | G | DOM | 431 | | | | | -2.706 | 0.00681 | 1 | 0.38747 | 0.33424 | 0.42713 | 21 | 81 | 82 | 44 | 123 | 80 |
| rs7172611 | Imputed | G | GEN | 431 | | | | | 6.084 | 0.04773 | 0.8893 | 0.22274 | 0.25 | 0.20243 | 15 | 62 | 107 | 7 | 86 | 154 |
| rs7172611 | Imputed | G | REC | 431 | 3.183 | 0.4709 | 1.265 | 8.011 | 2.459 | 0.01395 | 0.8893 | 0.22274 | 0.25 | 0.20243 | 15 | 62 | 107 | 7 | 86 | 154 |
| rs7172689 | Imputed | T | GEN | 431 | | | | | 6.084 | 0.04773 | 0.8893 | 0.22274 | 0.25 | 0.20243 | 15 | 62 | 107 | 7 | 86 | 154 |
| rs7172689 | Imputed | T | REC | 431 | 3.183 | 0.4709 | 1.265 | 8.011 | 2.459 | 0.01395 | 0.8893 | 0.22274 | 0.25 | 0.20243 | 15 | 62 | 107 | 7 | 86 | 154 |
| rs7175701 | Imputed | C | GEN | 431 | | | | | 6.07 | 0.04808 | 0.7883 | 0.23202 | 0.25272 | 0.2166 | 16 | 61 | 107 | 8 | 91 | 148 |
| rs7180245 | Imputed | A | GEN | 431 | | | | | 6.084 | 0.04773 | 0.8893 | 0.22274 | 0.25 | 0.20243 | 15 | 62 | 107 | 7 | 86 | 154 |
| rs7180245 | Imputed | A | REC | 431 | 3.183 | 0.4709 | 1.265 | 8.011 | 2.459 | 0.01395 | 0.8893 | 0.22274 | 0.25 | 0.20243 | 15 | 62 | 107 | 7 | 86 | 154 |
| rs7220603 | Genotyped | A | ADD | 431 | 0.6302 | 0.1616 | 0.4591 | 0.865 | -2.857 | 0.00428 | 0.04531 | 0.31671 | 0.2663 | 0.35425 | 8 | 82 | 94 | 26 | 123 | 98 |

TABLE 15-continued

| SNP rs # | SOURCE | AL-LELE (A1) | MOD-EL | NMISS | OR | SE | L95 | U95 | STAT | P | HW_PVA-LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs7282518 | Imputed | T | ADD | 375 | 1.518 | 0.1836 | 1.06 | 2.176 | 2.275 | 0.02291 | 0.08335 | 0.184 | 0.225 | 0.15349 | 12 | 48 | 100 | 6 | 54 | 155 |
| rs7283476 | Imputed | T | ADD | 429 | 0.6337 | 0.4061 | 0.2859 | 1.405 | -1.123 | 0.2614 | 0.3657 | 0.03263 | 0.02459 | 0.03862 | 0 | 9 | 174 | 1 | 17 | 228 |
| rs7283476 | Imputed | T | DOM | 429 | 0.6518 | 0.4222 | 0.2849 | 1.491 | -1.014 | 0.3106 | 0.3657 | 0.03263 | 0.02459 | 0.03862 | 0 | 9 | 174 | 1 | 17 | 228 |
| rs7295817 | Imputed | C | GEN | 427 | | | | | 1.689 | 0.4298 | 0.9199 | 0.40281 | 0.37912 | 0.42041 | 28 | 82 | 72 | 42 | 122 | 81 |
| rs7298255 | Imputed | A | ADD | 430 | 0.7591 | 0.1447 | 0.5717 | 1.008 | -1.905 | 0.05677 | 0.4311 | 0.42674 | 0.38798 | 0.45547 | 30 | 82 | 71 | 44 | 137 | 66 |
| rs7298255 | Imputed | A | DOM | 430 | 0.594 | 0.2105 | 0.3932 | 0.8973 | -2.475 | 0.01332 | 0.4311 | 0.42674 | 0.38798 | 0.45547 | 30 | 82 | 71 | 44 | 137 | 66 |
| rs7305832 | Imputed | C | GEN | 431 | | | | | 3.043 | 0.2184 | 0.471 | 0.37355 | 0.3913 | 0.36032 | 30 | 84 | 70 | 26 | 126 | 95 |
| rs7305832 | Imputed | C | REC | 431 | 1.616 | 0.2891 | 0.9169 | 2.847 | 1.66 | 0.09694 | 0.471 | 0.37355 | 0.3913 | 0.36032 | 30 | 84 | 70 | 26 | 126 | 95 |
| rs7331467 | Imputed | A | GEN | 431 | | | | | 11.32 | 0.00349 | 0.4097 | 0.37007 | 0.39674 | 0.3502 | 38 | 70 | 76 | 25 | 123 | 99 |
| rs7392620 | Imputed | C | ADD | 421 | 0.7494 | 0.1521 | 0.5562 | 1.01 | -1.896 | 0.05801 | 0.8266 | 0.33135 | 0.29558 | 0.35833 | 13 | 81 | 87 | 32 | 108 | 100 |
| rs742827 | Imputed | A | ADD | 423 | 1.374 | 0.1417 | 1.041 | 1.814 | 2.245 | 0.02479 | 0.1106 | 0.35461 | 0.3956 | 0.32365 | 30 | 84 | 68 | 31 | 94 | 116 |
| rs742827 | Imputed | A | GEN | 423 | | | | | 5.635 | 0.05977 | 0.1106 | 0.35461 | 0.3956 | 0.32365 | 30 | 84 | 68 | 31 | 94 | 116 |
| rs742827 | Imputed | A | REC | 423 | 1.393 | 0.2794 | 0.8055 | 2.408 | 1.186 | 0.2357 | 0.1106 | 0.35461 | 0.3956 | 0.32365 | 30 | 84 | 68 | 31 | 94 | 116 |
| rs7446891 | Imputed | G | DOM | 429 | 0.6887 | 0.197 | 0.4682 | 1.013 | -1.893 | 0.05831 | 1 | 0.31702 | 0.28962 | 0.3374 | 18 | 70 | 95 | 25 | 116 | 105 |
| rs7448641 | Imputed | C | ADD | 431 | 0.309 | 0.5694 | 0.1012 | 0.9434 | -2.062 | 0.03918 | 1 | 0.0232 | 0.01087 | 0.03239 | 0 | 4 | 180 | 0 | 16 | 231 |
| rs7448641 | Imputed | C | DOM | 431 | 0.309 | 0.5694 | 0.1012 | 0.9434 | -2.062 | 0.03918 | 1 | 0.0232 | 0.01087 | 0.03239 | 0 | 4 | 180 | 0 | 16 | 231 |
| rs7484728 | Imputed | A | GEN | 429 | | | | | 10.78 | 0.00456 | 0.03857 | 0.37063 | 0.4235 | 0.3313 | 42 | 71 | 70 | 27 | 109 | 110 |
| rs7499402 | Genotyped | A | ADD | 431 | 1.39 | 0.2523 | 0.8476 | 2.279 | 1.305 | 0.1919 | 0.7458 | 0.08005 | 0.09511 | 0.06883 | 2 | 31 | 151 | 1 | 32 | 214 |
| rs7529851 | Imputed | A | ADD | 412 | 0.6637 | 0.1466 | 0.498 | 0.8846 | -2.796 | 0.00517 | 0.8387 | 0.41141 | 0.35593 | 0.45319 | 23 | 80 | 74 | 16 | 117 | 70 |
| rs7529851 | Imputed | A | GEN | 412 | | | | | 7.96 | 0.01868 | 0.8387 | 0.41141 | 0.35593 | 0.45319 | 23 | 80 | 74 | 16 | 117 | 70 |
| rs7573951 | Imputed | G | ADD | 431 | 0.6931 | 0.1457 | 0.521 | 0.9221 | -2.517 | 0.01184 | 0.6898 | 0.40371 | 0.35598 | 0.43927 | 23 | 87 | 75 | 46 | 125 | 76 |
| rs7599198 | Imputed | T | DOM | 373 | 0.5474 | 0.2267 | 0.351 | 0.8537 | -2.658 | 0.00787 | 0.599 | 0.42895 | 0.37742 | 0.4656 | 23 | 71 | 61 | 43 | 117 | 58 |
| rs7600050 | Imputed | C | ADD | 408 | 1.511 | 0.1483 | 1.13 | 2.02 | 2.782 | 0.00541 | 0.6132 | 0.42892 | 0.48295 | 0.38793 | 41 | 88 | 47 | 31 | 118 | 83 |
| rs7607712 | Imputed | T | ADD | 416 | 1.551 | 0.1747 | 1.101 | 2.185 | 2.513 | 0.01197 | 0.00491 | 0.25962 | 0.30114 | 0.22917 | 11 | 84 | 81 | 6 | 98 | 136 |
| rs7607712 | Imputed | T | DOM | 416 | 1.544 | 0.2007 | 1.042 | 2.289 | 2.165 | 0.03037 | 0.00491 | 0.25962 | 0.30114 | 0.22917 | 11 | 84 | 81 | 6 | 98 | 136 |
| rs7613492 | Imputed | G | GEN | 430 | | | | | 7.139 | 0.02817 | 0.02491 | 0.34535 | 0.39946 | 0.30488 | 34 | 79 | 71 | 28 | 94 | 124 |
| rs7621663 | Imputed | G | ADD | 431 | 1.447 | 0.1393 | 1.102 | 1.901 | 2.655 | 0.00794 | 0.02563 | 0.34571 | 0.39946 | 0.30567 | 34 | 79 | 71 | 28 | 95 | 124 |
| rs7621663 | Imputed | G | GEN | 431 | | | | | 7.055 | 0.02938 | 0.02563 | 0.34571 | 0.39946 | 0.30567 | 34 | 79 | 71 | 28 | 95 | 124 |
| rs7621663 | Imputed | G | REC | 431 | 1.785 | 0.2775 | 1.036 | 3.075 | 2.089 | 0.03675 | 0.02563 | 0.34571 | 0.39946 | 0.30567 | 34 | 79 | 71 | 28 | 95 | 124 |
| rs7626584 | Imputed | C | ADD | 431 | 0.5782 | 0.3624 | 0.2842 | 1.176 | -1.511 | 0.1307 | 1 | 0.04524 | 0.03261 | 0.05466 | 0 | 12 | 172 | 0 | 27 | 220 |
| rs7684899 | Imputed | C | ADD | 431 | 0.7399 | 0.1691 | 0.5312 | 1.031 | -1.782 | 0.07475 | 0.2494 | 0.2239 | 0.19565 | 0.24494 | 10 | 52 | 122 | 12 | 97 | 138 |
| rs7684899 | Imputed | C | DOM | 431 | 0.6359 | 0.2028 | 0.4273 | 0.9464 | -2.232 | 0.02564 | 0.2494 | 0.2239 | 0.19565 | 0.24494 | 10 | 52 | 122 | 12 | 97 | 138 |
| rs7701604 | Imputed | G | ADD | 431 | 0.309 | 0.5694 | 0.1012 | 0.9434 | -2.062 | 0.03918 | 0.8902 | 0.0232 | 0.01087 | 0.03239 | 0 | 4 | 180 | 0 | 16 | 231 |
| rs7701604 | Imputed | G | DOM | 431 | 0.309 | 0.5694 | 0.1012 | 0.9434 | -2.062 | 0.03918 | 0.8902 | 0.0232 | 0.01087 | 0.03239 | 0 | 4 | 180 | 0 | 16 | 231 |
| rs7703676 | Imputed | G | ADD | 431 | 0.309 | 0.5694 | 0.1012 | 0.9434 | -2.062 | 0.03918 | 1 | 0.0232 | 0.01087 | 0.03239 | 0 | 4 | 180 | 0 | 16 | 231 |
| rs7703676 | Imputed | G | GEN | 431 | | | | | 4.213 | 0.03918 | 1 | 0.0232 | 0.01087 | 0.03239 | 0 | 4 | 180 | 0 | 16 | 231 |
| rs7708491 | Imputed | C | REC | 428 | 0.5862 | 0.2628 | 0.3502 | 0.9812 | -2.032 | 0.04213 | 0.3793 | 0.44509 | 0.42896 | 0.45714 | 26 | 105 | 52 | 54 | 116 | 75 |
| rs7711358 | Imputed | A | DOM | 431 | 0.7035 | 0.1964 | 0.4787 | 1.034 | -1.791 | 0.07336 | 0.7398 | 0.32019 | 0.2962 | 0.33806 | 20 | 69 | 95 | 26 | 115 | 106 |
| rs7719448 | Imputed | G | REC | 429 | 0.5823 | 0.2627 | 0.348 | 0.9745 | -2.058 | 0.03958 | 0.3789 | 0.44522 | 0.42935 | 0.45714 | 26 | 106 | 52 | 54 | 116 | 75 |
| rs7724761 | Imputed | T | REC | 418 | 0.5608 | 0.2705 | 0.3301 | 0.953 | -2.138 | 0.03252 | 0.4268 | 0.439 | 0.42179 | 0.45188 | 24 | 103 | 66 | 52 | 112 | 75 |
| rs7742476 | Imputed | T | DOM | 420 | 1.408 | 0.2046 | 0.9428 | 2.103 | 1.672 | 0.09449 | 0.6585 | 0.20952 | 0.23333 | 0.19167 | 9 | 66 | 105 | 11 | 70 | 159 |
| rs7762993 | Imputed | A | ADD | 431 | 1.384 | 0.1852 | 0.963 | 1.99 | 1.756 | 0.07907 | 0.2535 | 0.18097 | 0.20652 | 0.16194 | 4 | 68 | 112 | 6 | 68 | 173 |
| rs7762993 | Imputed | A | DOM | 431 | 1.506 | 0.206 | 1.006 | 2.255 | 1.987 | 0.04689 | 0.2535 | 0.18097 | 0.20652 | 0.16194 | 4 | 68 | 112 | 6 | 68 | 173 |
| rs7767265 | Imputed | G | ADD | 423 | 1.375 | 0.168 | 0.9889 | 1.91 | 1.894 | 0.05828 | 0.6667 | 0.21513 | 0.24586 | 0.19215 | 9 | 71 | 101 | 9 | 69 | 161 |
| rs7767265 | Imputed | G | DOM | 423 | 1.584 | 0.2032 | 1.064 | 2.359 | 2.263 | 0.02363 | 0.6667 | 0.21513 | 0.24586 | 0.19215 | 9 | 71 | 101 | 9 | 69 | 161 |
| rs7768128 | Imputed | G | REC | 407 | 0.4807 | 0.4606 | 0.1949 | 1.186 | -1.59 | 0.1118 | 0.4044 | 0.23219 | 0.21637 | 0.24364 | 7 | 60 | 104 | 18 | 79 | 139 |

TABLE 15-continued

| SNP rs # | SOURCE | AL-LELE (A1) | MOD-EL | NMISS | OR | SE | L95 | U95 | STAT | P | HW_PVA-LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs7771264 | Imputed | T | DOM | 431 | 0.5289 | 0.2031 | 0.3552 | 0.7874 | −3.137 | 0.00171 | 0.1775 | 0.23318 | 0.19022 | 0.26518 | 7 | 56 | 121 | 11 | 109 | 127 |
| rs7773151 | Genotyped | C | DOM | 431 | 0.5304 | 0.202 | 0.357 | 0.7881 | −3.139 | 0.0017 | 0.1465 | 0.24014 | 0.20109 | 0.26923 | 9 | 56 | 119 | 10 | 113 | 124 |
| rs7773210 | Genotyped | A | DOM | 431 | 0.5304 | 0.202 | 0.357 | 0.7881 | −3.139 | 0.0017 | 0.1465 | 0.24014 | 0.20109 | 0.26923 | 9 | 56 | 119 | 10 | 113 | 124 |
| rs7808536 | Imputed | G | DOM | 429 | 1.939 | 0.2082 | 1.289 | 2.916 | 3.18 | 0.00147 | 1 | 0.18531 | 0.22951 | 0.15244 | 7 | 70 | 106 | 7 | 61 | 178 |
| rs7843510 | Genotyped | G | DOM | 431 | 1.603 | 0.203 | 1.077 | 2.386 | 2.323 | 0.02015 | 0.6081 | 0.37471 | 0.4375 | 0.32794 | 38 | 85 | 61 | 25 | 112 | 110 |
| rs7894867 | Imputed | T | DOM | 430 | 1.833 | 0.2398 | 1.146 | 2.932 | 2.527 | 0.01151 | 0.03174 | 0.11744 | 0.15574 | 0.08907 | 8 | 41 | 134 | 3 | 38 | 206 |
| rs7921834 | Imputed | C | DOM | 430 | 1.458 | 0.197 | 0.9908 | 2.145 | 1.913 | 0.05576 | 0.4158 | 0.29419 | 0.32065 | 0.27439 | 18 | 82 | 84 | 23 | 89 | 134 |
| rs7939893 | Imputed | C | ADD | 431 | 0.8337 | 0.1482 | 0.6235 | 1.115 | −1.227 | 0.22 | 0.6712 | 0.34455 | 0.32337 | 0.36032 | 21 | 77 | 86 | 28 | 122 | 97 |
| rs7939893 | Imputed | C | DOM | 431 | 0.7294 | 0.1979 | 0.4949 | 1.075 | −1.594 | 0.1109 | 0.6712 | 0.34455 | 0.32337 | 0.36032 | 21 | 77 | 86 | 28 | 122 | 97 |
| rs7944513 | Imputed | T | GEN | 410 | | | | | 5.096 | 0.07823 | 0.8957 | 0.25 | 0.28902 | 0.22152 | 16 | 68 | 89 | 10 | 85 | 142 |
| rs7944513 | Imputed | T | REC | 410 | 2.257 | 0.4179 | 0.9952 | 5.12 | 1.949 | 0.05135 | 0.8957 | 0.25 | 0.28902 | 0.22152 | 16 | 68 | 89 | 10 | 85 | 142 |
| rs7949720 | Imputed | G | ADD | 406 | 0.6348 | 0.2219 | 0.4109 | 0.9807 | −2.048 | 0.0406 | 0.09887 | 0.12192 | 0.09281 | 0.14226 | 2 | 27 | 138 | 8 | 52 | 179 |
| rs7949720 | Imputed | G | DOM | 406 | 0.6285 | 0.2538 | 0.3822 | 1.034 | −1.83 | 0.06728 | 0.09887 | 0.12192 | 0.09281 | 0.14226 | 2 | 27 | 138 | 8 | 52 | 179 |
| rs7955901 | Imputed | C | ADD | 429 | 0.7576 | 0.1448 | 0.5705 | 1.006 | −1.918 | 0.05515 | 0.4895 | 0.42657 | 0.38736 | 0.45547 | 30 | 81 | 71 | 8 | 137 | 66 |
| rs7955901 | Imputed | C | DOM | 429 | 0.5886 | 0.2107 | 0.3895 | 0.8896 | −2.516 | 0.01189 | 0.4895 | 0.42657 | 0.38736 | 0.45547 | 30 | 81 | 71 | 8 | 137 | 66 |
| rs7956274 | Imputed | T | ADD | 429 | 0.7688 | 0.1449 | 0.5788 | 1.021 | −1.815 | 0.06949 | 0.3761 | 0.42541 | 0.38859 | 0.45306 | 30 | 83 | 71 | 8 | 136 | 66 |
| rs7956274 | Imputed | T | DOM | 429 | 0.6074 | 0.2105 | 0.402 | 0.9176 | −2.369 | 0.01786 | 0.3761 | 0.42541 | 0.38859 | 0.45306 | 30 | 83 | 71 | 8 | 136 | 66 |
| rs7956274 | Imputed | T | GEN | 429 | | | | | 5.764 | 0.05601 | 0.3761 | 0.42541 | 0.38859 | 0.45306 | 30 | 83 | 71 | 8 | 136 | 66 |
| rs7957932 | Imputed | G | ADD | 429 | 0.7693 | 0.1441 | 0.58 | 1.02 | −1.819 | 0.06884 | 0.4321 | 0.4359 | 0.39946 | 0.46327 | 32 | 83 | 69 | 6 | 137 | 63 |
| rs7957932 | Imputed | G | DOM | 429 | 0.5936 | 0.2123 | 0.3915 | 0.8999 | −2.457 | 0.01402 | 0.4321 | 0.4359 | 0.39946 | 0.46327 | 32 | 83 | 69 | 6 | 137 | 63 |
| rs7984504 | Imputed | C | GEN | 431 | | | | | 7.984 | 0.01846 | 0.5855 | 0.32831 | 0.3587 | 0.30567 | 24 | 72 | 82 | 19 | 113 | 115 |
| rs7999518 | Imputed | A | REC | 385 | 0.6295 | 0.2746 | 0.3675 | 1.078 | −1.686 | 0.09185 | 0.305 | 0.45065 | 0.42857 | 0.46652 | 24 | 90 | 47 | 49 | 111 | 64 |
| rs8026245 | Imputed | G | GEN | 431 | | | | | 6.07 | 0.04808 | 0.7883 | 0.23202 | 0.25272 | 0.2166 | 16 | 61 | 107 | 8 | 91 | 148 |
| rs8026245 | Imputed | G | REC | 431 | 2.44 | 0.4471 | 1.239 | 7.15 | 2.44 | 0.01469 | 0.7883 | 0.23202 | 0.25272 | 0.2166 | 16 | 61 | 107 | 8 | 91 | 148 |
| rs8060725 | Genotyped | A | ADD | 431 | 0.7775 | 0.173 | 0.5539 | 1.091 | −1.455 | 0.1456 | 0.774 | 0.21346 | 0.19022 | 0.23077 | 4 | 62 | 118 | 14 | 86 | 147 |
| rs8103016 | Genotyped | A | ADD | 431 | 1.589 | 0.1785 | 1.12 | 2.254 | 2.594 | 0.0095 | 0.4503 | 0.19722 | 0.23641 | 0.16802 | 8 | 71 | 105 | 6 | 71 | 170 |
| rs8103016 | Genotyped | A | DOM | 431 | 1.683 | 0.2037 | 1.129 | 2.508 | 2.555 | 0.01061 | 0.4503 | 0.19722 | 0.23641 | 0.16802 | 8 | 71 | 105 | 6 | 71 | 170 |
| rs8104182 | Imputed | G | ADD | 429 | 1.613 | 0.1788 | 1.136 | 2.289 | 2.672 | 0.00754 | 0.5407 | 0.19606 | 0.23641 | 0.16599 | 8 | 71 | 105 | 6 | 71 | 171 |
| rs8104182 | Imputed | G | DOM | 431 | 1.716 | 0.204 | 1.151 | 2.56 | 2.648 | 0.00811 | 0.5407 | 0.19606 | 0.23641 | 0.16599 | 8 | 71 | 105 | 6 | 71 | 171 |
| rs8129461 | Imputed | G | ADD | 429 | 0.6337 | 0.4061 | 0.2859 | 1.405 | −1.123 | 0.2614 | 0.3657 | 0.03263 | 0.02459 | 0.03862 | 0 | 9 | 174 | 1 | 17 | 228 |
| rs8129461 | Imputed | G | DOM | 429 | 0.6518 | 0.4222 | 0.2849 | 1.491 | −1.014 | 0.3106 | 0.3657 | 0.03263 | 0.02459 | 0.03862 | 0 | 9 | 174 | 1 | 17 | 228 |
| rs8130021 | Imputed | G | ADD | 429 | 0.6337 | 0.4061 | 0.2859 | 1.405 | −1.123 | 0.2614 | 0.3657 | 0.03263 | 0.02459 | 0.03862 | 0 | 9 | 174 | 1 | 17 | 228 |
| rs8130021 | Imputed | G | DOM | 429 | 0.6518 | 0.4222 | 0.2849 | 1.491 | −1.014 | 0.3106 | 0.3657 | 0.03263 | 0.02459 | 0.03862 | 0 | 9 | 174 | 1 | 17 | 228 |
| rs879961 | Imputed | A | ADD | 430 | 0.7316 | 0.1563 | 0.5386 | 0.9938 | −2 | 0.04552 | 0.5449 | 0.27442 | 0.2377 | 0.30162 | 15 | 57 | 111 | 20 | 109 | 118 |
| rs879961 | Imputed | A | DOM | 430 | 0.5986 | 0.1985 | 0.4057 | 0.8831 | −2.586 | 0.00971 | 0.5449 | 0.27442 | 0.2377 | 0.30162 | 15 | 57 | 111 | 20 | 109 | 118 |
| rs906353 | Genotyped | G | DOM | 431 | 0.6603 | 0.1967 | 0.4491 | 0.9708 | −2.11 | 0.03482 | 0.6452 | 0.29698 | 0.26902 | 0.31781 | 18 | 63 | 103 | 22 | 113 | 112 |
| rs915491 | Imputed | C | DOM | 431 | 1.452 | 0.1969 | 0.9867 | 2.135 | 1.892 | 0.0585 | 0.3349 | 0.2761 | 0.30163 | 0.25709 | 16 | 79 | 89 | 21 | 85 | 141 |
| rs915493 | Imputed | T | DOM | 431 | 1.279 | 0.1636 | 0.9278 | 1.762 | 1.502 | 0.1331 | 0.5983 | 0.25765 | 0.28485 | 0.23789 | 13 | 79 | 84 | 15 | 85 | 134 |
| rs915494 | Imputed | A | ADD | 392 | 1.409 | 0.207 | 0.9389 | 2.114 | 1.656 | 0.0978 | 0.5983 | 0.25765 | 0.28485 | 0.23789 | 13 | 68 | 84 | 15 | 78 | 134 |
| rs917295 | Imputed | G | DOM | 429 | 0.6749 | 0.197 | 0.4587 | 0.993 | −1.996 | 0.04596 | 1 | 0.28689 | 0.28689 | 0.3374 | 18 | 69 | 96 | 25 | 116 | 105 |
| rs9284851 | Imputed | A | GEN | 426 | | | | | 6.343 | 0.04195 | 0.03262 | 0.31585 | 0.39946 | 0.30992 | 34 | 79 | 71 | 28 | 94 | 120 |
| rs9293464 | Imputed | T | REC | 429 | 0.5823 | 0.2627 | 0.348 | 0.9745 | −2.058 | 0.03958 | 0.3789 | 0.44522 | 0.42935 | 0.45714 | 26 | 106 | 52 | 54 | 116 | 75 |
| rs9295154 | Genotyped | G | DOM | 431 | 1.917 | 0.2188 | 1.249 | 2.943 | 2.974 | 0.00294 | 0.274 | 0.15777 | 0.19022 | 0.1336 | 5 | 60 | 119 | 9 | 48 | 190 |
| rs9310221 | Imputed | G | DOM | 389 | 1.407 | 0.2186 | 0.917 | 2.16 | 1.563 | 0.118 | 1 | 0.40746 | 0.41768 | 0.4 | 23 | 91 | 50 | 41 | 98 | 86 |
| rs9310699 | Genotyped | T | GEN | 431 | | | | | 7.563 | 0.02279 | 0.04132 | 0.34107 | 0.39674 | 0.2996 | 33 | 80 | 71 | 27 | 94 | 126 |

TABLE 15-continued

| SNP rs # | SOURCE | AL-LELE (A1) | MOD-EL | NMISS | OR | SE | L95 | U95 | STAT | P | HW_PVA LUE | AL-LELE FREQ | PRA-VA_AL-LELE FREQ | PLA-CEBO_AL-LELE FREQ | PRA-VA_A1_HZ_CO-UNT | PRA-VA_HET_CO-UNT | PRA-VA_A2_HZ_CO-UNT | PLA-CEBO_A1_HZ_CO-UNT | PLA-CEBO_HET_CO-UNT | PLA-CEBO_A2_HZ_CO-UNT |
|---|---|---|---|---|---|---|---|---|---|---|---|---|---|---|---|---|---|---|---|---|
| rs9310700 | Imputed | C | ADD | 431 | 1.447 | 0.1393 | 1.102 | 1.901 | 2.655 | 0.00794 | 0.02563 | 0.34571 | 0.39946 | 0.30567 | 34 | 79 | 71 | 28 | 95 | 124 |
| rs9310700 | Imputed | C | GEN | 431 | | | | | 7.055 | 0.02938 | 0.02563 | 0.34571 | 0.39946 | 0.30567 | 34 | 79 | 71 | 28 | 95 | 124 |
| rs9310701 | Imputed | G | GEN | 430 | | | | | 6.869 | 0.03224 | 0.03283 | 0.34651 | 0.39946 | 0.30691 | 34 | 79 | 71 | 28 | 95 | 123 |
| rs9310704 | Imputed | G | GEN | 426 | | | | | 6.343 | 0.04195 | 0.03262 | 0.34859 | 0.39946 | 0.30992 | 30 | 79 | 71 | 28 | 94 | 120 |
| rs9319185 | Imputed | C | GEN | 431 | | | | | 7.984 | 0.01846 | 0.5855 | 0.32831 | 0.3587 | 0.30567 | 30 | 72 | 82 | 19 | 113 | 115 |
| rs9319186 | Imputed | T | GEN | 431 | | | | | 7.984 | 0.01846 | 0.5855 | 0.32831 | 0.3587 | 0.30567 | 30 | 72 | 82 | 19 | 113 | 115 |
| rs9327555 | Imputed | T | DOM | 429 | 0.6887 | 0.197 | 0.4682 | 1.013 | -1.893 | 0.05831 | 1 | 0.31702 | 0.28962 | 0.3374 | 18 | 70 | 95 | 25 | 116 | 105 |
| rs9403367 | Imputed | C | DOM | 431 | 0.5304 | 0.202 | 0.357 | 0.7881 | -3.139 | 0.0017 | 0.1465 | 0.24014 | 0.20109 | 0.26923 | 9 | 56 | 119 | 10 | 113 | 124 |
| rs9419608 | Imputed | G | REC | 427 | 1.589 | 0.2251 | 1.022 | 2.47 | 2.059 | 0.03954 | 0.08119 | 0.48595 | 0.51381 | 0.46545 | 55 | 76 | 50 | 55 | 119 | 72 |
| rs9426437 | Imputed | T | DOM | 426 | 0.6833 | 0.203 | 0.459 | 1.017 | -1.876 | 0.06061 | 0.7588 | 0.38498 | 0.35714 | 0.40574 | 25 | 80 | 77 | 36 | 126 | 82 |
| rs9454967 | Imputed | G | DOM | 431 | 2.24 | 0.3143 | 1.21 | 4.147 | 2.566 | 0.0103 | 0.1777 | 0.05916 | 0.08152 | 0.04251 | 1 | 28 | 155 | 2 | 17 | 228 |
| rs9635511 | Imputed | T | DOM | 427 | 0.7034 | 0.2071 | 0.4687 | 1.055 | -1.699 | 0.08928 | 0.108 | 0.40281 | 0.38525 | 0.41598 | 28 | 85 | 70 | 33 | 137 | 74 |
| rs966583 | Imputed | A | ADD | 431 | 0.6846 | 0.1496 | 0.5106 | 0.9178 | -2.533 | 0.01131 | 0.1622 | 0.40371 | 0.35326 | 0.4413 | 21 | 88 | 75 | 42 | 134 | 71 |
| rs966583 | Imputed | A | DOM | 431 | 0.6092 | 0.2075 | 0.4056 | 0.915 | -2.388 | 0.01694 | 0.1622 | 0.40371 | 0.35326 | 0.4413 | 21 | 88 | 75 | 42 | 134 | 71 |
| rs980263 | Imputed | T | GEN | 431 | | | | | 6.792 | 0.0335 | 0.0334 | 0.34687 | 0.39946 | 0.30769 | 34 | 79 | 71 | 28 | 96 | 123 |
| rs980264 | Imputed | T | GEN | 431 | | | | | 6.792 | 0.0335 | 0.0334 | 0.34687 | 0.39946 | 0.30769 | 34 | 79 | 71 | 28 | 96 | 123 |
| rs9812206 | Imputed | G | ADD | 431 | 0.4853 | 0.2571 | 0.2932 | 0.8033 | -2.812 | 0.00493 | 0.7864 | 0.09977 | 0.06793 | 0.12348 | 0 | 25 | 159 | 3 | 55 | 189 |
| rs9812206 | Imputed | G | DOM | 431 | 0.4903 | 0.2646 | 0.2919 | 0.8236 | -2.693 | 0.00707 | 0.7864 | 0.09977 | 0.06793 | 0.12348 | 0 | 25 | 159 | 3 | 55 | 189 |
| rs9813552 | Imputed | G | ADD | 431 | 0.5098 | 0.2537 | 0.3101 | 0.8382 | -2.656 | 0.00792 | 0.6016 | 0.10093 | 0.07065 | 0.12348 | 0 | 26 | 158 | 3 | 55 | 189 |
| rs9813552 | Imputed | G | DOM | 431 | 0.5166 | 0.2615 | 0.3095 | 0.8625 | -2.526 | 0.01154 | 0.6016 | 0.10093 | 0.07065 | 0.12348 | 0 | 26 | 158 | 3 | 55 | 189 |
| rs9815037 | Imputed | T | ADD | 430 | 0.4609 | 0.2606 | 0.2765 | 0.7681 | -2.972 | 0.00296 | 0.785 | 0.09884 | 0.06522 | 0.12398 | 0 | 24 | 160 | 3 | 55 | 188 |
| rs9815037 | Imputed | T | DOM | 430 | 0.4643 | 0.2679 | 0.2746 | 0.7848 | -2.864 | 0.00418 | 0.785 | 0.09884 | 0.06522 | 0.12398 | 0 | 24 | 160 | 3 | 55 | 188 |
| rs9819583 | Imputed | T | GEN | 431 | | | | | 7.563 | 0.02279 | 0.04132 | 0.34107 | 0.39674 | 0.2996 | 33 | 80 | 71 | 27 | 94 | 126 |
| rs9825349 | Imputed | A | ADD | 431 | 0.4629 | 0.2606 | 0.2778 | 0.7715 | -2.955 | 0.00312 | 0.7849 | 0.09861 | 0.06522 | 0.12348 | 0 | 24 | 160 | 3 | 55 | 189 |
| rs9825349 | Imputed | A | DOM | 431 | 0.4664 | 0.2679 | 0.2759 | 0.7884 | -2.847 | 0.00441 | 0.7849 | 0.09861 | 0.06522 | 0.12348 | 0 | 24 | 160 | 3 | 55 | 189 |
| rs9833118 | Imputed | G | ADD | 419 | 1.479 | 0.1411 | 1.122 | 1.95 | 2.774 | 0.00554 | 0.02381 | 0.34964 | 0.4073 | 0.30705 | 34 | 77 | 67 | 28 | 92 | 121 |
| rs9833118 | Imputed | G | GEN | 419 | | | | | 7.693 | 0.02135 | 0.02381 | 0.34964 | 0.4073 | 0.30705 | 34 | 77 | 67 | 28 | 92 | 121 |
| rs9834217 | Imputed | T | ADD | 430 | 0.4658 | 0.2606 | 0.2795 | 0.7764 | -2.931 | 0.00338 | 0.785 | 0.09884 | 0.06557 | 0.12348 | 0 | 24 | 159 | 3 | 55 | 189 |
| rs9834217 | Imputed | T | DOM | 430 | 0.4695 | 0.2679 | 0.2777 | 0.7937 | -2.822 | 0.00477 | 0.785 | 0.09884 | 0.06557 | 0.12348 | 0 | 24 | 159 | 3 | 55 | 189 |
| rs9838563 | Imputed | C | GEN | 430 | | | | | 6.869 | 0.03224 | 0.03283 | 0.34651 | 0.39946 | 0.30691 | 34 | 79 | 71 | 28 | 95 | 123 |
| rs9840460 | Imputed | T | ADD | 431 | 0.4629 | 0.2606 | 0.2778 | 0.7715 | -2.955 | 0.00312 | 0.7849 | 0.09861 | 0.06522 | 0.12348 | 0 | 24 | 160 | 3 | 55 | 189 |
| rs9840460 | Imputed | T | DOM | 431 | 0.4664 | 0.2679 | 0.2759 | 0.7884 | -2.847 | 0.00441 | 0.7849 | 0.09861 | 0.06522 | 0.12348 | 0 | 24 | 160 | 3 | 55 | 189 |
| rs9840756 | Imputed | A | ADD | 431 | 0.4629 | 0.2606 | 0.2778 | 0.7715 | -2.955 | 0.00312 | 0.7849 | 0.09861 | 0.06522 | 0.12348 | 0 | 24 | 160 | 3 | 55 | 189 |
| rs9840756 | Imputed | A | DOM | 431 | 0.4664 | 0.2679 | 0.2759 | 0.7884 | -2.847 | 0.00441 | 0.7849 | 0.09861 | 0.06522 | 0.12348 | 0 | 24 | 160 | 3 | 55 | 189 |
| rs9847999 | Imputed | C | GEN | 426 | | | | | 6.343 | 0.04195 | 0.03262 | 0.34859 | 0.39946 | 0.30992 | 34 | 79 | 71 | 28 | 94 | 120 |
| rs9864769 | Imputed | C | GEN | 431 | | | | | 6.792 | 0.0335 | 0.0334 | 0.34687 | 0.39946 | 0.30769 | 34 | 79 | 71 | 28 | 96 | 123 |
| rs9866421 | Genotyped | C | REC | 431 | 0.6994 | 0.2578 | 0.4219 | 1.159 | -1.387 | 0.1655 | 0.8452 | 0.43187 | 0.44022 | 0.42915 | 29 | 104 | 51 | 51 | 110 | 86 |
| rs987296 | Imputed | T | GEN | 430 | | | | | 7.666 | 0.02164 | 0.03184 | 0.3407 | 0.39674 | 0.29878 | 33 | 80 | 71 | 27 | 93 | 126 |
| rs9881685 | Imputed | A | ADD | 431 | 0.4853 | 0.2571 | 0.2932 | 0.8033 | -2.812 | 0.00493 | 0.7864 | 0.09977 | 0.06793 | 0.12348 | 0 | 25 | 159 | 3 | 55 | 189 |
| rs9881685 | Imputed | A | DOM | 431 | 0.4903 | 0.2646 | 0.2919 | 0.8236 | -2.693 | 0.00707 | 0.7864 | 0.09977 | 0.06793 | 0.12348 | 0 | 25 | 159 | 3 | 55 | 189 |
| rs992695 | Imputed | C | ADD | 431 | 0.7364 | 0.156 | 0.5424 | 0.9998 | -1.961 | 0.04987 | 0.5472 | 0.27494 | 0.23913 | 0.30162 | 15 | 58 | 111 | 20 | 109 | 118 |
| rs992695 | Imputed | C | DOM | 431 | 0.6065 | 0.198 | 0.4114 | 0.894 | -2.526 | 0.01155 | 0.5472 | 0.27494 | 0.23913 | 0.30162 | 15 | 58 | 111 | 20 | 109 | 118 |
| rs9936999 | Imputed | G | DOM | 249 | 1.779 | 0.2695 | 1.049 | 3.017 | 2.137 | 0.03256 | 0.6862 | 0.37349 | 0.42991 | 0.33099 | 18 | 56 | 33 | 15 | 64 | 63 |

TABLE 16

| SNP rs # | SOURCE | ALLELE (A1) | MODEL | NMISS | OR | SE | L95 | U95 | STAT | P | HW_PVALUE | ALLELE_FREQ | ATORVA_ALLELE_FREQ | PRAVA_ALLELE_FREQ |
|---|---|---|---|---|---|---|---|---|---|---|---|---|---|---|
| rs77638540 | Genotyped | T | DOM | 443 | 0.3879 | 0.3691 | 0.1881 | 0.7996 | -2.566 | 0.0103 | 0.3489 | 0.05305 | 0.0314 | 0.0694 |
| rs72746987 | Genotyped | A | DOM | 443 | 1.033 | 0.3495 | 0.5209 | 2.05 | 0.09422 | 0.9249 | 1 | 0.04176 | 0.0419 | 0.0417 |
| rs10021016 | Genotyped | G | GEN | 443 | | | | | 6.477 | 0.03922 | 0.7144 | 0.26298 | 0.2984 | 0.2361 |
| rs10021016 | Genotyped | G | REC | 443 | 2.482 | 0.3826 | 1.172 | 5.253 | 2.375 | 0.01753 | 0.7144 | 0.26298 | 0.2984 | 0.2361 |
| rs10051148 | Imputed | C | DOM | 443 | 0.6399 | 0.1948 | 0.4368 | 0.9373 | -2.293 | 0.02187 | 0.8242 | 0.30813 | 0.2801 | 0.3294 |
| rs10054055 | Imputed | T | DOM | 440 | 0.5872 | 0.2006 | 0.3963 | 0.8702 | -2.653 | 0.007974 | 0.3313 | 0.32841 | 0.2937 | 0.3546 |
| rs10067895 | Imputed | A | DOM | 440 | 0.577 | 0.2025 | 0.388 | 0.8581 | -2.716 | 0.006612 | 0.07522 | 0.34886 | 0.3132 | 0.376 |
| rs10100725 | Imputed | C | DOM | 443 | 1.055 | 0.2111 | 0.6977 | 1.596 | 0.2549 | 0.7988 | 0.3323 | 0.17833 | 0.1859 | 0.1726 |
| rs10128531 | Imputed | T | DOM | 415 | 1.662 | 0.2062 | 1.11 | 2.49 | 2.465 | 0.0137 | 0.677 | 0.13735 | 0.1742 | 0.1097 |
| rs10181743 | Imputed | G | ADD | 417 | 1.137 | 0.1442 | 0.8575 | 1.509 | 0.8934 | 0.3716 | 0.6902 | 0.43046 | 0.4469 | 0.4181 |
| rs10199127 | Imputed | T | DOM | 431 | 1.032 | 0.2018 | 0.6945 | 1.532 | 0.1537 | 0.8779 | 0.3263 | 0.32831 | 0.3155 | 0.3381 |
| rs10270624 | Imputed | G | DOM | 409 | 1.374 | 0.2138 | 0.904 | 2.09 | 1.488 | 0.1368 | 0.7448 | 0.18582 | 0.2095 | 0.1674 |
| rs1030006 | Imputed | T | REC | 434 | 0.87 | 0.2356 | 0.5483 | 1.381 | -0.591 | 0.5545 | 0.7002 | 0.47005 | 0.4599 | 0.4777 |
| rs1031811 | Imputed | G | REC | 434 | 2.698 | 0.3294 | 1.415 | 5.145 | 3.013 | 0.002589 | 0.7388 | 0.31567 | 0.361 | 0.2814 |
| rs10430870 | Genotyped | A | GEN | 443 | | | | | 8.277 | 0.01594 | 0.7024 | 0.24831 | 0.2853 | 0.2202 |
| rs10430870 | Genotyped | G | REC | 443 | 3.43 | 0.4334 | 1.467 | 8.021 | 2.84E+00 | 0.004451 | 0.7024 | 0.24831 | 0.2853 | 0.2202 |
| rs10469597 | Imputed | A | GEN | 411 | | | | | 2.673 | 0.2627 | 0.5359 | 0.27494 | 0.2599 | 0.2863 |
| rs10469597 | Imputed | A | REC | 411 | 1.249 | 0.4024 | 0.5677 | 2.749 | 0.5528 | 0.5804 | 0.5359 | 0.27494 | 0.2599 | 0.2863 |
| rs10478919 | Imputed | G | DOM | 411 | 0.593 | 0.2016 | 0.3994 | 0.8804 | -2.592 | 0.009541 | 0.1134 | 0.34312 | 0.3089 | 0.369 |
| rs10506623 | Imputed | C | ADD | 442 | 0.7806 | 0.1427 | 0.5901 | 1.033 | -1.735 | 0.08266 | 0.6908 | 0.3948 | 0.3632 | 0.4187 |
| rs10506623 | Imputed | C | DOM | 442 | 0.7185 | 0.204 | 0.4817 | 1.072 | -1.621 | 0.1051 | 0.6908 | 0.3948 | 0.3632 | 0.4187 |
| rs10506626 | Imputed | A | ADD | 443 | 0.7544 | 0.1415 | 0.5717 | 0.9954 | -1.992 | 0.04634 | 0.5504 | 0.39391 | 0.356 | 0.4226 |
| rs10506626 | Imputed | A | DOM | 443 | 0.6807 | 0.2015 | 0.4586 | 1.01 | -1.909 | 0.05621 | 0.5504 | 0.39391 | 0.356 | 0.4226 |
| rs10509477 | Imputed | T | DOM | 443 | 1.364 | 0.1959 | 0.9291 | 2.003 | 1.584 | 0.1131 | 0.1655 | 0.33409 | 0.3691 | 0.3075 |
| rs10517918 | Imputed | G | REC | 433 | 0.972 | 0.2598 | 0.5841 | 1.618 | -0.1092 | 0.9131 | 0.4917 | 0.42725 | 0.4309 | 0.4245 |
| rs10517924 | Imputed | A | REC | 442 | 1.079 | 0.2382 | 0.6766 | 1.721 | 0.3198 | 0.7491 | 1 | 0.46154 | 0.466 | 0.4582 |
| rs10519362 | Imputed | G | DOM | 434 | 1.656 | 0.2162 | 1.084 | 2.529 | 2.333 | 0.01967 | 0.5877 | 0.15668 | 0.1882 | 0.1331 |
| rs10520072 | Imputed | T | DOM | 443 | 0.5934 | 0.2016 | 0.3997 | 0.881 | -2.589 | 0.009637 | 0.1134 | 0.34312 | 0.3115 | 0.3671 |
| rs10737390 | Imputed | T | DOM | 418 | 1.128 | 0.213 | 0.7431 | 1.712 | 0.5659 | 0.5715 | 0.3626 | 0.40909 | 0.419 | 0.4017 |
| rs10742851 | Imputed | T | REC | 443 | 1.673 | 0.3727 | 0.8057 | 3.473 | 1.38 | 0.1675 | 0.4903 | 0.29007 | 0.3037 | 0.2798 |
| rs10743685 | Imputed | G | GEN | 435 | | | | | 1.895 | 0.3878 | 0.1663 | 0.41379 | 0.4335 | 0.3988 |
| rs10743685 | Imputed | G | REC | 435 | 1.446 | 0.2691 | 0.8531 | 2.45 | 1.37 | 0.1708 | 0.1663 | 0.41379 | 0.4335 | 0.3988 |
| rs10749293 | Imputed | G | DOM | 441 | 1.442 | 0.1947 | 0.9847 | 2.113 | 1.881 | 0.05998 | 0.1901 | 0.322 | 0.3579 | 0.2948 |
| rs10749294 | Imputed | A | DOM | 443 | 1.341 | 0.1934 | 0.9176 | 1.959 | 1.516 | 0.1296 | 0.2987 | 0.29007 | 0.3246 | 0.2639 |
| rs10753760 | Imputed | T | ADD | 423 | 1.352 | 0.1976 | 0.9176 | 1.991 | 1.525 | 0.1272 | 0.01675 | 0.41844 | 0.4108 | 0.4244 |
| rs10753760 | Imputed | T | GEN | 423 | | | | | 0.9252 | 0.1361 | 0.7085 | 1.987 | 0.01675 | 0.41844 | 0.4108 | 0.4244 |
| rs10772362 | Imputed | T | ADD | 443 | 0.9252 | 0.1361 | 0.7085 | 1.208 | -0.5713 | 0.5678 | 0.3626 | 0.41844 | 0.4108 | 0.4244 |
| rs10784891 | Imputed | C | ADD | 443 | 0.8356 | 0.1722 | 0.5962 | 1.171 | -1.043 | 0.297 | 0.5807 | 0.22122 | 0.2068 | 0.2321 |
| rs10784891 | Imputed | C | ADD | 422 | 0.7472 | 0.1404 | 0.5675 | 0.9839 | -2.076 | 0.03794 | 0.4305 | 0.4455 | 0.4049 | 0.4769 |
| rs10784891 | Imputed | C | DOM | 422 | 0.7374 | 0.2125 | 0.4862 | 1.118 | -1.433 | 0.1518 | 0.4305 | 0.4455 | 0.4049 | 0.4769 |
| rs10784891 | Imputed | C | GEN | 422 | | | | | 4.661 | 0.09727 | 0.4305 | 0.4455 | 0.4049 | 0.4769 |
| rs10787923 | Imputed | G | DOM | 439 | 1.448 | 0.1952 | 0.9878 | 2.123 | 1.897 | 0.05785 | 0.1572 | 0.32232 | 0.359 | 0.2948 |
| rs10787924 | Imputed | T | DOM | 443 | 1.341 | 0.1934 | 0.9176 | 1.959 | 1.516 | 0.1296 | 0.2987 | 0.29007 | 0.3246 | 0.2639 |
| rs10787949 | Imputed | C | DOM | 442 | 1.352 | 0.1976 | 0.9157 | 1.991 | 1.525 | 0.1272 | 0.1377 | 0.33937 | 0.3717 | 0.3147 |
| rs10787951 | Imputed | A | DOM | 441 | 1.349 | 0.1976 | 0.9157 | 1.987 | 1.514 | 0.1299 | 0.1364 | 0.339 | 0.3711 | 0.3147 |
| rs10787983 | Imputed | C | DOM | 441 | 1.351 | 0.1964 | 0.9194 | 1.986 | 1.532 | 0.1255 | 0.1642 | 0.33447 | 0.3691 | 0.308 |
| rs10794733 | Imputed | C | ADD | 439 | 0.6594 | 0.1519 | 0.4896 | 0.888 | -2.742 | 0.006112 | 0.578 | 0.31093 | 0.2605 | 0.3494 |
| rs10818280 | Imputed | C | DOM | 432 | 0.6208 | 0.201 | 0.4186 | 0.9206 | -2.371 | 0.01772 | 0.347 | 0.28588 | 0.2433 | 0.3184 |
| rs10860586 | Imputed | A | ADD | 431 | 0.9019 | 0.1389 | 0.6869 | 1.184 | -0.7436 | 0.4571 | 0.9232 | 0.5058 | 0.4892 | 0.5183 |

TABLE 16-continued

| | | | | | | | | | | | |
|---|---|---|---|---|---|---|---|---|---|---|---|
| rs10860586 | Imputed | A | GEN | 431 | | | | | 0.568 | 0.7528 | 0.9232 | 0.5058 | 0.4892 | 0.5183 |
| rs10870473 | Imputed | A | ADD | 177 | 1.273 | 0.2526 | 0.7757 | 2.088 | 0.9544 | 0.3399 | 1 | 0.29944 | 0.3209 | 0.2864 |
| rs10870473 | Imputed | A | DOM | 177 | 1.887 | 0.3386 | 0.9717 | 3.664 | 1.875 | 0.06077 | | 0.29944 | 0.3209 | 0.2864 |
| rs10879240 | Imputed | C | ADD | 428 | 0.7296 | 0.1403 | 0.5542 | 0.9605 | -2.247 | 0.02462 | 0.434 | 0.44743 | 0.4043 | 0.4813 |
| rs10879240 | Imputed | C | GEN | 428 | | | | | 5.7 | 0.05785 | 0.434 | 0.44743 | 0.4043 | 0.4813 |
| rs10879242 | Imputed | A | ADD | 421 | 0.7715 | 0.1445 | 0.5812 | 1.024 | -1.795 | 0.07269 | 0.9197 | 0.40855 | 0.373 | 0.4364 |
| rs10879242 | Imputed | A | DOM | 421 | 0.7102 | 0.2081 | 0.4724 | 1.068 | -1.644 | 0.1001 | 0.9197 | 0.40855 | 0.373 | 0.4364 |
| rs10879245 | Imputed | G | ADD | 421 | 0.7715 | 0.1445 | 0.5812 | 1.024 | -1.795 | 0.07269 | 0.9197 | 0.40855 | 0.373 | 0.4364 |
| rs10879245 | Imputed | G | DOM | 421 | 0.7102 | 0.2081 | 0.4724 | 1.068 | -1.644 | 0.1001 | 0.9197 | 0.40855 | 0.373 | 0.4364 |
| rs10879249 | Imputed | T | ADD | 440 | 0.7823 | 0.1427 | 0.5914 | 1.035 | -1.72 | 0.08541 | 0.7662 | 0.39773 | 0.3658 | 0.422 |
| rs10879249 | Imputed | T | DOM | 440 | 0.7247 | 0.2038 | 0.486 | 1.081 | -1.58 | 0.1141 | 0.7662 | 0.39773 | 0.3658 | 0.422 |
| rs10886429 | Imputed | A | DOM | 441 | 1.296 | 0.1967 | 0.8811 | 1.905 | 1.316 | 0.1881 | 0.1642 | 0.33447 | 0.3665 | 0.31 |
| rs10886449 | Imputed | G | DOM | 440 | 1.337 | 0.1968 | 0.9089 | 1.966 | 1.475 | 0.1403 | 0.1168 | 0.30795 | 0.3474 | 0.278 |
| rs10886451 | Imputed | G | DOM | 440 | 1.337 | 0.1968 | 0.9089 | 1.966 | 1.475 | 0.1403 | 0.1168 | 0.30795 | 0.3474 | 0.278 |
| rs10886452 | Imputed | A | DOM | 440 | 1.376 | 0.1972 | 0.9349 | 2.025 | 1.619 | 0.1055 | 0.1648 | 0.33523 | 0.3737 | 0.306 |
| rs10886456 | Imputed | G | DOM | 440 | 1.337 | 0.1968 | 0.9089 | 1.966 | 1.475 | 0.1403 | 0.1168 | 0.30795 | 0.3474 | 0.306 |
| rs10886463 | Imputed | C | DOM | 442 | 1.352 | 0.1976 | 0.9177 | 1.991 | 1.525 | 0.1272 | 0.1118 | 0.3405 | 0.3743 | 0.278 |
| rs10886465 | Imputed | A | DOM | 441 | 1.355 | 0.1976 | 0.9197 | 1.995 | 1.536 | 0.1245 | 0.1364 | 0.339 | 0.3743 | 0.3147 |
| rs10886526 | Imputed | C | DOM | 439 | 1.364 | 0.197 | 0.9275 | 2.007 | 1.578 | 0.1146 | 0.2383 | 0.33257 | 0.3677 | 0.312 |
| rs10922903 | Imputed | C | REC | 440 | 0.9678 | 0.2533 | 0.5891 | 1.59 | -0.1294 | 0.897 | 0.8458 | 0.43068 | 0.4418 | 0.4223 |
| rs10941126 | Imputed | G | ADD | 443 | 0.9741 | 0.2886 | 0.5532 | 1.715 | -0.09096 | 0.9275 | 2.36E-05 | 0.07336 | 0.0733 | 0.0734 |
| rs10941126 | Imputed | G | DOM | 443 | 1.136 | 0.3415 | 0.5817 | 2.218 | 0.3732 | 0.709 | 2.36E-05 | 0.07336 | 0.0733 | 0.0734 |
| rs10947980 | Imputed | G | ADD | 439 | 1.004 | 0.1592 | 0.7347 | 1.371 | 0.0233 | 0.9814 | 0.4609 | 0.2631 | 0.2632 | 0.2631 |
| rs11059376 | Imputed | T | ADD | 401 | 1.086 | 0.1953 | 0.7409 | 1.593 | 0.424 | 0.6716 | 1 | 0.16459 | 0.1695 | 0.1608 |
| rs11072995 | Imputed | T | GEN | 439 | | | | | 3.28 | 0.194 | 0.295 | 0.19932 | 0.2237 | 0.1807 |
| rs11072995 | Imputed | T | REC | 439 | 2.198 | 0.4614 | 0.8897 | 5.43 | 1.707 | 0.08787 | 0.295 | 0.19932 | 0.2237 | 0.1807 |
| rs11081202 | Genotyped | G | GEN | 443 | | | | | 8.643 | 0.01328 | 0.456 | 0.25621 | 0.288 | 0.2321 |
| rs11081202 | Genotyped | G | REC | 443 | 3.218 | 0.3982 | 1.475 | 7.022 | 2.935 | 0.003332 | 0.456 | 0.25621 | 0.288 | 0.2321 |
| rs110965 | Imputed | C | GEN | 420 | | | | | 11.84 | 0.002689 | 0.9143 | 0.34643 | 0.3984 | 0.3067 |
| rs11124962 | Imputed | A | DOM | 437 | 1.26 | 0.1969 | 0.8568 | 1.854 | 1.175 | 0.2401 | 0.3787 | 0.25515 | 0.2632 | 0.249 |
| rs1116596 | Imputed | T | DOM | 443 | 0.593 | 0.2016 | 0.3994 | 0.8804 | -2.592 | 0.009541 | 0.1134 | 0.34312 | 0.3089 | 0.369 |
| rs11178531 | Imputed | A | ADD | 439 | 0.7197 | 0.1371 | 0.5501 | 0.9416 | -2.399 | 0.01643 | 0.3881 | 0.46811 | 0.4211 | 0.504 |
| rs11178531 | Imputed | A | DOM | 439 | 0.6936 | 0.2116 | 0.4581 | 1.05 | -1.729 | 0.08386 | 0.3881 | 0.46811 | 0.4211 | 0.504 |
| rs11178583 | Imputed | A | ADD | 443 | 0.7883 | 0.1424 | 0.5963 | 1.042 | -1.671 | 0.09473 | 0.6922 | 0.39503 | 0.3639 | 0.4187 |
| rs11178583 | Imputed | A | DOM | 443 | 0.7338 | 0.2032 | 0.4927 | 1.093 | -1.523 | 0.1277 | 0.6922 | 0.39503 | 0.3639 | 0.4187 |
| rs11178589 | Imputed | T | ADD | 437 | 0.7796 | 0.1432 | 0.5888 | 1.032 | -1.739 | 0.08199 | 0.8419 | 0.39931 | 0.3658 | 0.4251 |
| rs11178589 | Imputed | T | DOM | 437 | 0.7215 | 0.2047 | 0.4831 | 1.078 | -1.595 | 0.1108 | 0.8419 | 0.39931 | 0.3658 | 0.4251 |
| rs11178594 | Imputed | C | ADD | 441 | 0.7716 | 0.1422 | 0.584 | 1.02 | -1.824 | 0.06814 | 1 | 0.40249 | 0.3684 | 0.4283 |
| rs11178594 | Imputed | C | DOM | 441 | 0.7044 | 0.202 | 0.4741 | 1.046 | -1.735 | 0.08274 | 1 | 0.40249 | 0.3684 | 0.4283 |
| rs11178602 | Imputed | T | ADD | 439 | 0.7699 | 0.1424 | 0.5824 | 1.018 | -1.836 | 0.06634 | 1 | 0.40205 | 0.3677 | 0.428 |
| rs11178602 | Imputed | T | DOM | 439 | 0.7005 | 0.2027 | 0.4709 | 1.042 | -1.757 | 0.079 | 1 | 0.40205 | 0.3677 | 0.428 |
| rs11178648 | Imputed | T | ADD | 440 | 0.754 | 0.1419 | 0.5709 | 0.9958 | -1.99 | 0.04664 | 0.4852 | 0.39432 | 0.3571 | 0.4223 |
| rs11178648 | Imputed | T | DOM | 440 | 0.6786 | 0.2027 | 0.4561 | 1.01 | -1.912 | 0.05581 | 0.4852 | 0.39432 | 0.3571 | 0.4223 |
| rs11198877 | Imputed | A | ADD | 441 | 1.369 | 0.1971 | 0.9302 | 2.014 | 1.593 | 0.1113 | 0.1996 | 0.3356 | 0.3737 | 0.3068 |
| rs11198942 | Imputed | A | DOM | 443 | 1.364 | 0.1959 | 0.9291 | 2.003 | 1.584 | 0.1131 | 0.1655 | 0.33409 | 0.3691 | 0.3075 |
| rs11221075 | Imputed | A | DOM | 417 | 0.4912 | 0.2448 | 0.304 | 0.7936 | -2.904 | 0.003685 | 1 | 0.11391 | 0.0754 | 0.1429 |
| rs11242020 | Imputed | T | ADD | 443 | 0.593 | 0.2016 | 0.3994 | 0.8804 | -2.592 | 0.009541 | 0.1134 | 0.34312 | 0.3089 | 0.369 |
| rs11242021 | Imputed | C | DOM | 443 | 0.5934 | 0.2016 | 0.3997 | 0.881 | -2.589 | 0.009637 | 0.1134 | 0.34312 | 0.3115 | 0.3671 |
| rs11242022 | Imputed | T | DOM | 443 | 0.5934 | 0.2016 | 0.3997 | 0.881 | -2.589 | 0.009637 | 0.1134 | 0.34312 | 0.3115 | 0.3671 |
| rs11242023 | Imputed | T | DOM | 443 | 0.5934 | 0.2016 | 0.3997 | 0.881 | -2.589 | 0.009637 | 0.1134 | 0.34312 | 0.3115 | 0.3671 |
| rs1149349 | Imputed | A | ADD | 434 | 1.154 | 0.221 | 0.7482 | 1.779 | 0.6474 | 0.5174 | 0.4627 | 0.15323 | 0.1508 | 0.1551 |
| rs1149350 | Imputed | A | ADD | 443 | 0.7733 | 0.1679 | 0.5564 | 1.075 | -1.531 | 0.1258 | 0.01047 | 0.21445 | 0.1885 | 0.2341 |
| rs1149350 | Imputed | A | DOM | 443 | 0.8901 | 0.2092 | 0.5906 | 1.341 | -0.5566 | 0.5778 | 0.01047 | 0.21445 | 0.1885 | 0.2341 |

TABLE 16-continued

| | | | | | | | | | | |
|---|---|---|---|---|---|---|---|---|---|---|
| rs11576627 | Imputed | T | ADD | 441 | 1.439 | 0.1975 | 0.977 | 2.119 | 1.842 | 0.06547 | 0.12358 | 0.15 | 0.1036 |
| rs11576627 | Imputed | T | DOM | 441 | 1.57 | 0.2354 | 0.9899 | 2.491 | 1.917 | 0.05525 | 0.12358 | 0.15 | 0.1036 |
| rs11630050 | Imputed | G | GEN | 442 | | | | | 2.296 | 0.3173 | 0.23416 | 0.2539 | 0.2191 |
| rs11630050 | Imputed | G | REC | 442 | 1.888 | 0.4309 | 0.8114 | 4.394 | 1.475 | 0.1402 | 0.23416 | 0.2539 | 0.2191 |
| rs11633024 | Imputed | C | GEN | 442 | | | | | 2.296 | 0.3173 | 1 | 0.2539 | 0.2191 |
| rs11633024 | Imputed | C | REC | 442 | 1.888 | 0.4309 | 0.8114 | 4.394 | 1.475 | 0.1402 | 1 | 0.2539 | 0.2191 |
| rs11636298 | Imputed | G | GEN | 443 | | | | | 2.593 | 0.2734 | 0.5733 | 0.2356 | 0.1964 |
| rs11636298 | Imputed | G | REC | 443 | 1.965 | 0.4472 | 0.8177 | 4.72 | 1.51 | 0.1311 | 0.5733 | 0.2356 | 0.1964 |
| rs11637363 | Imputed | C | GEN | 420 | | | | | 2.573 | 0.2762 | 0.7866 | 0.2527 | 0.2203 |
| rs11637363 | Imputed | C | REC | 420 | 1.982 | 0.4368 | 0.842 | 4.666 | 1.566 | 0.1173 | 0.7866 | 0.2527 | 0.2203 |
| rs11637813 | Imputed | A | GEN | 442 | | | | | 2.296 | 0.3173 | 1 | 0.2539 | 0.2191 |
| rs11637813 | Imputed | A | REC | 442 | 1.888 | 0.4309 | 0.8114 | 4.394 | 1.475 | 0.1402 | 1 | 0.2539 | 0.2191 |
| rs11638043 | Imputed | C | GEN | 420 | | | | | 2.573 | 0.2762 | 0.7866 | 0.2527 | 0.2203 |
| rs11638043 | Imputed | C | REC | 420 | 1.982 | 0.4368 | 0.842 | 4.666 | 1.566 | 0.1173 | 0.7866 | 0.2527 | 0.2203 |
| rs11638115 | Imputed | A | GEN | 439 | | | | | 3.28 | 0.194 | 0.295 | 0.2237 | 0.1807 |
| rs11638115 | Imputed | A | REC | 439 | 2.198 | 0.4614 | 0.8897 | 5.43 | 1.707 | 0.08787 | 0.295 | 0.2237 | 0.1807 |
| rs11638444 | Imputed | A | GEN | 442 | | | | | 2.07 | 0.3552 | 0.4848 | 0.2368 | 0.2004 |
| rs11682946 | Imputed | A | ADD | 86 | 3.591 | 0.6209 | 1.063 | 12.13 | 2.059 | 0.03949 | 1 | 0.15 | 0.0543 |
| rs11682946 | Imputed | A | DOM | 86 | 3.591 | 0.6209 | 1.063 | 12.13 | 2.059 | 0.03949 | 1 | 0.15 | 0.0543 |
| rs11717157 | Imputed | T | ADD | 442 | 1.051 | 0.1481 | 0.786 | 1.405 | 0.3342 | 0.7382 | 0.662 | 0.3246 | 0.3147 |
| rs11717157 | Imputed | T | GEN | 442 | | | | | 0.8899 | 0.6408 | 0.662 | 0.3246 | 0.3147 |
| rs11724055 | Imputed | A | DOM | 443 | 0.5373 | 0.2207 | 0.3486 | 0.828 | −2.816 | 0.004869 | 0.6032 | 0.1283 | 0.1885 |
| rs11743355 | Imputed | C | ADD | 443 | 0.9741 | 0.2886 | 0.5532 | 1.715 | −0.09096 | 0.9275 | 2.36E-05 | 0.0733 | 0.0734 |
| rs11743355 | Imputed | C | DOM | 443 | 1.136 | 0.3415 | 0.5817 | 2.218 | 0.3732 | 0.709 | 2.36E-05 | 0.0733 | 0.0734 |
| rs11746806 | Imputed | T | ADD | 443 | 0.9741 | 0.2886 | 0.5532 | 1.715 | −0.09096 | 0.9275 | 2.36E-05 | 0.0733 | 0.0734 |
| rs11746806 | Imputed | T | DOM | 443 | 1.136 | 0.3415 | 0.5817 | 2.218 | 0.3732 | 0.709 | 2.36E-05 | 0.0733 | 0.0734 |
| rs11746959 | Imputed | T | ADD | 443 | 0.9741 | 0.2886 | 0.5532 | 1.715 | −0.09096 | 0.9275 | 2.36E-05 | 0.0733 | 0.0734 |
| rs11746959 | Imputed | T | DOM | 443 | 1.136 | 0.3415 | 0.5817 | 2.218 | 0.3732 | 0.709 | 2.36E-05 | 0.0733 | 0.0734 |
| rs11749272 | Imputed | T | DOM | 443 | 0.593 | 0.2016 | 0.3994 | 0.8804 | −2.592 | 0.009541 | 0.1134 | 0.3089 | 0.369 |
| rs11839636 | Imputed | C | GEN | 441 | | | | | 0.9349 | 0.6266 | 0.4378 | 0.2989 | 0.3234 |
| rs11839785 | Imputed | C | GEN | 441 | | | | | 0.9349 | 0.6266 | 0.4378 | 0.2989 | 0.3234 |
| rs11853619 | Imputed | C | GEN | 440 | | | | | 2.44 | 0.2953 | 0.5684 | 0.2342 | 0.196 |
| rs11853619 | Imputed | C | REC | 440 | 1.946 | 0.4474 | 0.8098 | 4.677 | 1.488 | 0.1367 | 0.5684 | 0.2342 | 0.196 |
| rs11856780 | Imputed | A | GEN | 440 | | | | | 2.44 | 0.2953 | 0.5684 | 0.2342 | 0.196 |
| rs11856780 | Imputed | A | REC | 440 | 1.946 | 0.4474 | 0.8098 | 4.677 | 1.488 | 0.1367 | 0.5684 | 0.2342 | 0.196 |
| rs11901899 | Imputed | A | DOM | 426 | 1.452 | 0.1995 | 0.9821 | 2.147 | 1.869 | 0.06157 | 0.3322 | 0.3071 | 0.2521 |
| rs11903290 | Imputed | C | REC | 434 | 2.698 | 0.3294 | 1.415 | 5.145 | 3.013 | 0.002589 | 0.7388 | 0.361 | 0.2814 |
| rs11909480 | Imputed | G | ADD | 439 | 0.4305 | 0.3702 | 0.2084 | 0.8894 | −2.277 | 0.02282 | 0.2386 | 0.0263 | 0.0622 |
| rs11909480 | Imputed | G | DOM | 439 | 0.3714 | 0.3963 | 0.1708 | 0.8077 | −2.499 | 0.01246 | 0.2386 | 0.0263 | 0.0622 |
| rs11910289 | Imputed | T | ADD | 440 | 1.815 | 0.2555 | 1.1 | 2.995 | 2.334 | 0.01959 | 0.1085 | 0.1099 | 0.0643 |
| rs11910289 | Imputed | T | DOM | 440 | 1.911 | 0.2846 | 1.094 | 3.339 | 2.276 | 0.02285 | 0.1085 | 0.1099 | 0.0643 |
| rs11920375 | Genotyped | C | GEN | 443 | | | | | 1.788 | 0.4089 | 0.8294 | 0.3351 | 0.3234 |
| rs11926319 | Imputed | G | REC | 440 | 1.007 | 0.269 | 0.5945 | 1.706 | 0.02639 | 0.9789 | 0.4982 | 0.0759 | 0.0774 |
| rs11933744 | Imputed | T | REC | 440 | 0.8701 | 0.3394 | 0.4473 | 1.692 | −0.4099 | 0.6819 | 0.3677 | 0.2804 | 0.3227 |
| rs11934919 | Imputed | C | REC | 441 | 0.8636 | 0.341 | 0.4426 | 1.685 | −0.43 | 0.6672 | 0.4994 | 0.2778 | 0.3194 |
| rs11934957 | Imputed | C | REC | 441 | 0.8636 | 0.341 | 0.4426 | 1.685 | −0.43 | 0.6672 | 0.4994 | 0.2778 | 0.3194 |
| rs11959206 | Imputed | A | ADD | 434 | 1.201 | 0.2381 | 0.7533 | 1.916 | 0.7701 | 0.4412 | 0.923 | 0.4545 | 0.4615 |
| rs12038613 | Imputed | G | REC | 404 | 0.8998 | 0.2554 | 0.5454 | 1.484 | −0.4136 | 0.6791 | 0.9202 | 0.4483 | 0.4457 |
| rs12151417 | Imputed | C | DOM | 442 | 1.517 | 0.199 | 1.027 | 2.241 | 2.095 | 0.03616 | 0.8879 | 0.2435 | 0.1932 |
| rs12153185 | Imputed | T | DOM | 441 | 0.5728 | 0.2023 | 0.3853 | 0.8516 | −2.754 | 0.005893 | 0.07489 | 0.3132 | 0.3785 |
| rs12182651 | Imputed | T | DOM | 441 | 0.9744 | 0.2621 | 0.583 | 1.629 | −0.09893 | 0.9212 | 0.07328 | 0.0895 | 0.0916 |
| rs12235345 | Imputed | C | DOM | 443 | 1.768 | 0.3192 | 0.9457 | 3.305 | 1.785 | 0.07424 | 0.3489 | 0.0707 | 0.0397 |
| rs12324786 | Imputed | T | GEN | 439 | | | | | 3.28 | 0.194 | 0.295 | 0.2237 | 0.1807 |

TABLE 16-continued

| | | | | | | | | | | | |
|---|---|---|---|---|---|---|---|---|---|---|---|
| rs12324786 | Imputed | T | REC | 439 | 2.198 | 0.4614 | 0.8897 | 5.43 | 1.707 | 0.08787 | 0.295 | 0.19932 | 0.2237 | 0.1807 |
| rs12336958 | Imputed | G | DOM | 407 | 0.7989 | 0.209 | 0.5304 | 1.203 | −1.074 | 0.2826 | 0.9166 | 0.38452 | 0.3621 | 0.4013 |
| rs12407412 | Imputed | C | ADD | 441 | 1.439 | 0.1975 | 0.977 | 2.119 | 1.842 | 0.06547 | 0.01289 | 0.12358 | 0.15 | 0.1036 |
| rs12407412 | Imputed | C | DOM | 441 | 1.57 | 0.2354 | 0.9899 | 2.491 | 1.917 | 0.05525 | 0.01289 | 0.12358 | 0.15 | 0.1036 |
| rs12418971 | Imputed | C | GEN | 436 | | | | 8.323 | | 0.01558 | 0.6068 | 0.24771 | 0.2884 | 0.2166 |
| rs12418971 | Imputed | C | REC | 436 | 3.381 | 0.4338 | 1.445 | 7.911 | 2.808 | 0.004979 | 0.6068 | 0.24771 | 0.2884 | 0.2166 |
| rs12241967 | Imputed | T | REC | 443 | 0.6598 | 0.3096 | 0.3596 | 1.211 | −1.343 | 0.1794 | 0.6028 | 0.35214 | 0.3429 | 0.3591 |
| rs12420184 | Imputed | G | DOM | 438 | 1.429 | 0.2168 | 0.9343 | 2.185 | 1.647 | 0.09966 | 1 | 0.14954 | 0.1693 | 0.1345 |
| rs12433968 | Imputed | T | DOM | 419 | 1.059 | 0.1998 | 0.7158 | 1.566 | 0.2862 | 0.7747 | 0.0315 | 0.31623 | 0.3197 | 0.3136 |
| rs12445477 | Imputed | A | DOM | 427 | 0.7231 | 0.2709 | 0.4252 | 1.23 | −1.197 | 0.2315 | 0.3613 | 0.08899 | 0.0788 | 0.0967 |
| rs12447191 | Genotyped | T | ADD | 443 | 0.7641 | 0.1931 | 0.5233 | 1.116 | −1.393 | 0.1636 | 0.8583 | 0.15801 | 0.1387 | 0.1726 |
| rs12447191 | Genotyped | T | DOM | 443 | 0.6902 | 0.216 | 0.452 | 1.054 | −1.716 | 0.08611 | 0.8583 | 0.15801 | 0.1387 | 0.1726 |
| rs12465349 | Imputed | A | REC | 434 | 1.865 | 0.2195 | 1.213 | 2.867 | 2.839 | 0.004525 | 0.8461 | 0.55069 | 0.5775 | 0.5304 |
| rs1247340 | Imputed | C | ADD | 441 | 0.7681 | 0.1723 | 0.548 | 1.077 | −1.531 | 0.1257 | 0.0397 | 0.20522 | 0.1789 | 0.2251 |
| rs1247340 | Imputed | C | DOM | 441 | 0.9041 | 0.2098 | 0.5993 | 1.364 | −0.4802 | 0.6311 | 0.0397 | 0.20522 | 0.1789 | 0.2251 |
| rs1247341 | Imputed | C | ADD | 441 | 0.7805 | 0.1735 | 0.5555 | 1.097 | −1.428 | 0.1532 | 0.05636 | 0.20408 | 0.1806 | 0.222 |
| rs1247341 | Imputed | C | DOM | 441 | 0.919 | 0.2102 | 0.6087 | 1.387 | −0.4021 | 0.6876 | 0.05636 | 0.20408 | 0.1806 | 0.222 |
| rs1247343 | Imputed | C | DOM | 441 | 1.064 | 0.2203 | 0.6907 | 1.638 | 0.2798 | 0.7797 | 0.03783 | 0.1644 | 0.15 | 0.1753 |
| rs12509758 | Imputed | C | ADD | 436 | 1.34 | 0.2022 | 0.9013 | 1.991 | 1.446 | 0.1481 | 0.1442 | 0.20757 | 0.2193 | 0.1988 |
| rs12515472 | Imputed | A | DOM | 443 | 1.913 | 0.2164 | 1.252 | 2.923 | 2.997 | 0.002728 | 0.8546 | 0.1535 | 0.1937 | 0.123 |
| rs12548906 | Imputed | G | ADD | 415 | 1.763 | 0.1813 | 1.236 | 2.516 | 3.128 | 0.00176 | 1 | 0.19639 | 0.2458 | 0.1597 |
| rs12596240 | Imputed | G | DOM | 443 | 0.9009 | 0.205 | 0.6028 | 1.346 | −0.509 | 0.6107 | 0.9223 | 0.41986 | 0.3953 | 0.4385 |
| rs12618781 | Imputed | A | DOM | 440 | 1.082 | 0.2178 | 0.7061 | 1.658 | 0.3618 | 0.7175 | 0.8483 | 0.47045 | 0.4709 | 0.4701 |
| rs12678600 | Imputed | A | ADD | 439 | 0.7992 | 0.198 | 0.5421 | 1.178 | −1.132 | 0.2575 | 1 | 0.31663 | 0.2989 | 0.33 |
| rs12692229 | Imputed | T | ADD | 443 | 1.608 | 0.1488 | 1.202 | 2.153 | 3.194 | 0.001404 | 0.4038 | 0.35102 | 0.4084 | 0.3075 |
| rs12713324 | Imputed | T | DOM | 443 | 1.501 | 0.1987 | 1.017 | 2.215 | 2.043 | 0.04105 | 0.8886 | 0.21558 | 0.2435 | 0.1944 |
| rs12719415 | Imputed | C | ADD | 443 | 0.5934 | 0.2016 | 0.3997 | 0.881 | −2.589 | 0.009637 | 0.1134 | 0.34312 | 0.3115 | 0.3671 |
| rs12820589 | Imputed | G | ADD | 418 | 0.882 | 0.1789 | 0.6212 | 1.252 | −0.7022 | 0.4826 | 1 | 0.19856 | 0.1875 | 0.2073 |
| rs12820589 | Imputed | G | DOM | 418 | 0.926 | 0.2078 | 0.6162 | 1.392 | −0.3697 | 0.7116 | 1 | 0.19856 | 0.1875 | 0.2073 |
| rs12831292 | Imputed | G | ADD | 436 | 0.7739 | 0.1429 | 0.5848 | 1.024 | −1.794 | 0.0728 | 1 | 0.40367 | 0.371 | 0.428 |
| rs12831292 | Imputed | G | DOM | 436 | 0.7047 | 0.2039 | 0.4725 | 1.051 | −1.716 | 0.08609 | 1 | 0.40367 | 0.371 | 0.428 |
| rs13012636 | Imputed | G | REC | 433 | 2.717 | 0.3295 | 1.424 | 5.183 | 3.034 | 0.002417 | 0.739 | 0.3164 | 0.3629 | 0.2814 |
| rs13038146 | Imputed | C | ADD | 443 | 1.389 | 0.1433 | 1.049 | 1.839 | 2.291 | 0.02197 | 0.2479 | 0.34424 | 0.3874 | 0.3115 |
| rs13038146 | Imputed | C | GEN | 443 | | | | | 6.692 | 0.03523 | 0.2479 | 0.34424 | 0.3874 | 0.3115 |
| rs13038146 | Imputed | C | REC | 443 | 2.069 | 0.2898 | 1.172 | 3.65 | 2.508 | 0.01214 | 0.2479 | 0.34424 | 0.3874 | 0.3115 |
| rs13089860 | Imputed | A | DOM | 364 | 0.5987 | 0.2307 | 0.3809 | 0.941 | −2.224 | 0.02617 | 0.02707 | 0.46429 | 0.4325 | 0.49 |
| rs13102419 | Imputed | T | REC | 439 | 1.104 | 0.2389 | 0.6915 | 1.764 | 0.4158 | 0.6775 | 1 | 0.46128 | 0.4684 | 0.4558 |
| rs13194907 | Imputed | A | ADD | 443 | 1.091 | 0.2583 | 0.6574 | 1.81 | 0.3362 | 0.7367 | 0.279 | 0.07336 | 0.0759 | 0.0714 |
| rs13194907 | Imputed | A | DOM | 443 | 1.162 | 0.2804 | 0.6707 | 2.013 | 0.5355 | 0.5923 | 0.279 | 0.07336 | 0.0759 | 0.0714 |
| rs13195745 | Imputed | A | ADD | 443 | 1.091 | 0.2583 | 0.6574 | 1.81 | 0.3362 | 0.7367 | 0.279 | 0.07336 | 0.0759 | 0.0714 |
| rs13195745 | Imputed | A | DOM | 443 | 1.162 | 0.2804 | 0.6707 | 2.013 | 0.5355 | 0.5923 | 0.279 | 0.07336 | 0.0759 | 0.0714 |
| rs13265054 | Imputed | T | DOM | 434 | 0.7541 | 0.1998 | 0.5098 | 1.116 | −1.413 | 0.1577 | 0.8248 | 0.31567 | 0.2941 | 0.332 |
| rs13273002 | Imputed | A | GEN | 443 | | | | | 0.08764 | 0.9571 | 0.8776 | 0.19074 | 0.1859 | 0.1944 |
| rs13282131 | Imputed | C | ADD | 440 | 1.295 | 0.1396 | 0.9848 | 1.702 | 1.85 | 0.06426 | 0.8464 | 0.43864 | 0.4711 | 0.414 |
| rs13282131 | Imputed | C | GEN | 440 | | | | | 6.641 | 0.03614 | 0.8464 | 0.43864 | 0.4711 | 0.414 |
| rs13282131 | Imputed | C | REC | 440 | 1.884 | 0.247 | 1.161 | 3.057 | 2.564 | 0.01034 | 0.8464 | 0.43864 | 0.4711 | 0.414 |
| rs1330052 | Imputed | G | GEN | 443 | | | | | 1.596 | 0.4502 | 1 | 0.34876 | 0.3325 | 0.3611 |
| rs1335721 | Imputed | A | REC | 406 | 0.8982 | 0.2552 | 0.5447 | 1.481 | −0.4207 | 0.674 | 0.9203 | 0.44581 | 0.4486 | 0.4437 |
| rs1336382 | Imputed | T | DOM | 443 | 1.364 | 0.1959 | 0.9291 | 2.003 | 1.584 | 0.1131 | 0.1655 | 0.33409 | 0.3691 | 0.3075 |
| rs1336383 | Imputed | T | DOM | 443 | 1.364 | 0.1959 | 0.9291 | 2.003 | 1.584 | 0.1131 | 0.1655 | 0.33409 | 0.3691 | 0.3075 |
| rs1336407 | Imputed | T | DOM | 442 | 1.347 | 0.1964 | 0.9168 | 1.98 | 1.518 | 0.129 | 0.1663 | 0.33484 | 0.3691 | 0.3088 |
| rs1336409 | Imputed | T | DOM | 442 | 1.347 | 0.1964 | 0.9168 | 1.98 | 1.518 | 0.129 | 0.1663 | 0.33484 | 0.3691 | 0.3088 |
| rs1336596 | Imputed | A | DOM | 440 | 0.9849 | 0.205 | 0.659 | 1.472 | −0.07439 | 0.9407 | 0.4737 | 0.36932 | 0.3763 | 0.364 |

TABLE 16-continued

| | | | | | | | | | | | |
|---|---|---|---|---|---|---|---|---|---|---|---|
| rs13387284 | Imputed | A | DOM | 408 | 1.094 | 0.2214 | 0.7089 | 1.689 | 0.4062 | 0.6846 | 0.2701 | 0.4424 | 0.4454 | 0.4402 |
| rs13401462 | Imputed | C | DOM | 417 | 0.8697 | 0.2292 | 0.555 | 1.363 | -0.609 | 0.5425 | 0.6243 | 0.5024 | 0.5056 | 0.5 |
| rs13409045 | Imputed | T | ADD | 442 | 1.009 | 0.1374 | 0.7712 | 1.321 | 0.06836 | 0.9455 | 0.2878 | 0.43891 | 0.4398 | 0.4382 |
| rs1349284 | Imputed | C | GEN | 443 | | | | | 0.308 | 0.8573 | 0.5114 | 0.31828 | 0.322 | 0.3155 |
| rs1355715 | Imputed | T | ADD | 442 | 0.6617 | 0.3179 | 0.3549 | 1.234 | -1.299 | 0.1939 | 1 | 0.05769 | 0.0471 | 0.0657 |
| rs1357696 | Imputed | A | GEN | 434 | | | | | 2.08 | 0.3535 | 0.9152 | 0.34332 | 0.3503 | 0.3381 |
| rs1357698 | Imputed | A | GEN | 436 | | | | | 1.977 | 0.3722 | 1 | 0.34633 | 0.3537 | 0.3407 |
| rs1357699 | Imputed | T | GEN | 436 | | | | | 1.977 | 0.3722 | 1 | 0.34633 | 0.3537 | 0.3407 |
| rs1363273 | Imputed | C | REC | 421 | 0.9417 | 0.2317 | 0.598 | 1.483 | -0.2592 | 0.7955 | 0.9225 | 0.49169 | 0.4809 | 0.5 |
| rs1373601 | Imputed | A | DOM | 404 | 0.9323 | 0.2122 | 0.6151 | 1.413 | -0.3303 | 0.7412 | 0.3414 | 0.37871 | 0.3882 | 0.3718 |
| rs1375829 | Imputed | C | GEN | 443 | | | | | 0.308 | 0.8573 | 0.5114 | 0.31828 | 0.322 | 0.3155 |
| rs1395748 | Imputed | G | DOM | 441 | 1.231 | 0.195 | 0.8402 | 1.804 | 1.067 | 0.2859 | 0.6571 | 0.30952 | 0.322 | 0.3 |
| rs1414865 | Imputed | T | DOM | 442 | 1.352 | 0.1976 | 0.9177 | 1.991 | 1.525 | 0.1272 | 0.1377 | 0.33937 | 0.3717 | 0.3147 |
| rs1414873 | Imputed | A | DOM | 442 | 1.347 | 0.1964 | 0.9168 | 1.98 | 1.518 | 0.129 | 0.1663 | 0.33484 | 0.3691 | 0.3088 |
| rs1414876 | Imputed | C | DOM | 442 | 1.347 | 0.1964 | 0.9168 | 1.98 | 1.518 | 0.129 | 0.1663 | 0.33484 | 0.3691 | 0.3088 |
| rs1424643 | Imputed | G | ADD | 430 | 1.447 | 0.1648 | 1.048 | 1.999 | 2.244 | 0.02486 | 0.4845 | 0.22209 | 0.2609 | 0.1931 |
| rs1424643 | Imputed | G | DOM | 430 | 1.694 | 0.2023 | 1.14 | 2.518 | 2.606 | 0.009171 | 0.4845 | 0.22209 | 0.2609 | 0.1931 |
| rs1424648 | Imputed | T | DOM | 438 | 1.609 | 0.2007 | 1.085 | 2.384 | 2.368 | 0.01786 | 0.5746 | 0.21804 | 0.2526 | 0.1915 |
| rs1429321 | Imputed | A | DOM | 432 | 1.519 | 0.2006 | 1.025 | 2.251 | 2.084 | 0.03713 | 0.6699 | 0.21644 | 0.246 | 0.1939 |
| rs1429326 | Imputed | T | ADD | 433 | 1.404 | 0.1719 | 1.003 | 1.967 | 1.975 | 0.04831 | 0.6569 | 0.20208 | 0.234 | 0.1776 |
| rs1429326 | Imputed | T | DOM | 433 | 1.574 | 0.2049 | 1.053 | 2.352 | 2.213 | 0.02687 | 0.6569 | 0.20208 | 0.234 | 0.1776 |
| rs1444741 | Imputed | A | DOM | 407 | 0.9777 | 0.2088 | 0.6493 | 1.472 | -0.1082 | 0.9138 | 0.2366 | 0.35627 | 0.3713 | 0.3453 |
| rs1449916 | Imputed | C | DOM | 270 | 0.7246 | 0.2903 | 0.4102 | 1.28 | -1.11 | 0.2671 | 0.464 | 0.52222 | 0.5042 | 0.5362 |
| rs1459523 | Imputed | A | ADD | 442 | 1.051 | 0.1481 | 0.786 | 1.405 | 0.3342 | 0.7382 | 0.662 | 0.319 | 0.3246 | 0.3147 |
| rs1459523 | Imputed | A | GEN | 442 | | | | | 0.8899 | 0.6408 | 0.5142 | 0.319 | 0.3246 | 0.3147 |
| rs1466352 | Imputed | A | GEN | 443 | | | | | 1.33 | 0.5142 | 0.9151 | 0.33409 | 0.3429 | 0.3274 |
| rs1466353 | Imputed | G | GEN | 443 | | | | | 1.33 | 0.5142 | 0.9151 | 0.33409 | 0.3429 | 0.3274 |
| rs1476714 | Imputed | A | DOM | 439 | 0.5924 | 0.2025 | 0.3983 | 0.8811 | -2.585 | 0.009742 | 0.1129 | 0.3451 | 0.3132 | 0.3695 |
| rs1486723 | Imputed | C | REC | 434 | 0.5711 | 0.3144 | 0.3084 | 1.058 | -1.782 | 0.07477 | 0.3533 | 0.36866 | 0.3351 | 0.3936 |
| rs1495375 | Imputed | A | ADD | 421 | 0.7715 | 0.1445 | 0.5812 | 1.024 | -1.795 | 0.07269 | 0.9197 | 0.40855 | 0.373 | 0.4364 |
| rs1495375 | Imputed | A | DOM | 421 | 0.7102 | 0.2081 | 0.4724 | 1.068 | -1.644 | 0.1001 | 0.9197 | 0.40855 | 0.373 | 0.4364 |
| rs1495381 | Imputed | T | GEN | 442 | | | | | 7.762 | 0.02063 | 0.2705 | 0.38575 | 0.4342 | 0.3492 |
| rs1495381 | Imputed | T | REC | 442 | 2.08 | 0.2834 | 1.194 | 3.626 | 2.584 | 0.009753 | 0.084 | 0.38575 | 0.4342 | 0.3492 |
| rs1498061 | Imputed | C | ADD | 200 | 0.6227 | 0.2741 | 0.3639 | 1.066 | -1.728 | 0.084 | 0.4882 | 0.19 | 0.1446 | 0.2222 |
| rs1498992 | Imputed | G | DOM | 428 | 0.7274 | 0.1999 | 0.4916 | 1.076 | -1.592 | 0.1114 | 0.4588 | 0.35047 | 0.3234 | 0.3709 |
| rs1499001 | Imputed | T | DOM | 437 | 0.7573 | 0.1974 | 0.5144 | 1.115 | -1.409 | 0.159 | 0.2889 | 0.28375 | 0.262 | 0.3 |
| rs1512988 | Imputed | A | ADD | 442 | 0.7806 | 0.1427 | 0.5901 | 1.033 | -1.735 | 0.08266 | 0.6908 | 0.3948 | 0.3632 | 0.4187 |
| rs1512988 | Imputed | A | DOM | 442 | 0.7185 | 0.204 | 0.4817 | 1.072 | -1.621 | 0.1051 | 0.6908 | 0.3948 | 0.3632 | 0.4187 |
| rs1512989 | Imputed | T | ADD | 442 | 0.7806 | 0.1427 | 0.5901 | 1.033 | -1.735 | 0.08266 | 0.6908 | 0.3948 | 0.3632 | 0.4187 |
| rs1512989 | Imputed | T | DOM | 442 | 0.7185 | 0.204 | 0.4817 | 1.072 | -1.621 | 0.1051 | 0.6908 | 0.3948 | 0.3632 | 0.4187 |
| rs1512991 | Imputed | T | ADD | 425 | 0.7106 | 0.1399 | 0.5401 | 0.9348 | -2.442 | 0.01462 | 0.3804 | 0.45647 | 0.4071 | 0.4938 |
| rs1512991 | Imputed | T | DOM | 425 | 0.6965 | 0.2131 | 0.4587 | 1.057 | -1.698 | 0.08957 | 0.3804 | 0.45647 | 0.4071 | 0.4938 |
| rs1512991 | Imputed | T | GEN | 425 | | | | | 6.384 | 0.0411 | 0.3804 | 0.45647 | 0.4071 | 0.4938 |
| rs1524303 | Imputed | T | GEN | 436 | | | | | 1.005 | 0.6051 | 0.7421 | 0.32225 | 0.3298 | 0.3165 |
| rs1524306 | Imputed | C | ADD | 441 | 1.05 | 0.1481 | 0.7851 | 1.403 | 0.3265 | 0.744 | 0.6626 | 0.31973 | 0.3246 | 0.316 |
| rs1524306 | Imputed | C | GEN | 441 | | | | | 0.8672 | 0.6482 | 0.6626 | 0.31973 | 0.3246 | 0.316 |
| rs1524310 | Imputed | G | ADD | 438 | 1.063 | 0.1488 | 0.7944 | 1.424 | 0.4133 | 0.6794 | 0.6604 | 0.31735 | 0.3237 | 0.3125 |
| rs1524310 | Imputed | G | GEN | 438 | | | | | 0.7768 | 0.6781 | 0.6604 | 0.31735 | 0.3237 | 0.3125 |
| rs1524321 | Imputed | C | GEN | 441 | | | | | 1.192 | 0.5511 | 1 | 0.33107 | 0.3429 | 0.322 |
| rs1527059 | Imputed | A | DOM | 441 | 0.4524 | 0.2645 | 0.2693 | 0.7598 | -2.999 | 0.002712 | 0.1053 | 0.09977 | 0.0684 | 0.1235 |
| rs152707 | Imputed | A | ADD | 443 | 1.066 | 0.1385 | 0.8128 | 1.399 | 0.4637 | 0.6429 | 0.8451 | 0.41422 | 0.4241 | 0.4067 |
| rs152707 | Imputed | A | GEN | 443 | | | | | 0.2887 | 0.8656 | 0.8451 | 0.41422 | 0.4241 | 0.4067 |
| rs152712 | Genotyped | C | ADD | 443 | 1.066 | 0.1385 | 0.8128 | 1.399 | 0.4637 | 0.6429 | 0.8451 | 0.41422 | 0.4241 | 0.4067 |

TABLE 16-continued

| | | | | | | | | | | | | |
|---|---|---|---|---|---|---|---|---|---|---|---|---|
| rs152712 | Genotyped | C | GEN | 443 | | | | | 0.2887 | 0.8656 | 0.8451 | 0.41422 | 0.4241 | 0.4067 |
| rs1533994 | Imputed | T | GEN | 443 | | | | | 1.33 | 0.5142 | 0.9151 | 0.33409 | 0.3429 | 0.3274 |
| rs1535866 | Imputed | G | DOM | 440 | | | | | 1.697 | 0.08971 | 0.6667 | 0.21023 | 0.2263 | 0.198 |
| rs1563773 | Imputed | T | GEN | 439 | | | | | 1.172 | 0.5564 | 0.9151 | 0.33599 | 0.3439 | 0.33 |
| rs1563774 | Imputed | T | GEN | 439 | | | | | 1.172 | 0.5564 | 0.9151 | 0.33599 | 0.3439 | 0.33 |
| rs1567740 | Imputed | T | ADD | 439 | 0.7805 | 0.1427 | 0.59 | 1.032 | −1.736 | 0.08253 | 0.8422 | 0.39863 | 0.3658 | 0.4237 |
| rs1567740 | Imputed | T | DOM | 439 | 0.7204 | 0.2038 | 0.4831 | 1.074 | −1.609 | 0.1076 | 0.8253 | 0.39863 | 0.3658 | 0.4237 |
| rs1572573 | Imputed | A | DOM | 396 | 1.019 | 0.2128 | 0.6715 | 1.546 | 0.08849 | 0.9295 | 0.00264 | 0.18813 | 0.1879 | 0.1883 |
| rs1577497 | Imputed | C | REC | 408 | 0.899 | 0.2549 | 0.5455 | 1.481 | −0.418 | 0.676 | 0.9204 | 0.44485 | 0.446 | 0.444 |
| rs1581514 | Imputed | T | ADD | 429 | 1.06 | 0.1488 | 0.7919 | 1.419 | 0.3912 | 0.6957 | 0.8269 | 0.32751 | 0.3351 | 0.3217 |
| rs1581514 | Imputed | T | DOM | 429 | | | | | 1.004 | 0.6052 | 0.8269 | 0.32751 | 0.3351 | 0.3217 |
| rs1582321 | Imputed | T | GEN | 443 | 0.9009 | 0.205 | 0.6028 | 1.346 | −0.509 | 0.6107 | 0.9223 | 0.41986 | 0.3953 | 0.4385 |
| rs1582322 | Imputed | A | DOM | 438 | 0.8697 | 0.2066 | 0.5801 | 1.304 | −0.6757 | 0.4992 | 0.7686 | 0.41895 | 0.3947 | 0.4375 |
| rs1582323 | Imputed | A | DOM | 437 | 0.8751 | 0.2067 | 0.5836 | 1.312 | −0.6457 | 0.5185 | 0.6949 | 0.41762 | 0.3947 | 0.4352 |
| rs1592485 | Imputed | C | ADD | 443 | 0.8723 | 0.2093 | 0.5787 | 1.315 | −0.653 | 0.5138 | 0.5 | 0.44131 | 0.4162 | 0.4603 |
| rs1600954 | Imputed | T | ADD | 423 | 1.193 | 0.1389 | 0.909 | 1.567 | 1.273 | 0.203 | 0.6267 | 0.47754 | 0.5027 | 0.458 |
| rs1600954 | Imputed | T | GEN | 423 | | | | | 1.735 | 0.4199 | 0.6267 | 0.47754 | 0.5027 | 0.458 |
| rs16938626 | Imputed | G | DOM | 435 | 0.7689 | 0.1982 | 0.5213 | 1.134 | −1.326 | 0.1849 | 0.3923 | 0.26552 | 0.2487 | 0.2782 |
| rs16964300 | Imputed | G | ADD | 439 | 0.7656 | 0.1898 | 0.5278 | 1.111 | −1.407 | 0.1593 | 0.863 | 0.16515 | 0.1455 | 0.18 |
| rs16964300 | Imputed | G | DOM | 439 | 0.6717 | 0.2145 | 0.4411 | 1.023 | −1.855 | 0.06358 | 0.863 | 0.16515 | 0.1455 | 0.18 |
| rs16986282 | Imputed | G | ADD | 442 | 0.3565 | 0.3985 | 0.1632 | 0.7784 | −2.589 | 0.009634 | 0.2362 | 0.04638 | 0.0262 | 0.0618 |
| rs17007620 | Imputed | G | ADD | 408 | 1.033 | 0.1717 | 0.7377 | 1.446 | 0.1877 | 0.8511 | 1 | 0.22181 | 0.226 | 0.2186 |
| rs17007620 | Imputed | G | DOM | 408 | 1.127 | 0.206 | 0.7523 | 1.687 | 0.5784 | 0.563 | 1 | 0.22181 | 0.226 | 0.2186 |
| rs17014326 | Imputed | G | DOM | 441 | 1.215 | 0.196 | 0.8276 | 1.785 | 0.9949 | 0.3198 | 0.9106 | 0.30499 | 0.3141 | 0.298 |
| rs17047957 | Imputed | C | DOM | 439 | 1.801 | 0.2129 | 1.187 | 2.734 | 2.765 | 0.005699 | 0.6092 | 0.16856 | 0.2063 | 0.14 |
| rs1705261 | Imputed | A | REC | 442 | 2.005 | 0.2767 | 1.166 | 3.449 | 2.514 | 0.01192 | 0.5499 | 0.39367 | 0.4395 | 0.3591 |
| rs17073341 | Imputed | A | ADD | 441 | 2.051 | 0.3685 | 0.9962 | 4.224 | 1.95 | 0.05123 | 0.09324 | 0.03515 | 0.05 | 0.0239 |
| rs17073341 | Imputed | A | DOM | 441 | 2.316 | 0.4002 | 1.057 | 5.074 | 2.098 | 0.03591 | 0.09324 | 0.03515 | 0.05 | 0.0239 |
| rs17138702 | Imputed | G | ADD | 443 | 1.127 | 0.1808 | 0.7906 | 1.606 | 0.6601 | 0.5092 | 0.1045 | 0.15463 | 0.1649 | 0.1468 |
| rs17189710 | Imputed | T | ADD | 430 | 1.382 | 0.1457 | | 1.839 | 2.22 | 0.02639 | 0.3369 | 0.34535 | 0.3865 | 0.3143 |
| rs17189710 | Imputed | T | GEN | 430 | | | | | 6.752 | 0.03418 | 0.3369 | 0.34535 | 0.3865 | 0.3143 |
| rs17189710 | Imputed | T | REC | 430 | 2.127 | 0.2957 | 1.192 | 3.797 | 2.553 | 0.01069 | 0.3369 | 0.34535 | 0.3865 | 0.3143 |
| rs17310176 | Imputed | C | ADD | 443 | 0.6446 | 0.1904 | 0.4438 | 0.9362 | −2.306 | 0.02109 | 0.8641 | 0.16704 | 0.1335 | 0.1925 |
| rs17310176 | Imputed | C | DOM | 443 | 0.6022 | 0.2152 | 0.395 | 0.9182 | −2.357 | 0.01845 | 0.8641 | 0.16704 | 0.1335 | 0.1925 |
| rs17358860 | Imputed | A | DOM | 416 | 0.5513 | 0.2173 | 0.3601 | 0.844 | −2.74 | 0.006139 | 0.3352 | 0.1887 | 0.1547 | 0.2149 |
| rs17370541 | Imputed | T | GEN | 397 | | | | | 0.1403 | 0.9322 | 0.287 | 0.38035 | 0.3844 | 0.3772 |
| rs17370541 | Imputed | T | REC | 397 | 1.119 | 0.3013 | 0.62 | 2.02 | 0.3735 | 0.7088 | 0.287 | 0.38035 | 0.3844 | 0.3772 |
| rs17526574 | Imputed | G | GEN | 443 | | | | | 0.4224 | 0.8096 | 0.3222 | 0.31603 | 0.3063 | 0.3234 |
| rs17530747 | Imputed | T | DOM | 374 | 1.033 | 0.2172 | 0.6751 | 1.582 | 0.1511 | 0.8799 | 0.0203 | 0.3369 | 0.3438 | 0.3318 |
| rs17649114 | Imputed | C | GEN | 440 | 1.776 | 0.2066 | 1.185 | 2.663 | 2.781 | 0.00542 | 0.06 | 0.18864 | 0.2302 | 0.1574 |
| rs17766172 | Imputed | A | REC | 428 | 0.5776 | 0.3128 | 0.3129 | 1.066 | −1.755 | 0.07928 | 0.4542 | 0.34579 | 0.3242 | 0.3618 |
| rs1818885 | Imputed | G | GEN | 443 | | | | | 0.8065 | 0.6682 | 0.7429 | 0.31941 | 0.3246 | 0.3155 |
| rs1832222 | Imputed | G | DOM | 433 | 1.344 | 0.1965 | 0.9144 | 1.975 | 1.504 | 0.1325 | 0.2005 | 0.33521 | 0.3691 | 0.3095 |
| rs1861327 | Imputed | G | DOM | 433 | 0.8914 | 0.2099 | 0.5908 | 1.345 | −0.5476 | 0.584 | 0.8446 | 0.42494 | 0.3989 | 0.4449 |
| rs1868581 | Imputed | G | ADD | 436 | 1.033 | 0.1486 | 0.7722 | 1.383 | 0.2208 | 0.8253 | 0.5814 | 0.31881 | 0.3218 | 0.3165 |
| rs1868581 | Imputed | G | GEN | 436 | | | | | 0.5916 | 0.7439 | 0.5814 | 0.31881 | 0.3218 | 0.3165 |
| rs1874313 | Imputed | A | ADD | 443 | 0.7883 | 0.1424 | 0.5963 | 1.042 | −1.671 | 0.09473 | 0.6922 | 0.39503 | 0.3639 | 0.4187 |
| rs1874313 | Imputed | A | DOM | 443 | 0.7338 | 0.2032 | 0.4927 | 1.093 | −1.523 | 0.1277 | 0.6922 | 0.39503 | 0.3639 | 0.4187 |
| rs1876409 | Imputed | C | DOM | 443 | 1.204 | 0.1943 | 0.8227 | 1.762 | 0.9553 | 0.3394 | 0.8255 | 0.31264 | 0.322 | 0.3056 |
| rs1913201 | Imputed | G | ADD | 432 | 0.7137 | 0.1396 | 0.5429 | 0.9384 | −2.415 | 0.01572 | 0.438 | 0.4537 | 0.4054 | 0.4899 |
| rs1913201 | Imputed | G | GEN | 432 | | | | | −1.667 | 0.09546 | 0.438 | 0.4537 | 0.4054 | 0.4899 |
| rs1913201 | Imputed | G | REC | 432 | 0.7026 | 0.2117 | 0.464 | 1.064 | 6.276 | 0.04338 | 0.438 | 0.4537 | 0.4054 | 0.4899 |
| rs1916922 | Imputed | T | GEN | 435 | | | | | 0.5208 | 0.7707 | 0.6579 | 0.31724 | 0.3218 | 0.3138 |

TABLE 16-continued

| | | | | | | | | | | |
|---|---|---|---|---|---|---|---|---|---|---|
| rs1936871 | Genotyped | G | DOM | 443 | 0.7975 | 0.2097 | 0.5287 | 1.203 | −1.079 | 0.2807 | 0.7727 | 0.44357 | 0.4346 | 0.4504 |
| rs1961157 | Imputed | T | REC | 442 | 1.145 | 0.2401 | 0.7152 | 1.833 | 0.5643 | 0.5725 | 0.5032 | 0.45814 | 0.466 | 0.4522 |
| rs1987179 | Imputed | T | ADD | 417 | 0.617 | 0.1957 | 0.4205 | 0.9055 | −2.467 | 0.01361 | 0.8637 | 0.17266 | 0.1346 | 0.2021 |
| rs1987179 | Imputed | T | DOM | 417 | 0.5176 | 0.2237 | 0.3339 | 0.8024 | −2.944 | 0.00324 | 0.8637 | 0.17266 | 0.1346 | 0.2021 |
| rs1990023 | Imputed | T | DOM | 443 | 0.593 | 0.2016 | 0.3994 | 0.8804 | −2.592 | 0.009541 | 0.1134 | 0.34312 | 0.3089 | 0.369 |
| rs1995025 | Imputed | C | DOM | 433 | 1.717 | 0.216 | 1.124 | 2.621 | 2.501 | 0.01238 | 0.1894 | 0.15012 | 0.1855 | 0.1235 |
| rs2016194 | Imputed | G | DOM | 443 | 0.5934 | 0.2016 | 0.3997 | 0.881 | −2.589 | 0.009637 | 0.1894 | 0.34312 | 0.3115 | 0.3671 |
| rs2023651 | Imputed | T | ADD | 429 | 1.235 | 0.1824 | 0.864 | 1.766 | 1.159 | 0.2466 | 0.08904 | 0.21911 | 0.2391 | 0.2041 |
| rs2024902 | Imputed | A | DOM | 442 | 1.087 | 0.2583 | 0.655 | 1.803 | 0.3216 | 0.7477 | 0.2797 | 0.07353 | 0.0759 | 0.0717 |
| rs2024902 | Imputed | A | ADD | 442 | 1.157 | 0.2804 | 0.6678 | 2.005 | 0.52 | 0.6031 | 0.2797 | 0.07353 | 0.0759 | 0.0717 |
| rs2025107 | Imputed | A | DOM | 442 | 0.982 | 0.2619 | 0.5877 | 1.641 | −0.06944 | 0.9446 | 0.0729 | 0.0905 | 0.0895 | 0.0913 |
| rs2025108 | Imputed | T | DOM | 442 | 0.982 | 0.2619 | 0.5877 | 1.641 | −0.06944 | 0.9446 | 0.0729 | 0.0905 | 0.0895 | 0.0913 |
| rs2031987 | Imputed | T | GEN | 443 | | | | | | 0.8096 | 0.3222 | 0.31603 | 0.3063 | 0.3234 |
| rs2052428 | Imputed | C | DOM | 427 | 0.7089 | 0.2176 | 0.4628 | 1.086 | −1.581 | 0.1138 | 0.2452 | 0.47892 | 0.4622 | 0.4917 |
| rs2053230 | Imputed | C | ADD | 391 | 0.8193 | 0.2084 | 0.5446 | 1.233 | −0.9565 | 0.3388 | 6.29E−06 | 0.19309 | 0.1794 | 0.2036 |
| rs2062448 | Imputed | T | DOM | 442 | 0.913 | 0.2688 | 0.5391 | 1.546 | −0.3387 | 0.7348 | 0.09556 | 0.07692 | 0.0737 | 0.0794 |
| rs2063420 | Imputed | C | REC | 442 | 0.8647 | 0.2574 | 0.5221 | 1.432 | −0.5649 | 0.5721 | 0.2891 | 0.43778 | 0.4342 | 0.4405 |
| rs2063591 | Imputed | C | ADD | 441 | 0.7255 | 0.1363 | 0.5554 | 0.9478 | −2.353 | 0.01861 | 0.2947 | 0.47506 | 0.4293 | 0.51 |
| rs2063591 | Imputed | C | DOM | 441 | 0.6936 | 0.2125 | 0.4573 | 1.052 | −1.722 | 0.08515 | 0.2947 | 0.47506 | 0.4293 | 0.51 |
| rs208026 | Genotyped | A | DOM | 443 | 1.559 | 0.1973 | 1.059 | 2.295 | 2.25 | 0.02446 | 0.4931 | 0.22348 | 0.2539 | 0.2004 |
| rs208029 | Imputed | T | DOM | 422 | 1.924 | 0.2083 | 1.279 | 2.894 | 3.142 | 0.001679 | 1 | 0.20024 | 0.2432 | 0.1674 |
| rs208757 | Imputed | G | DOM | 435 | 1.858 | 0.2057 | 1.241 | 2.78 | 3.011 | 0.002601 | 0.6456 | 0.19425 | 0.2354 | 0.1626 |
| rs2095586 | Imputed | A | DOM | 442 | 1.347 | 0.1964 | 0.9168 | 1.98 | 1.518 | 0.129 | 0.3355 | 0.33145 | 0.3665 | 0.3048 |
| rs2095606 | Imputed | A | DOM | 436 | 0.9481 | 0.2038 | 0.6359 | 1.414 | −0.2614 | 0.7938 | 0.105 | 0.38073 | 0.385 | 0.3775 |
| rs2102374 | Imputed | A | ADD | 437 | 1.135 | 0.1587 | 0.8318 | 1.549 | 0.7991 | 0.4242 | 0.1584 | 0.2849 | 0.2974 | 0.2753 |
| rs2102374 | Imputed | A | DOM | 437 | 1.187 | 0.1949 | 0.8099 | 1.739 | 0.8784 | 0.3797 | 0.1584 | 0.2849 | 0.2974 | 0.2753 |
| rs2108426 | Imputed | C | DOM | 443 | 0.5934 | 0.2016 | 0.3997 | 0.881 | −2.589 | 0.009637 | 0.1134 | 0.34312 | 0.3115 | 0.3671 |
| rs2110664 | Imputed | A | DOM | 399 | 1.47 | 0.2058 | 0.9818 | 2.2 | 1.871 | 0.06136 | 1 | 0.27569 | 0.3052 | 0.2533 |
| rs2132242 | Imputed | A | ADD | 440 | 0.7679 | 0.1423 | 0.5811 | 1.015 | −1.856 | 0.06344 | 1 | 0.40341 | 0.3684 | 0.43 |
| rs2132242 | Imputed | A | DOM | 440 | 0.6978 | 0.2022 | 0.4695 | 1.037 | −1.78 | 0.07505 | 1 | 0.40341 | 0.3684 | 0.43 |
| rs2158958 | Imputed | A | DOM | 443 | 0.5934 | 0.2016 | 0.3997 | 0.881 | −2.589 | 0.009637 | 0.1134 | 0.34312 | 0.3115 | 0.3671 |
| rs2158961 | Imputed | G | DOM | 443 | 0.6399 | 0.1948 | 0.4368 | 0.9373 | −2.293 | 0.02187 | 0.8242 | 0.30813 | 0.2801 | 0.3294 |
| rs2163046 | Imputed | A | DOM | 436 | 1.529 | 0.2 | 1.033 | 2.263 | 2.124 | 0.03363 | 0.8879 | 0.21674 | 0.246 | 0.1943 |
| rs2180286 | Imputed | A | ADD | 443 | 0.587 | 0.2201 | 0.3813 | 0.9037 | −2.42 | 0.01553 | 0.3923 | 0.50564 | 0.4712 | 0.5317 |
| rs2180684 | Imputed | G | DOM | 433 | 1.876 | 0.2393 | 1.174 | 2.999 | 2.629 | 0.00857 | 0.3529 | 0.11778 | 0.1478 | 0.0951 |
| rs2188079 | Imputed | A | ADD | 443 | 1.028 | 0.1399 | 0.7818 | 1.353 | 0.2006 | 0.841 | 0.563 | 0.43905 | 0.445 | 0.4345 |
| rs2188079 | Imputed | A | GEN | 443 | | | | | 1.2 | 0.5489 | 0.1134 | 0.43905 | 0.445 | 0.4345 |
| rs2190598 | Imputed | C | DOM | 443 | 0.5934 | 0.2016 | 0.3997 | 0.881 | −2.589 | 0.009637 | 0.1134 | 0.34312 | 0.3115 | 0.3671 |
| rs2190600 | Imputed | T | DOM | 440 | 0.577 | 0.2025 | 0.388 | 0.8581 | −2.716 | 0.006612 | 0.07522 | 0.34886 | 0.3132 | 0.376 |
| rs2224184 | Genotyped | A | ADD | 443 | 0.587 | 0.2201 | 0.3813 | 0.9037 | −2.42 | 0.01553 | 0.447 | 0.50451 | 0.4712 | 0.5298 |
| rs2247066 | Imputed | T | DOM | 441 | 1.231 | 0.195 | 0.8402 | 1.804 | 1.067 | 0.2859 | 0.6571 | 0.30952 | 0.322 | 0.3 |
| rs2248236 | Imputed | A | ADD | 443 | 0.6625 | 0.1753 | 0.4699 | 0.9342 | −2.348 | 0.01888 | 0.8852 | 0.20655 | 0.1702 | 0.2341 |
| rs2248236 | Imputed | C | DOM | 443 | 0.5404 | 0.2044 | 0.362 | 0.8067 | −3.011 | 0.002602 | 0.8852 | 0.20655 | 0.1702 | 0.2341 |
| rs2265733 | Imputed | C | ADD | 437 | 1.135 | 0.1587 | 0.8318 | 1.549 | 0.7991 | 0.4242 | 0.1584 | 0.2849 | 0.2974 | 0.2753 |
| rs2265733 | Imputed | C | DOM | 437 | 1.187 | 0.1949 | 0.8099 | 1.739 | 0.8784 | 0.3797 | 0.1584 | 0.2849 | 0.2974 | 0.2753 |
| rs2270584 | Imputed | A | ADD | 441 | 0.7517 | 0.1419 | 0.5692 | 0.9927 | −2.011 | 0.04429 | 0.4848 | 0.39342 | 0.3553 | 0.4223 |
| rs2270584 | Imputed | A | DOM | 441 | 0.6747 | 0.2026 | 0.4536 | 1.004 | −1.942 | 0.05211 | 0.4848 | 0.39342 | 0.3553 | 0.4223 |
| rs2270586 | Imputed | A | ADD | 442 | 0.7586 | 0.1416 | 0.5748 | 1.001 | −1.952 | 0.05099 | 0.4864 | 0.39367 | 0.356 | 0.4223 |
| rs2270586 | Imputed | A | DOM | 442 | 0.6883 | 0.2018 | 0.4634 | 1.022 | −1.851 | 0.06423 | 0.4864 | 0.39367 | 0.356 | 0.4223 |
| rs229775 | Imputed | A | REC | 443 | 0.6598 | 0.3096 | 0.3596 | 1.211 | −1.343 | 0.1794 | 0.6028 | 0.35214 | 0.3429 | 0.3591 |
| rs229815 | Imputed | T | REC | 432 | 0.6306 | 0.295 | 0.3557 | 1.124 | −1.563 | 0.1181 | 0.4755 | 0.38194 | 0.3824 | 0.3816 |
| rs229829 | Imputed | C | REC | 413 | 0.5855 | 0.2981 | 0.3264 | 1.05 | −1.795 | 0.07258 | 0.7558 | 0.38741 | 0.3857 | 0.3887 |
| rs229831 | Imputed | A | REC | 441 | 0.6194 | 0.315 | 0.3341 | 1.148 | −1.521 | 0.1283 | 0.466 | 0.35261 | 0.3421 | 0.3606 |

TABLE 16-continued

| | | | | | | | | | | | |
|---|---|---|---|---|---|---|---|---|---|---|---|
| rs2317057 | Imputed | T | ADD | 368 | 0.5936 | 0.1943 | 0.4056 | 0.8687 | -2.685 | 0.007256 | 0.6434 | 0.21467 | 0.1687 | 0.2512 |
| rs2322100 | Genotyped | T | REC | 443 | 2.61 | 0.3935 | 1.207 | 5.644 | 2.438 | 0.01477 | 0.7091 | 0.25734 | 0.2906 | 0.2321 |
| rs2322101 | Imputed | A | REC | 440 | 2.67 | 0.3944 | 1.233 | 5.784 | 2.491 | 0.01275 | 0.7102 | 0.25909 | 0.2937 | 0.2331 |
| rs2327929 | Imputed | G | REC | 441 | 1.411 | 0.2475 | 0.8684 | 2.291 | 1.39 | 0.1645 | 0.4376 | 0.42857 | 0.4476 | 0.414 |
| rs2332844 | Imputed | A | ADD | 282 | 1.301 | 0.2435 | 0.807 | 2.096 | 1.079 | 0.2804 | 0.8232 | 0.8422 | 0.8583 | 0.8302 |
| rs2332844 | Imputed | A | REC | 282 | 1.427 | 0.2711 | 0.8386 | 2.427 | 1.311 | 0.19 | 0.8232 | 0.8422 | 0.8583 | 0.8302 |
| rs2349170 | Imputed | G | DOM | 443 | 1.414 | 0.198 | 0.9594 | 2.085 | 1.751 | 0.07997 | 0.06576 | 0.23702 | 0.2723 | 0.2103 |
| rs2356722 | Imputed | G | DOM | 443 | 1.255 | 0.1956 | 0.8553 | 1.841 | 1.161 | 0.2457 | 0.8223 | 0.30135 | 0.3141 | 0.2917 |
| rs2364956 | Imputed | T | ADD | 415 | 1.168 | 0.1854 | 0.8122 | 1.68 | 0.838 | 0.402 | 0.09486 | 0.15783 | 0.1713 | 0.1477 |
| rs2373793 | Imputed | G | ADD | 435 | 1.56 | 0.1996 | 1.055 | 2.307 | 2.227 | 0.02596 | 1 | 0.14253 | 0.1737 | 0.1184 |
| rs2373793 | Imputed | G | DOM | 435 | 1.599 | 0.2233 | 1.032 | 2.477 | 2.103 | 0.03546 | 1 | 0.14253 | 0.1737 | 0.1184 |
| rs238252 | Imputed | G | ADD | 434 | 1.155 | 0.2029 | 0.7763 | 1.72 | 0.712 | 0.4765 | 1 | 0.13364 | 0.1436 | 0.126 |
| rs238252 | Imputed | G | DOM | 434 | 1.191 | 0.2236 | 0.7681 | 1.846 | 0.7803 | 0.4352 | 0.4634 | 0.13364 | 0.1436 | 0.126 |
| rs2383903 | Imputed | G | DOM | 443 | 0.7568 | 0.1968 | 0.5146 | 1.113 | -1.416 | 0.1569 | 0.1892 | 0.26411 | 0.2461 | 0.2778 |
| rs2387945 | Imputed | G | DOM | 436 | 1.747 | 0.2151 | 1.146 | 2.663 | 2.593 | 0.009513 | 1 | 0.15023 | 0.1862 | 0.123 |
| rs2389863 | Imputed | A | DOM | 432 | 0.5655 | 0.2068 | 0.377 | 0.8481 | -2.756 | 0.005845 | 0.8852 | 0.20602 | 0.172 | 0.2317 |
| rs2389866 | Imputed | C | DOM | 443 | 0.5404 | 0.2044 | 0.362 | 0.8067 | -3.011 | 0.002602 | 0.8852 | 0.20655 | 0.1702 | 0.2341 |
| rs2389869 | Imputed | C | DOM | 443 | 0.5404 | 0.2044 | 0.362 | 0.8067 | -3.011 | 0.002602 | 0.8641 | 0.20655 | 0.1702 | 0.2341 |
| rs2389870 | Genotyped | C | DOM | 443 | 0.5285 | 0.2176 | 0.345 | 0.8096 | -2.931 | 0.003382 | 0.3781 | 0.16704 | 0.1309 | 0.1944 |
| rs2418494 | Imputed | G | ADD | 423 | 0.6959 | 0.1462 | 0.5225 | 0.9268 | -2.48 | 0.01314 | 0.3781 | 0.54137 | 0.4917 | 0.5785 |
| rs2418494 | Imputed | G | GEN | 423 | | | | | 6.342 | 0.04195 | 0.1134 | 0.54137 | 0.4917 | 0.5785 |
| rs2418541 | Imputed | A | DOM | 443 | 0.593 | 0.2016 | 0.3994 | 0.8804 | -2.592 | 0.009541 | 0.1134 | 0.34312 | 0.3089 | 0.369 |
| rs2418542 | Imputed | A | DOM | 443 | 0.593 | 0.2016 | 0.3994 | 0.8804 | -2.592 | 0.009541 | 0.3868 | 0.34312 | 0.3089 | 0.369 |
| rs2423556 | Imputed | C | DOM | 433 | 0.5931 | 0.2244 | 0.382 | 0.9206 | -2.328 | 0.01989 | 0.6021 | 0.51155 | 0.4808 | 0.5339 |
| rs2437688 | Imputed | C | ADD | 443 | 2.041 | 0.2367 | 1.284 | 3.247 | 3.014 | 0.002576 | 0.9116 | 0.10158 | 0.1361 | 0.0754 |
| rs2456809 | Imputed | T | ADD | 438 | 1.173 | 0.1954 | 0.7998 | 1.721 | 0.8168 | 0.414 | 0.1583 | 0.31393 | 0.3218 | 0.308 |
| rs2456811 | Imputed | T | DOM | 412 | 1.146 | 0.1589 | 0.8394 | 1.565 | 0.8588 | 0.3905 | 0.1583 | 0.28555 | 0.2989 | 0.2753 |
| rs2456811 | Imputed | T | DOM | 436 | 1.202 | 0.1953 | 0.8198 | 1.763 | 0.9425 | 0.346 | 0.2817 | 0.28555 | 0.2989 | 0.2753 |
| rs2476976 | Imputed | C | DOM | 442 | 1.391 | 0.1963 | 0.9466 | 2.044 | 1.68 | 0.09288 | 0.1443 | 0.32919 | 0.3639 | 0.3028 |
| rs2484911 | Imputed | A | DOM | 443 | 1.347 | 0.1959 | 0.9174 | 1.977 | 1.52 | 0.1285 | 0.4009 | 0.30474 | 0.3403 | 0.2778 |
| rs2488557 | Imputed | C | DOM | 431 | 0.924 | 0.2286 | 0.5904 | 1.446 | -0.3457 | 0.7296 | 0.0772 | 0.12993 | 0.121 | 0.1367 |
| rs250162 | Imputed | C | ADD | 429 | 0.6714 | 0.1771 | 0.4745 | 0.9501 | -2.249 | 0.02451 | 0.0772 | 0.2296 | 0.1935 | 0.2572 |
| rs250162 | Imputed | C | DOM | 429 | 0.6417 | 0.2018 | 0.4321 | 0.953 | -2.199 | 0.02791 | 0.6189 | 0.2296 | 0.1935 | 0.2572 |
| rs2560708 | Imputed | T | ADD | 436 | 0.7416 | 0.1846 | 0.5164 | 1.065 | -1.619 | 0.1054 | 0.6968 | 0.17546 | 0.1526 | 0.1931 |
| rs2617841 | Imputed | C | DOM | 412 | 0.7326 | 0.2034 | 0.4917 | 1.092 | -1.53 | 0.1261 | 0.8852 | 0.25364 | 0.2386 | 0.2648 |
| rs2622499 | Imputed | G | DOM | 443 | 0.5404 | 0.2044 | 0.362 | 1.092 | -3.011 | 0.002602 | 0.8242 | 0.20655 | 0.1702 | 0.2341 |
| rs264129 | Imputed | G | DOM | 443 | 0.6399 | 0.1948 | 0.4368 | 0.9373 | -2.293 | 0.02187 | 0.2772 | 0.30813 | 0.2801 | 0.3294 |
| rs2642936 | Imputed | T | ADD | 428 | 0.9768 | 0.1833 | 0.682 | 1.399 | -0.1281 | 0.8981 | 0.8255 | 0.19276 | 0.1913 | 0.1939 |
| rs2660633 | Imputed | A | DOM | 443 | 1.204 | 0.1943 | 0.8227 | 1.762 | 0.9553 | 0.3394 | 0.8255 | 0.31264 | 0.322 | 0.3056 |
| rs2660634 | Imputed | A | DOM | 443 | 1.204 | 0.1943 | 0.8227 | 1.762 | 0.9553 | 0.3394 | 0.1584 | 0.31264 | 0.322 | 0.3056 |
| rs2660648 | Imputed | A | ADD | 437 | 1.135 | 0.1587 | 0.8318 | 1.549 | 0.7991 | 0.4242 | 0.1584 | 0.2849 | 0.2974 | 0.2753 |
| rs2660648 | Imputed | A | DOM | 437 | 1.187 | 0.1949 | 0.8099 | 1.739 | 0.8784 | 0.3797 | 0.493 | 0.2849 | 0.2974 | 0.2753 |
| rs2681505 | Imputed | T | ADD | 443 | 0.8499 | 0.1719 | 0.6068 | 1.19 | -0.9458 | 0.3442 | 1 | 0.22235 | 0.2094 | 0.2321 |
| rs277411 | Imputed | G | DOM | 442 | 1.109 | 0.3436 | 0.5658 | 2.175 | 0.3022 | 0.7625 | 0.113 | 0.04412 | 0.0447 | 0.0437 |
| rs2832634 | Imputed | A | ADD | 442 | 1.764 | 0.2529 | 1.075 | 2.896 | 2.245 | 0.02478 | 0.113 | 0.08484 | 0.1099 | 0.0657 |
| rs2832637 | Imputed | T | ADD | 442 | 1.764 | 0.2529 | 1.075 | 2.896 | 2.245 | 0.02478 | 0.9102 | 0.08484 | 0.1099 | 0.0657 |
| rs2843167 | Imputed | A | ADD | 442 | 1.111 | 0.1972 | 0.7547 | 1.635 | 0.5327 | 0.5943 | 0.4631 | 0.29977 | 0.3037 | 0.2968 |
| rs2876227 | Imputed | C | ADD | 442 | 1.389 | 0.1445 | 1.046 | 1.843 | 2.272 | 0.02309 | 0.4631 | 0.34502 | 0.3874 | 0.3127 |
| rs2882097 | Imputed | A | GEN | 442 | | | | | 6.593 | 0.03701 | 0.1655 | 0.33409 | 0.3691 | 0.3075 |
| rs2909862 | Imputed | G | DOM | 443 | 1.364 | 0.1959 | 0.9291 | 2.003 | 1.584 | 0.1131 | 0.08505 | 0.40625 | 0.4167 | 0.3983 |
| rs3001945 | Imputed | T | DOM | 416 | 1.083 | 0.2178 | 0.7067 | 1.659 | 0.3656 | 0.7146 | 0.1899 | 0.14943 | 0.1845 | 0.123 |
| rs3011020 | Imputed | C | DOM | 435 | 1.72 | 0.2156 | 1.127 | 2.625 | 2.515 | 0.0119 | 0.1892 | 0.15023 | 0.1862 | 0.123 |
| | | | DOM | 436 | 1.747 | 0.2151 | 1.146 | 2.663 | 2.593 | 0.009513 | | | | |

TABLE 16-continued

| rsID | Type | Allele | Model | N | | | | | | | | |
|---|---|---|---|---|---|---|---|---|---|---|---|---|
| rs36071725 | Genotyped | C | ADD | 443 | 0.9696 | 0.1509 | 0.7214 | 1.303 | -0.2047 | 0.8378 | 0.31828 | 0.3141 | 0.3214 |
| rs36071725 | Genotyped | C | GEN | 443 | | | | | 0.6419 | 0.7255 | 0.31828 | 0.3141 | 0.3214 |
| rs373983 | Imputed | G | DOM | 414 | 1.954 | 0.2168 | 1.277 | 2.988 | 3.089 | 0.002005 | 0.41063 | 0.4536 | 0.3766 |
| rs3743794 | Imputed | G | DOM | 434 | 0.8871 | 0.2078 | 0.5903 | 1.333 | -0.5765 | 0.5643 | 0.4182 | 0.3963 | 0.435 |
| rs3756154 | Imputed | C | ADD | 416 | 0.6137 | 0.1939 | 0.4196 | 0.8975 | -2.518 | 0.01182 | 0.17668 | 0.1374 | 0.2073 |
| rs3756154 | Imputed | C | DOM | 416 | 0.5162 | 0.2209 | 0.3348 | 0.7959 | -2.993 | 0.00276 | 0.17668 | 0.1374 | 0.2073 |
| rs3775850 | Imputed | A | DOM | 443 | 0.5373 | 0.2207 | 0.3486 | 0.828 | -2.816 | 0.004869 | 0.16253 | 0.1283 | 0.1885 |
| rs3775851 | Imputed | C | DOM | 443 | 0.5373 | 0.2207 | 0.3486 | 0.828 | -2.816 | 0.004869 | 0.16253 | 0.1283 | 0.1885 |
| rs3793044 | Imputed | C | ADD | 443 | 1.091 | 0.2583 | 0.6574 | 1.81 | 0.3362 | 0.7367 | 0.07336 | 0.0759 | 0.0714 |
| rs3793044 | Imputed | C | DOM | 443 | 1.162 | 0.2804 | 0.6707 | 2.013 | 0.5355 | 0.5923 | 0.07336 | 0.0759 | 0.0714 |
| rs3793053 | Imputed | C | DOM | 436 | 0.9919 | 0.2675 | 0.5872 | 1.676 | -0.03035 | 0.9758 | 0.0883 | 0.0878 | 0.0887 |
| rs3796246 | Imputed | G | DOM | 442 | 0.9829 | 0.2682 | 0.5811 | 1.663 | -0.06425 | 0.9488 | 0.07805 | 0.0759 | 0.0797 |
| rs3806003 | Imputed | A | ADD | 443 | 1.091 | 0.2583 | 0.6574 | 1.81 | 0.3362 | 0.7367 | 0.07336 | 0.0759 | 0.0714 |
| rs3806003 | Imputed | A | DOM | 443 | 1.162 | 0.2804 | 0.6707 | 2.013 | 0.5355 | 0.5923 | 0.07336 | 0.0759 | 0.0714 |
| rs3806004 | Imputed | T | DOM | 442 | 0.982 | 0.2619 | 0.5877 | 1.641 | -0.06944 | 0.9446 | 0.0905 | 0.0895 | 0.0913 |
| rs3806010 | Imputed | T | DOM | 442 | 0.982 | 0.2619 | 0.5877 | 1.641 | -0.06944 | 0.9446 | 0.0905 | 0.0895 | 0.0913 |
| rs3806014 | Imputed | A | DOM | 430 | 1.002 | 0.2658 | 0.5954 | 1.688 | 0.00889 | 0.9929 | 0.0907 | 0.0902 | 0.0911 |
| rs3806015 | Imputed | A | DOM | 426 | 0.9945 | 0.2663 | 0.5902 | 1.676 | -0.02059 | 0.9836 | 0.09155 | 0.0907 | 0.0922 |
| rs3806018 | Imputed | A | DOM | 442 | 0.982 | 0.2619 | 0.5877 | 1.641 | -0.06944 | 0.9446 | 0.0905 | 0.0895 | 0.0913 |
| rs3806019 | Imputed | A | DOM | 438 | 0.9676 | 0.2625 | 0.5784 | 1.619 | -0.1255 | 0.9001 | 0.09132 | 0.0899 | 0.0924 |
| rs3806024 | Imputed | T | DOM | 442 | 1.001 | 0.2605 | 0.601 | 1.669 | 0.00521 | 0.9958 | 0.09276 | 0.0942 | 0.0916 |
| rs3915080 | Imputed | A | GEN | 436 | | | | | 1.977 | 0.3722 | 0.34633 | 0.3537 | 0.3407 |
| rs3942254 | Imputed | T | ADD | 420 | 0.7577 | 0.1442 | 0.5712 | 1.005 | -1.925 | 0.05425 | 0.39167 | 0.3539 | 0.4194 |
| rs3942254 | Imputed | T | DOM | 420 | 0.6591 | 0.2081 | 0.4383 | 0.991 | -2.004 | 0.04512 | 0.39167 | 0.3539 | 0.4194 |
| rs3945085 | Imputed | A | DOM | 441 | 1.324 | 0.1969 | 0.9003 | 1.948 | 1.427 | 0.1537 | 0.34014 | 0.3743 | 0.314 |
| rs3976737 | Imputed | G | ADD | 377 | 1.239 | 0.1939 | 0.8469 | 1.811 | 1.103 | 0.27 | 0.16976 | 0.1867 | 0.1575 |
| rs399485 | Imputed | A | DOM | 437 | 1.648 | 0.1968 | 1.12 | 2.423 | 2.538 | 0.01116 | 0.25973 | 0.2921 | 0.2348 |
| rs4029119 | Imputed | G | ADD | 443 | 0.9741 | 0.2886 | 0.5532 | 1.715 | -0.09096 | 0.9275 | 0.07336 | 0.0733 | 0.0734 |
| rs4029119 | Imputed | G | DOM | 443 | 1.136 | 0.3415 | 0.5817 | 2.218 | 0.3732 | 0.709 | 0.07336 | 0.0733 | 0.0734 |
| rs4076201 | Imputed | G | GEN | 420 | | | | | 2.573 | 0.2762 | 0.23452 | 0.2527 | 0.2203 |
| rs4076201 | Imputed | G | REC | 420 | 1.982 | 0.4368 | 0.842 | 4.666 | 1.566 | 0.1173 | 0.23452 | 0.2527 | 0.2203 |
| rs41395945 | Imputed | G | ADD | 441 | 1.822 | 0.2555 | 1.104 | 3.006 | 2.348 | 0.01887 | 0.0839 | 0.1099 | 0.064 |
| rs41395945 | Imputed | G | DOM | 441 | 1.919 | 0.2846 | 1.099 | 3.352 | 2.29 | 0.022 | 0.0839 | 0.1099 | 0.064 |
| rs4146972 | Genotyped | T | DOM | 443 | 1.832 | 0.2123 | 1.208 | 2.777 | 2.851 | 0.004361 | 0.17043 | 0.2094 | 0.1409 |
| rs4238087 | Imputed | G | DOM | 402 | 0.5579 | 0.251 | 0.3411 | 0.9125 | -2.325 | 0.02009 | 0.12562 | 0.1 | 0.1444 |
| rs4251569 | Imputed | T | ADD | 441 | 0.645 | 0.2176 | 0.4211 | 0.9882 | -2.015 | 0.04394 | 0.12018 | 0.0942 | 0.14 |
| rs4251569 | Imputed | T | DOM | 441 | 0.5571 | 0.243 | 0.346 | 0.897 | -2.407 | 0.01607 | 0.12018 | 0.0942 | 0.14 |
| rs4273613 | Imputed | T | ADD | 443 | 0.9741 | 0.2886 | 0.5532 | 1.715 | -0.09096 | 0.9275 | 0.07336 | 0.0733 | 0.0734 |
| rs4273613 | Imputed | T | DOM | 443 | 1.136 | 0.3415 | 0.5817 | 2.218 | 0.3732 | 0.709 | 0.07336 | 0.0733 | 0.0734 |
| rs4291049 | Imputed | T | REC | 432 | 1.16 | 0.2386 | 0.727 | 1.852 | 0.6237 | 0.5328 | 0.46065 | 0.4565 | 0.4637 |
| rs4315598 | Imputed | T | ADD | 443 | 1.389 | 0.1433 | 1.049 | 1.839 | 2.291 | 0.02197 | 0.34424 | 0.3874 | 0.3115 |
| rs4315598 | Imputed | T | GEN | 443 | | | | | 6.692 | 0.03523 | 0.34424 | 0.3874 | 0.3115 |
| rs4315598 | Imputed | T | REC | 420 | 2.069 | 0.2898 | 1.172 | 3.65 | 2.508 | 0.01214 | 0.4424 | 0.4454 | 0.4402 |
| rs4321395 | Imputed | A | DOM | 408 | 1.094 | 0.2214 | 0.7089 | 1.689 | 0.4062 | 0.6846 | 0.22573 | 0.2565 | 0.2024 |
| rs4321596 | Genotyped | T | REC | 443 | 2.583 | 0.4532 | 1.063 | 6.278 | 2.094 | 0.03627 | 0.48646 | 0.5026 | 0.4742 |
| rs4324417 | Imputed | T | DOM | 443 | 1.061 | 0.217 | 0.6932 | 1.623 | 0.2716 | 0.7859 | 0.44018 | 0.4188 | 0.4563 |
| rs4328619 | Genotyped | G | DOM | 443 | 0.5613 | 0.2195 | 0.365 | 0.8631 | -2.631 | 0.008525 | 0.43295 | 0.4339 | 0.4323 |
| rs4338909 | Imputed | T | ADD | 440 | 0.998 | 0.1323 | 0.7701 | 1.293 | -0.01507 | 0.988 | 0.33523 | 0.3684 | 0.31 |
| rs4370878 | Imputed | G | DOM | 440 | 1.312 | 0.1971 | 0.8916 | 1.931 | 1.378 | 0.1682 | 0.42099 | 0.4267 | 0.4167 |
| rs4379434 | Genotyped | T | DOM | 443 | 0.9929 | 0.2031 | 0.6669 | 1.478 | -0.03512 | 0.972 | 0.42099 | 0.4267 | 0.4167 |
| rs4416407 | Imputed | T | DOM | 437 | 1.387 | 0.2325 | 0.8796 | 2.188 | 1.408 | 0.1591 | 0.55149 | 0.5824 | 0.5281 |
| rs4417899 | Imputed | C | REC | 437 | 0.7208 | 0.2325 | 0.457 | 1.137 | -1.408 | 0.1591 | 0.44851 | 0.4176 | 0.4719 |
| rs4442732 | Imputed | A | ADD | 335 | 0.9155 | 0.1782 | 0.6456 | 1.298 | -0.4952 | 0.6205 | 0.3403 | 0.3333 | 0.3452 |

TABLE 16-continued

| | | | | | | | | | | |
|---|---|---|---|---|---|---|---|---|---|---|
| rs4444612 | Imputed | G | ADD | 443 | 1.389 | 0.1433 | 1.049 | 1.839 | 2.291 | 0.02197 | 0.34424 | 0.3874 | 0.3115 |
| rs4444612 | Imputed | G | GEN | 443 | | | | | 6.692 | 0.03523 | 0.34424 | 0.3874 | 0.3115 |
| rs4444612 | Imputed | G | REC | 443 | 2.069 | 0.2898 | 1.172 | 3.65 | 2.508 | 0.01214 | 0.34424 | 0.3874 | 0.3115 |
| rs4450660 | Imputed | C | DOM | 438 | 1.275 | 0.1965 | 0.8675 | 1.874 | 1.236 | 0.2163 | 0.25457 | 0.2632 | 0.248 |
| rs4509702 | Imputed | C | DOM | 440 | 1.312 | 0.1971 | 0.8916 | 1.931 | 1.378 | 0.1682 | 0.33523 | 0.3684 | 0.31 |
| rs4526920 | Imputed | G | GEN | 443 | | | | | 0.4224 | 0.8096 | 0.31603 | 0.3063 | 0.3234 |
| rs4533145 | Imputed | T | DOM | 441 | 1.764 | 0.2281 | 1.128 | 2.759 | 2.489 | 0.0128 | 0.12358 | 0.1534 | 0.1012 |
| rs4557006 | Imputed | A | DOM | 401 | 1.096 | 0.2227 | 0.7085 | 1.696 | 0.4124 | 0.6801 | 0.44389 | 0.4454 | 0.4427 |
| rs4570530 | Imputed | C | DOM | 440 | 1.312 | 0.1971 | 0.8916 | 1.931 | 1.378 | 0.1682 | 0.33523 | 0.3684 | 0.31 |
| rs4615971 | Imputed | C | DOM | 440 | 1.347 | 0.1965 | 0.9164 | 1.98 | 1.516 | 0.1296 | 0.33182 | 0.3658 | 0.306 |
| rs4628119 | Imputed | A | DOM | 442 | 1.055 | 0.1992 | 0.7139 | 1.559 | 0.268 | 0.7887 | 0.22624 | 0.2251 | 0.2271 |
| rs4664443 | Imputed | G | ADD | 442 | 1.009 | 0.1374 | 0.7712 | 1.321 | 0.06836 | 0.9455 | 0.43891 | 0.4398 | 0.4382 |
| rs4688259 | Imputed | T | DOM | 438 | 1.386 | 0.2325 | 0.8791 | 2.187 | 1.405 | 0.1599 | 0.55137 | 0.5824 | 0.528 |
| rs4688632 | Imputed | G | REC | 429 | 0.6822 | 0.2335 | 0.4316 | 1.078 | -1.638 | 0.1014 | 0.45338 | 0.4189 | 0.4795 |
| rs4695284 | Imputed | A | ADD | 194 | 1.444 | 0.3862 | 0.6775 | 3.079 | 0.9518 | 0.3412 | 0.08763 | 0.1053 | 0.0763 |
| rs4700302 | Imputed | A | ADD | 399 | 1.136 | 0.2485 | 0.6982 | 1.85 | 0.5147 | 0.6067 | 0.09398 | 0.1012 | 0.0885 |
| rs4702720 | Imputed | A | ADD | 359 | 0.757 | 0.1808 | 0.5311 | 1.079 | -1.54 | 0.1236 | 0.24652 | 0.2194 | 0.2672 |
| rs4702720 | Imputed | A | DOM | 359 | 0.6462 | 0.2205 | 0.4194 | 0.9956 | -1.98 | 0.04769 | 0.24652 | 0.2194 | 0.2672 |
| rs4711091 | Genotyped | G | GEN | 443 | | | | | 1.334 | 0.5133 | 0.47743 | 0.4607 | 0.4901 |
| rs4714484 | Imputed | A | ADD | 439 | 0.8396 | 0.1992 | 0.5682 | 1.241 | -0.8775 | 0.3802 | 0.15718 | 0.1455 | 0.166 |
| rs4736802 | Imputed | G | DOM | 442 | 0.9844 | 0.2032 | 0.661 | 1.466 | -0.07725 | 0.9384 | 0.42081 | 0.4263 | 0.4167 |
| rs4760785 | Imputed | A | ADD | 432 | 0.7137 | 0.1396 | 0.5429 | 0.9384 | -2.415 | 0.01572 | 0.4537 | 0.4054 | 0.4899 |
| rs4760785 | Imputed | A | DOM | 432 | 0.7026 | 0.2117 | 0.464 | 1.064 | -1.667 | 0.09546 | 0.4537 | 0.4054 | 0.4899 |
| rs4760785 | Imputed | A | GEN | 432 | | | | | 6.276 | 0.04338 | 0.4537 | 0.4054 | 0.4899 |
| rs4760894 | Imputed | T | ADD | 432 | 0.7137 | 0.1396 | 0.5429 | 0.9384 | -2.415 | 0.01572 | 0.4537 | 0.4054 | 0.4899 |
| rs4760894 | Imputed | T | DOM | 432 | 0.7026 | 0.2117 | 0.464 | 1.064 | -1.667 | 0.09546 | 0.4537 | 0.4054 | 0.4899 |
| rs4760894 | Imputed | T | GEN | 432 | | | | | 6.276 | 0.04338 | 0.4537 | 0.4054 | 0.4899 |
| rs4760895 | Imputed | A | ADD | 432 | 0.7137 | 0.1396 | 0.5429 | 0.9384 | -2.415 | 0.01572 | 0.4537 | 0.4054 | 0.4899 |
| rs4760895 | Imputed | A | DOM | 432 | 0.7026 | 0.2117 | 0.464 | 1.064 | -1.667 | 0.09546 | 0.4537 | 0.4054 | 0.4899 |
| rs4760895 | Imputed | A | GEN | 432 | | | | | 6.276 | 0.04338 | 0.4537 | 0.4054 | 0.4899 |
| rs4764738 | Imputed | A | ADD | 430 | 0.9549 | 0.142 | 0.723 | 1.261 | -0.3248 | 0.7454 | 0.53488 | 0.5294 | 0.5391 |
| rs4764738 | Imputed | A | GEN | 430 | | | | | 0.6545 | 0.7209 | 0.53488 | 0.5294 | 0.5391 |
| rs4764974 | Imputed | T | ADD | 431 | 0.9019 | 0.1389 | 0.6869 | 1.184 | -0.7436 | 0.4571 | 0.5058 | 0.4892 | 0.5183 |
| rs4764974 | Imputed | T | GEN | 431 | | | | | 0.568 | 0.7528 | 0.5058 | 0.4892 | 0.5183 |
| rs4798366 | Imputed | G | REC | 429 | 2.754 | 0.3596 | 1.361 | 5.574 | 2.817 | 0.004844 | 0.30186 | 0.3289 | 0.281 |
| rs483159 | Imputed | T | DOM | 386 | 1.953 | 0.219 | 1.271 | 2.999 | 3.056 | 0.002245 | 0.18264 | 0.2256 | 0.1509 |
| rs4836502 | Imputed | T | DOM | 443 | 0.5934 | 0.2016 | 0.3997 | 0.881 | -2.589 | 0.009637 | 0.34312 | 0.3115 | 0.3671 |
| rs4836507 | Imputed | C | ADD | 442 | 0.5803 | 0.2019 | 0.3906 | 0.862 | -2.696 | 0.007028 | 0.34955 | 0.3141 | 0.3765 |
| rs4836744 | Imputed | A | ADD | 443 | 0.7176 | 0.155 | 0.5296 | 0.9724 | -2.141 | 0.03229 | 0.30587 | 0.267 | 0.3353 |
| rs4836744 | Imputed | A | DOM | 443 | 0.6515 | 0.1952 | 0.4444 | 0.9552 | -2.195 | 0.02818 | 0.30587 | 0.267 | 0.3353 |
| rs4848944 | Genotyped | C | REC | 443 | 0.7027 | 0.2417 | 0.4375 | 1.128 | -1.46 | 0.1443 | 0.46501 | 0.4162 | 0.502 |
| rs4851529 | Imputed | A | DOM | 442 | 0.6342 | 0.203 | 0.426 | 0.944 | -2.244 | 0.02485 | 0.42081 | 0.3868 | 0.4464 |
| rs4851531 | Imputed | T | DOM | 442 | 0.6071 | 0.2055 | 0.4058 | 0.9082 | -2.428 | 0.01517 | 0.44231 | 0.4005 | 0.4741 |
| rs4858046 | Genotyped | T | GEN | 443 | | | | | 1.33 | 0.5142 | 0.33409 | 0.3429 | 0.3274 |
| rs4878214 | Imputed | A | ADD | 261 | 0.7554 | 0.1893 | 0.5212 | 1.095 | -1.481 | 0.1385 | 0.3046 | 0.2672 | 0.3345 |
| rs4880803 | Imputed | A | ADD | 439 | 0.6594 | 0.1519 | 0.4896 | 0.888 | -2.742 | 0.006112 | 0.31093 | 0.2605 | 0.3494 |
| rs489441 | Imputed | G | DOM | 409 | 1.224 | 0.1644 | 0.8866 | 1.689 | 1.228 | 0.2195 | 0.26773 | 0.2874 | 0.2532 |
| rs489441 | Imputed | G | DOM | 409 | 1.384 | 0.2043 | 0.9276 | 2.066 | 1.592 | 0.1114 | 0.26773 | 0.2874 | 0.2532 |
| rs4896568 | Imputed | T | DOM | 410 | 1.056 | 0.2054 | 0.7057 | 1.579 | 0.2631 | 0.7925 | 0.23415 | 0.233 | 0.235 |
| rs4938851 | Imputed | T | DOM | 443 | 1.781 | 0.2035 | 1.195 | 2.654 | 2.835 | 0.004584 | 0.19752 | 0.2408 | 0.1647 |
| rs4964416 | Imputed | C | DOM | 443 | 0.6905 | 0.2178 | 0.4506 | 1.058 | -1.701 | 0.08902 | 0.49323 | 0.4817 | 0.502 |
| rs5756669 | Imputed | C | DOM | 443 | 1.061 | 0.217 | 0.6932 | 1.623 | 0.2716 | 0.7859 | 0.48646 | 0.5026 | 0.4742 |
| rs6033138 | Imputed | C | ADD | 443 | 1.389 | 0.1433 | 1.049 | 1.839 | 2.291 | 0.02197 | 0.34424 | 0.3874 | 0.3115 |

TABLE 16-continued

| | | | | | | | | | | | |
|---|---|---|---|---|---|---|---|---|---|---|---|
| rs6033138 | Imputed | C | GEN | 443 | 2.069 | 0.2898 | 1.172 | 3.65 | 6.692 | 0.03523 | 0.2479 | 0.34424 | 0.3874 | 0.3115 |
| rs6033138 | Imputed | C | REC | 443 | 1.429 | 0.1436 | 1.079 | 1.894 | 2.508 | 0.01214 | 0.2479 | 0.34424 | 0.3874 | 0.3115 |
| rs6040619 | Imputed | C | ADD | 439 | | | | | 2.487 | 0.01287 | 0.3441 | 0.34852 | 0.3963 | 0.3127 |
| rs6040619 | Imputed | C | GEN | 439 | 2.094 | 0.2899 | 1.186 | 3.695 | 7.276 | 0.02631 | 0.3441 | 0.34852 | 0.3963 | 0.3127 |
| rs6040619 | Imputed | C | REC | 439 | 1.414 | 0.1431 | 1.068 | 1.871 | 2.549 | 0.01081 | 0.3441 | 0.34852 | 0.3963 | 0.3127 |
| rs6040625 | Imputed | T | ADD | 442 | | | | | 2.419 | 0.01557 | 0.3449 | 0.34729 | 0.3927 | 0.3127 |
| rs6040625 | Imputed | T | GEN | 442 | 2.067 | 0.2898 | 1.171 | 3.646 | 6.967 | 0.0307 | 0.3449 | 0.34729 | 0.3927 | 0.3127 |
| rs6040625 | Imputed | T | REC | 442 | 1.401 | 0.1436 | 1.058 | 1.857 | 2.505 | 0.01224 | 0.3449 | 0.34729 | 0.3927 | 0.3127 |
| rs6040630 | Imputed | A | ADD | 441 | | | | | 2.349 | 0.01881 | 0.2464 | 0.34467 | 0.3895 | 0.3108 |
| rs6040630 | Imputed | A | GEN | 441 | 2.062 | 0.2897 | 1.168 | 3.637 | 6.767 | 0.03392 | 0.2464 | 0.34467 | 0.3895 | 0.3108 |
| rs6040630 | Imputed | A | REC | 441 | 1.391 | 0.1433 | 1.05 | 1.842 | 2.497 | 0.01252 | 0.2464 | 0.34467 | 0.3895 | 0.3108 |
| rs6040633 | Imputed | A | ADD | 442 | | | | | 2.302 | 0.02133 | 0.2489 | 0.34502 | 0.3895 | 0.3115 |
| rs6040633 | Imputed | A | GEN | 442 | 2.063 | 0.2898 | 1.169 | 3.641 | 6.683 | 0.03539 | 0.2489 | 0.34502 | 0.3895 | 0.3115 |
| rs6040633 | Imputed | A | REC | 442 | 1.404 | 0.1433 | 1.06 | 1.859 | 2.5 | 0.01242 | 0.2489 | 0.34502 | 0.3895 | 0.3115 |
| rs6040634 | Imputed | T | ADD | 441 | | | | | 2.368 | 0.01791 | 0.295 | 0.34694 | 0.3921 | 0.3127 |
| rs6040634 | Imputed | T | GEN | 441 | 2.069 | 0.2898 | 1.173 | 3.652 | 6.855 | 0.03246 | 0.295 | 0.34694 | 0.3921 | 0.3127 |
| rs6040634 | Imputed | T | REC | 441 | 1.371 | 0.1435 | 1.034 | 1.816 | 2.509 | 0.0121 | 0.295 | 0.34694 | 0.3921 | 0.3127 |
| rs6040636 | Imputed | T | ADD | 443 | | | | | 2.196 | 0.0281 | 0.2458 | 0.34312 | 0.3848 | 0.3115 |
| rs6040636 | Imputed | T | GEN | 443 | 2.069 | 0.2898 | 1.172 | 3.65 | 6.529 | 0.03821 | 0.2458 | 0.34312 | 0.3848 | 0.3115 |
| rs6040636 | Imputed | T | REC | 443 | 1.389 | 0.1433 | 1.049 | 1.839 | 2.508 | 0.01214 | 0.2458 | 0.34312 | 0.3848 | 0.3115 |
| rs6040638 | Imputed | C | ADD | 443 | | | | | 2.291 | 0.02197 | 0.2479 | 0.34424 | 0.3874 | 0.3115 |
| rs6040638 | Imputed | C | GEN | 443 | 2.069 | 0.2898 | 1.172 | 3.65 | 6.692 | 0.03523 | 0.2479 | 0.34424 | 0.3874 | 0.3115 |
| rs6040638 | Imputed | C | REC | 443 | 1.389 | 0.1433 | 1.049 | 1.839 | 2.508 | 0.01214 | 0.2479 | 0.34424 | 0.3874 | 0.3115 |
| rs6040644 | Imputed | A | ADD | 443 | | | | | 2.291 | 0.02197 | 0.2479 | 0.34424 | 0.3874 | 0.3115 |
| rs6040644 | Imputed | A | GEN | 443 | 2.069 | 0.2898 | 1.172 | 3.65 | 6.692 | 0.03523 | 0.2479 | 0.34424 | 0.3874 | 0.3115 |
| rs6040644 | Imputed | A | REC | 443 | 1.422 | 0.1447 | 1.071 | 1.888 | 2.432 | 0.01502 | 0.3997 | 0.34424 | 0.3874 | 0.3115 |
| rs6040667 | Imputed | T | GEN | 424 | | | | | 7.201 | 0.02731 | 0.3997 | 0.35731 | 0.4038 | 0.3223 |
| rs6040667 | Imputed | T | REC | 424 | 2.108 | 0.2894 | 1.195 | 3.717 | 2.576 | 0.009982 | 0.3997 | 0.35731 | 0.4038 | 0.3223 |
| rs6040668 | Imputed | C | ADD | 440 | | | | | 2.314 | 0.02064 | 0.5278 | 0.34659 | 0.3895 | 0.314 |
| rs6040668 | Imputed | C | GEN | 440 | 1.398 | 0.1448 | 1.053 | 1.857 | 2.796 | 0.03345 | 0.5278 | 0.34659 | 0.3895 | 0.314 |
| rs6040668 | Imputed | C | REC | 440 | 2.097 | 0.2944 | 1.178 | 3.735 | 2.516 | 0.01186 | 0.5278 | 0.34659 | 0.3895 | 0.314 |
| rs6043066 | Genotyped | G | DOM | 443 | 1.485 | 0.2038 | 0.9963 | 2.215 | 1.942 | 0.05215 | 0.6163 | 0.25282 | 0.2749 | 0.2361 |
| rs6048146 | Imputed | G | DOM | 443 | 2.548 | 0.4417 | 1.072 | 6.055 | 2.117 | 0.03423 | 0.128 | 0.03837 | 0.0497 | 0.0298 |
| rs6082725 | Genotyped | T | DOM | 443 | 2.548 | 0.4417 | 1.072 | 6.055 | 2.117 | 0.03423 | 0.128 | 0.03837 | 0.0497 | 0.0298 |
| rs6131206 | Imputed | C | ADD | 424 | 1.493 | 0.1554 | 1.101 | 2.025 | 2.581 | 0.009855 | 0.2791 | 0.28066 | 0.3288 | 0.2438 |
| rs6131208 | Imputed | T | ADD | 440 | 1.387 | 0.1445 | 1.045 | 1.841 | 2.263 | 0.02364 | 0.2909 | 0.34091 | 0.3836 | 0.3088 |
| rs6131208 | Imputed | T | GEN | 440 | | | | | 6.748 | 0.03426 | 0.2909 | 0.34091 | 0.3836 | 0.3088 |
| rs6131208 | Imputed | T | REC | 440 | 2.109 | 0.2945 | 1.184 | 3.756 | 2.534 | 0.01129 | 0.2909 | 0.34091 | 0.3836 | 0.3088 |
| rs6134243 | Imputed | C | ADD | 443 | 1.389 | 0.1433 | 1.049 | 1.839 | 2.291 | 0.02197 | 0.2479 | 0.34424 | 0.3874 | 0.3115 |
| rs6134243 | Imputed | C | GEN | 443 | | | | | 6.692 | 0.03523 | 0.2479 | 0.34424 | 0.3874 | 0.3115 |
| rs6134243 | Imputed | C | REC | 443 | 2.069 | 0.2898 | 1.172 | 3.65 | 2.508 | 0.01214 | 0.2479 | 0.34424 | 0.3874 | 0.3115 |
| rs6136020 | Imputed | A | DOM | 441 | 1.061 | 0.2134 | 0.6982 | 1.612 | 0.2765 | 0.7822 | 0.1646 | 0.1644 | 0.1702 | 0.16 |
| rs613799 | Imputed | C | DOM | 420 | 1.391 | 0.2013 | 0.9378 | 2.065 | 1.641 | 0.1008 | 0.1798 | 0.32262 | 0.3591 | 0.295 |
| rs644041 | Imputed | G | ADD | 402 | 1.202 | 0.1659 | 0.8685 | 1.664 | 1.111 | 0.2667 | 0.6136 | 0.27114 | 0.2895 | 0.2576 |
| rs644041 | Imputed | G | DOM | 402 | 1.351 | 0.2068 | 0.9007 | 2.026 | 1.454 | 0.1459 | 0.6136 | 0.27114 | 0.2895 | 0.2576 |
| rs647645 | Imputed | C | ADD | 441 | 0.9195 | 0.1447 | 0.6925 | 1.221 | −0.5801 | 0.5619 | 0.6983 | 0.43537 | 0.4237 | 0.4442 |
| rs647645 | Imputed | C | DOM | 441 | 1.143 | 0.2499 | 0.7005 | 1.866 | 2.764 | 0.2511 | 0.6983 | 0.43537 | 0.4237 | 0.4442 |
| rs647645 | Imputed | C | GEN | 441 | | | | | 0.5357 | 0.5922 | 0.6983 | 0.43537 | 0.4237 | 0.4442 |
| rs6495554 | Imputed | C | GEN | 443 | | | | | 2.593 | 0.2734 | 0.5733 | 0.21332 | 0.2356 | 0.1964 |
| rs6495554 | Imputed | C | REC | 443 | 1.965 | 0.4472 | 0.8177 | 4.72 | 1.51 | 0.1311 | 0.5733 | 0.21332 | 0.2356 | 0.1964 |
| rs6495555 | Imputed | C | GEN | 443 | | | | | 2.593 | 0.2734 | 0.5733 | 0.21332 | 0.2356 | 0.1964 |
| rs6495555 | Imputed | C | REC | 443 | 1.965 | 0.4472 | 0.8177 | 4.72 | 1.51 | 0.1311 | 0.5733 | 0.21332 | 0.2356 | 0.1964 |

TABLE 16-continued

| SNP | Status | Allele | Model | N | c1 | c2 | c3 | c4 | c5 | c6 | c7 | c8 |
|---|---|---|---|---|---|---|---|---|---|---|---|---|
| rs6544728 | Imputed | T | DOM | 439 | 1.333 | 0.197 | 0.9058 | 1.961 | 1.458 | 0.7087 | 0.25854 | 0.2686 | 0.251 |
| rs6650705 | Imputed | C | ADD | 443 | 1.048 | 0.1481 | 0.7837 | 1.401 | 0.3148 | 0.7429 | 0.31941 | 0.3246 | 0.3155 |
| rs6650705 | Imputed | C | GEN | 443 | | | | | 0.8065 | 0.7429 | 0.31941 | 0.3246 | 0.3155 |
| rs6650707 | Imputed | T | GEN | 442 | | | | | 0.6682 | 0.9152 | 0.33484 | 0.3429 | 0.3287 |
| rs658108 | Imputed | A | DOM | 443 | 1.347 | 0.1959 | 0.9174 | 1.977 | 1.263 | 0.1443 | 0.30474 | 0.3403 | 0.2778 |
| rs6693441 | Imputed | A | DOM | 412 | 1.402 | 0.2318 | 0.89 | 2.208 | 1.52 | 0.1752 | 0.12621 | 0.1397 | 0.1159 |
| rs668732 | Imputed | A | DOM | 442 | 0.9925 | 0.2194 | 0.6457 | 1.526 | 1.457 | 0.2955 | 0.47738 | 0.4895 | 0.4681 |
| rs671041 | Imputed | A | DOM | 443 | 1.347 | 0.1959 | 0.9174 | 1.977 | 1.52 | 0.1443 | 0.30474 | 0.3403 | 0.2778 |
| rs671041 | Imputed | A | ADD | 434 | 1.378 | 0.1747 | 0.9785 | 1.941 | 1.836 | 0.06643 | 0.19355 | 0.2222 | 0.1714 |
| rs6719700 | Imputed | A | DOM | 434 | 1.551 | 0.207 | 1.034 | 2.327 | 2.121 | 0.03391 | 0.19355 | 0.2222 | 0.1714 |
| rs6719700 | Imputed | T | DOM | 441 | 0.5987 | 0.1322 | 0.399 | 0.8983 | -2.478 | 0.01322 | 0.44671 | 0.4058 | 0.478 |
| rs6722640 | Imputed | T | ADD | 434 | 1.239 | 0.1411 | 0.9401 | 1.634 | 1.522 | 0.2486 | 0.5023 | 0.5294 | 0.4818 |
| rs6743092 | Imputed | T | GEN | 434 | | | | | 9.618 | 0.008155 | 0.5023 | 0.5294 | 0.4818 |
| rs6743092 | Imputed | G | REC | 434 | 1.9 | 0.2284 | 1.214 | 2.973 | 2.809 | 0.004962 | 0.5023 | 0.5294 | 0.4818 |
| rs6744759 | Imputed | A | DOM | 436 | 2.691 | 0.3293 | 1.411 | 5.132 | 3.006 | 0.002648 | 0.31537 | 0.359 | 0.2823 |
| rs6746170 | Imputed | A | DOM | 442 | 1.346 | 0.196 | 0.9168 | 1.977 | 1.517 | 0.1293 | 0.26471 | 0.2775 | 0.255 |
| rs6759922 | Imputed | T | GEN | 408 | 1.094 | 0.2214 | 0.7089 | 1.689 | 0.4062 | 0.6846 | 0.4424 | 0.4454 | 0.4402 |
| rs6769864 | Imputed | C | GEN | 436 | | | | | 1.045 | 0.5932 | 0.32339 | 0.3316 | 0.3173 |
| rs6773932 | Imputed | A | GEN | 436 | | | | | 1.977 | 0.3722 | 0.34633 | 0.3537 | 0.3407 |
| rs6774353 | Imputed | C | GEN | 443 | | | | | 0.8065 | 0.6682 | 0.31941 | 0.3246 | 0.3155 |
| rs6781670 | Imputed | C | GEN | 443 | | | | | 0.308 | 0.8573 | 0.31828 | 0.322 | 0.3155 |
| rs6786431 | Imputed | A | GEN | 436 | | | | | 1.977 | 0.3722 | 0.34633 | 0.3537 | 0.3407 |
| rs6789091 | Imputed | C | GEN | 436 | | | | | 1.977 | 0.3722 | 0.34633 | 0.3537 | 0.3407 |
| rs6791296 | Imputed | T | ADD | 426 | 0.6456 | 0.2242 | 0.416 | 1.002 | -1.952 | 0.05092 | 0.13146 | 0.1056 | 0.1504 |
| rs6792662 | Imputed | G | DOM | 434 | 1.389 | 0.2326 | 0.8802 | 2.191 | 1.411 | 0.1581 | 0.55069 | 0.5829 | 0.5263 |
| rs6797574 | Imputed | G | GEN | 436 | | | | | 1.977 | 0.3722 | 0.34633 | 0.3537 | 0.3407 |
| rs6797882 | Imputed | G | GEN | 436 | | | | | 1.977 | 0.3722 | 0.34633 | 0.3537 | 0.3407 |
| rs6805139 | Imputed | C | DOM | 442 | 1.417 | 0.2237 | 0.9138 | 2.197 | 1.557 | 0.1194 | 0.52941 | 0.5628 | 0.504 |
| rs6806043 | Imputed | C | ADD | 441 | 1.05 | 0.1481 | 0.7851 | 1.403 | 0.3265 | 0.744 | 0.31973 | 0.3246 | 0.316 |
| rs6806043 | Imputed | C | GEN | 441 | | | | | 0.8672 | 0.6482 | 0.31973 | 0.3246 | 0.316 |
| rs6850716 | Imputed | C | GEN | 443 | | | | | 1.373 | 0.5034 | 0.22912 | 0.2094 | 0.244 |
| rs6867153 | Imputed | A | REC | 434 | 1.201 | 0.2381 | 0.7533 | 1.916 | 0.7701 | 0.4412 | 0.45853 | 0.4545 | 0.4615 |
| rs687047 | Imputed | C | ADD | 443 | 0.5642 | 0.2311 | 0.3587 | 0.8876 | -2.476 | 0.01329 | 0.11512 | 0.0838 | 0.1389 |
| rs6871041 | Imputed | G | DOM | 418 | 0.6503 | 0.2006 | 0.4389 | 0.9635 | -2.145 | 0.03192 | 0.2823 | 0.2582 | 0.3008 |
| rs688358 | Imputed | A | ADD | 427 | 0.5756 | 0.2319 | 0.3653 | 0.9068 | -2.382 | 0.01723 | 0.1171 | 0.086 | 0.1411 |
| rs6888012 | Imputed | C | REC | 432 | 1.203 | 0.2383 | 0.7542 | 1.919 | 0.7764 | 0.4375 | 0.45949 | 0.457 | 0.4614 |
| rs6908481 | Imputed | C | REC | 400 | 1.391 | 0.2704 | 0.8186 | 2.363 | 1.22 | 0.2226 | 0.41875 | 0.4327 | 0.4083 |
| rs7032231 | Imputed | A | ADD | 423 | 1.514 | 0.148 | 1.133 | 2.023 | 2.802 | 0.005072 | 0.32033 | 0.3736 | 0.2801 |
| rs7067638 | Imputed | G | GEN | 442 | 1.413 | 0.2274 | 0.905 | 2.207 | 1.521 | 0.1283 | 0.11991 | 0.1342 | 0.1091 |
| rs7077799 | Imputed | A | DOM | 442 | 1.347 | 0.1964 | 0.9168 | 1.98 | 1.518 | 0.1663 | 0.33484 | 0.3691 | 0.3088 |
| rs7082163 | Imputed | A | DOM | 440 | 1.236 | 0.2162 | 0.809 | 1.888 | 0.9797 | 0.3273 | 0.11818 | 0.1303 | 0.1091 |
| rs7082163 | Imputed | A | GEN | 440 | 1.386 | 0.2298 | 0.8837 | 2.175 | 1.422 | 0.1551 | 0.11818 | 0.1303 | 0.1091 |
| rs7089661 | Imputed | C | DOM | 442 | 1.347 | 0.1964 | 0.9168 | 1.98 | 1.518 | 0.129 | 0.33145 | 0.3665 | 0.3048 |
| rs7101319 | Imputed | C | ADD | 431 | 1.259 | 0.2167 | 0.8235 | 1.926 | 1.064 | 0.2873 | 0.37137 | 0.3713 | 0.1102 |
| rs7101319 | Imputed | C | DOM | 431 | 1.425 | 0.2303 | 0.9076 | 2.239 | 1.539 | 0.1238 | 0.12065 | 0.1344 | 0.1102 |
| rs710832 | Genotyped | A | GEN | 443 | | | | | 3.803 | 0.1494 | 0.24492 | 0.2147 | 0.2679 |
| rs710832 | Genotyped | A | REC | 443 | 0.4518 | 0.4871 | 0.1739 | 1.174 | -1.631 | 0.1029 | 0.24492 | 0.2147 | 0.2679 |
| rs7134262 | Imputed | T | REC | 438 | 1.986 | 0.3091 | 1.084 | 3.641 | 5.456 | 0.06536 | 0.3379 | 0.3763 | 0.3085 |
| rs7134262 | Imputed | T | GEN | 438 | | | | | 2.22 | 0.02641 | 0.3379 | 0.3763 | 0.3085 |
| rs7134671 | Imputed | T | GEN | 443 | | | | | 1.45 | 0.4843 | 0.38939 | 0.4058 | 0.377 |
| rs7138300 | Imputed | C | ADD | 432 | 0.7137 | 0.1396 | 0.5429 | 0.9384 | -2.415 | 0.01572 | 0.4537 | 0.4054 | 0.4899 |
| rs7138300 | Imputed | C | DOM | 432 | 0.7026 | 0.2117 | 0.464 | 1.064 | -1.667 | 0.09546 | 0.4537 | 0.4054 | 0.4899 |
| rs7138300 | Imputed | C | GEN | 432 | | | | | 6.276 | 0.04338 | 0.4537 | 0.4054 | 0.4899 |

TABLE 16-continued

| | | | | | | | | | | |
|---|---|---|---|---|---|---|---|---|---|---|
| rs7163931 | Imputed | G | GEN | 443 | | | | 2.593 | 0.5733 | 0.21332 | 0.2356 | 0.1964 |
| rs7163931 | Imputed | G | REC | 443 | 1.965 | 0.4472 | 0.8177 | 1.51 | 0.1311 | 0.21332 | 0.2356 | 0.1964 |
| rs7171486 | Genotyped | G | DOM | 443 | 0.591 | 0.1997 | 0.3996 | −2.634 | 0.008445 | 0.7558 | 0.2984 | 0.3988 |
| rs7172611 | Imputed | G | GEN | 443 | | | | 2.593 | 0.2734 | 0.5733 | 0.2356 | 0.1964 |
| rs7172611 | Imputed | G | REC | 443 | 1.965 | 0.4472 | 0.8177 | 1.51 | 0.1311 | 0.5733 | 0.2356 | 0.1964 |
| rs7172689 | Imputed | T | GEN | 443 | | | | 2.593 | 0.2734 | 0.5733 | 0.2356 | 0.1964 |
| rs7172689 | Imputed | T | REC | 443 | 1.965 | 0.4472 | 0.8177 | 1.51 | 0.1311 | 0.5733 | 0.2356 | 0.1964 |
| rs7175701 | Imputed | C | GEN | 440 | | | | 2.427 | 0.2972 | 1 | 0.254 | 0.2191 |
| rs7180245 | Imputed | A | GEN | 443 | | | | 2.593 | 0.2734 | 0.5733 | 0.2356 | 0.1964 |
| rs7180245 | Imputed | A | REC | 443 | 1.965 | 0.4472 | 0.8177 | 1.51 | 0.1311 | 0.5733 | 0.2356 | 0.1964 |
| rs7220603 | Genotyped | A | ADD | 443 | 1.419 | 0.1547 | 1.048 | 2.261 | 0.02374 | 0.3685 | 0.3403 | 0.2718 |
| rs7282518 | Imputed | T | ADD | 387 | 1.054 | 0.205 | 0.7055 | 0.2585 | 0.796 | 0.7019 | 0.30135 | 0.1511 |
| rs7283476 | Imputed | T | ADD | 441 | 0.413 | 0.3729 | 0.1989 | −2.371 | 0.01774 | 0.237 | 0.15504 | 0.062 |
| rs7283476 | Imputed | T | DOM | 441 | 0.3545 | 0.3985 | 0.1623 | −2.602 | 0.009257 | 0.237 | 0.04649 | 0.062 |
| rs7295817 | Imputed | C | GEN | 424 | | | | 6.629 | 0.03635 | 1 | 0.3819 | 0.4628 |
| rs7298255 | Imputed | A | ADD | 443 | 0.7433 | 0.1356 | 0.5699 | −2.188 | 0.02869 | 0.2143 | 0.4188 | 0.494 |
| rs7298255 | Imputed | A | DOM | 443 | 0.74 | 0.2089 | 0.4914 | −1.442 | 0.1493 | 0.2143 | 0.46163 | 0.494 |
| rs7305832 | Imputed | C | GEN | 442 | | | | 5.607 | 0.06061 | 1 | 0.33597 | 0.3068 |
| rs7305832 | Imputed | C | REC | 442 | 2.008 | 0.3089 | 1.096 | 2.256 | 0.02404 | 1 | 0.3743 | 0.3068 |
| rs7331467 | Imputed | A | GEN | 443 | | | | 1.596 | 0.4502 | 1 | 0.33597 | 0.3611 |
| rs7392620 | Imputed | C | ADD | 437 | 0.6521 | 0.1533 | 0.4829 | −2.789 | 0.005287 | 0.7378 | 0.34876 | 0.3508 |
| rs742827 | Imputed | A | ADD | 437 | 1.396 | 0.145 | 1.051 | 2.3 | 0.02146 | 0.4608 | 0.31121 | 0.3138 |
| rs742827 | Imputed | A | DOM | 437 | | | 0.8807 | | 0.03879 | 0.4608 | 0.34668 | 0.3138 |
| rs742827 | Imputed | A | REC | 437 | 2.051 | 0.2943 | 1.152 | 2.441 | 0.01464 | 0.4608 | 0.34668 | 0.3138 |
| rs7446891 | Imputed | G | DOM | 443 | 0.5934 | 0.2016 | 0.3997 | −2.589 | 0.009637 | 0.1134 | 0.34668 | 0.3115 |
| rs7448641 | Imputed | C | ADD | 443 | 0.9741 | 0.2886 | 0.5532 | −0.09096 | 0.9275 | 2.36E−05 | 0.34312 | 0.3671 |
| rs7448641 | Imputed | C | DOM | 443 | 1.136 | 0.3415 | 0.5817 | 0.3732 | 0.709 | 2.36E−05 | 0.07336 | 0.0734 |
| rs7484728 | Imputed | T | GEN | 443 | | | | 1.45 | 0.4843 | 1 | 0.38928 | 0.377 |
| rs7499402 | Genotyped | A | ADD | 443 | 2.08 | 0.2847 | 1.191 | 2.573 | 0.01008 | 0.3514 | 0.06546 | 0.0476 |
| rs7529851 | Imputed | A | ADD | 401 | 0.7324 | 0.1517 | 0.544 | −2.053 | 0.04006 | 0.3514 | 0.40648 | 0.4421 |
| rs7529851 | Imputed | A | GEN | 401 | | | | 4.232 | 0.1205 | 0.3514 | 0.40648 | 0.4421 |
| rs7573951 | Imputed | G | ADD | 442 | 1.009 | 0.1374 | 0.7712 | 0.06836 | 0.9455 | 0.2878 | 0.43891 | 0.4382 |
| rs7599198 | Imputed | T | DOM | 371 | 0.9895 | 0.2386 | 0.6199 | −0.04427 | 0.9647 | 0.1175 | 0.46092 | 0.4643 |
| rs7600050 | Imputed | C | ADD | 416 | 1.316 | 0.1481 | 0.9845 | 1.855 | 0.06365 | 0.9138 | 0.34736 | 0.3213 |
| rs7607712 | Imputed | T | ADD | 441 | 1.357 | 0.1708 | 0.9708 | 1.787 | 0.074 | 0.6555 | 0.19955 | 0.178 |
| rs7607712 | Imputed | T | DOM | 441 | 1.496 | 0.2035 | 1.004 | 1.98 | 0.04765 | 0.6555 | 0.19955 | 0.178 |
| rs7613492 | Imputed | G | GEN | 443 | | | | 0.8065 | 0.6682 | 0.7429 | 0.32463 | 0.3155 |
| rs7621663 | Imputed | G | ADD | 443 | 1.048 | 0.1481 | 0.7837 | 0.3148 | 0.7529 | 0.7429 | 0.31941 | 0.3155 |
| rs7621663 | Imputed | G | GEN | 443 | | | | 0.8065 | 0.6682 | 0.7429 | 0.31941 | 0.3155 |
| rs7621663 | Imputed | G | REC | 443 | 0.8874 | 0.3167 | 0.4771 | −0.3773 | 0.706 | 0.7429 | 0.31941 | 0.3155 |
| rs7626584 | Imputed | C | ADD | 442 | 0.6617 | 0.3179 | 0.3549 | −1.299 | 0.1939 | 1 | 0.05769 | 0.0657 |
| rs7684899 | Imputed | C | ADD | 417 | 0.617 | 0.1957 | 0.4205 | −2.467 | 0.01361 | 0.8637 | 0.17266 | 0.2021 |
| rs7684899 | Imputed | C | DOM | 417 | 0.5176 | 0.2237 | 0.3339 | −2.944 | 0.00324 | 0.8637 | 0.17266 | 0.2021 |
| rs7701604 | Imputed | G | ADD | 443 | 0.9741 | 0.2886 | 0.5532 | −0.09096 | 0.9275 | 2.36E−05 | 0.07336 | 0.0734 |
| rs7703676 | Imputed | C | ADD | 443 | 1.136 | 0.3415 | 0.5817 | 0.3732 | 0.709 | 2.36E−05 | 0.07336 | 0.0734 |
| rs7703676 | Imputed | C | DOM | 443 | 0.9741 | 0.2886 | 0.5532 | −0.09096 | 0.9275 | 2.36E−05 | 0.07336 | 0.0734 |
| rs7708491 | Imputed | C | REC | 435 | 1.136 | 0.3415 | 0.5817 | 0.3732 | 0.709 | 2.36E−05 | 0.07336 | 0.0734 |
| rs7711358 | Imputed | A | DOM | 443 | 1.179 | 0.2374 | 0.7405 | 0.6947 | 0.4872 | 0.8472 | 0.45977 | 0.4637 |
| rs7719448 | Imputed | G | REC | 436 | 0.593 | 0.2016 | 0.3994 | −2.592 | 0.009541 | 0.1134 | 0.34312 | 0.369 |
| rs7724761 | Imputed | G | REC | 435 | 1.235 | 0.2366 | 0.777 | 0.8936 | 0.3715 | 0.847 | 0.45872 | 0.4597 |
| rs7742476 | Imputed | T | DOM | 386 | 1.207 | 0.2381 | 0.7571 | 0.791 | 0.429 | 0.9232 | 0.45862 | 0.4617 |
| rs7762993 | Imputed | A | REC | 431 | 1.23 | 0.2098 | 0.8155 | 0.988 | 0.3231 | 0.00424 | 0.23316 | 0.2166 |
| rs7762993 | Imputed | A | ADD | 431 | 1.066 | 0.1948 | 0.7276 | 0.3271 | 0.7436 | 0.00187 | 0.18213 | 0.1796 |

TABLE 16-continued

| | | | | | | | | | | |
|---|---|---|---|---|---|---|---|---|---|---|
| rs7762993 | Imputed | A | DOM | 431 | 1.079 | 0.2057 | 0.7207 | 1.614 | 0.3676 | 0.00187 | 0.18213 | 0.1855 | 0.1796 |
| rs7767265 | Imputed | G | ADD | 430 | 1.18 | 0.1729 | 0.8411 | 1.656 | 0.3377 | 0.0128 | 0.24419 | 0.2594 | 0.2325 |
| rs7767265 | Imputed | G | DOM | 430 | 1.155 | 0.1977 | 0.7839 | 1.702 | 0.4664 | 0.0128 | 0.24419 | 0.2594 | 0.2325 |
| rs7768128 | Imputed | G | REC | 439 | 0.3066 | 0.5174 | 0.1112 | 0.8451 | 0.7283 | 0.7859 | 0.22779 | 0.2275 | 0.228 |
| rs7771264 | Imputed | T | DOM | 441 | 1.051 | 0.1977 | 0.7133 | 1.548 | 0.0223 | 0.25 | 0.2483 | 0.2513 | 0.246 |
| rs7773151 | Genotyped | C | DOM | 443 | 1.038 | 0.1992 | 0.7027 | 1.534 | 0.8018 | 0.3391 | 0.2246 | 0.2225 | 0.2262 |
| rs7773210 | Genotyped | A | DOM | 443 | 1.038 | 0.1992 | 0.7027 | 1.534 | 0.85 | 0.3391 | 0.2246 | 0.2225 | 0.2262 |
| rs7808536 | Imputed | G | DOM | 409 | 1.374 | 0.2138 | 0.904 | 2.09 | 0.1891 | 0.7448 | 0.18582 | 0.2095 | 0.1674 |
| rs7843510 | Genotyped | G | DOM | 443 | 0.9929 | 0.2031 | 0.6669 | 1.478 | 0.1891 | 0.1444 | 0.42325 | 0.4293 | 0.4187 |
| rs7894867 | Imputed | T | DOM | 441 | 1.426 | 0.2276 | 0.9129 | 2.228 | -0.03512 | 0.1751 | 0.12018 | 0.1349 | 0.1091 |
| rs7921834 | Imputed | C | DOM | 440 | 1.347 | 0.1965 | 0.9164 | 1.98 | 1.559 | 0.1189 | 0.33182 | 0.3658 | 0.306 |
| rs7939893 | Imputed | C | ADD | 441 | 0.6916 | 0.1478 | 0.5177 | 0.924 | 1.516 | 0.1296 | 0.32653 | 0.2789 | 0.3625 |
| rs7939893 | Imputed | C | DOM | 441 | 0.506 | 0.1982 | 0.3431 | 0.7463 | -2.495 | 0.01261 | 0.32653 | 0.2789 | 0.3625 |
| rs7944513 | Imputed | T | GEN | 418 | | | | | -3.437 | 0.000589 | 0.24522 | 0.2793 | 0.2197 |
| rs7944513 | Imputed | T | REC | 418 | 1.787 | 0.3844 | 0.8411 | 3.795 | 4.036 | 0.1329 | 0.24522 | 0.2793 | 0.2197 |
| rs7949720 | Imputed | G | ADD | 418 | 1.485 | 0.2216 | 0.9616 | 2.292 | 1.51 | 0.1311 | 0.11603 | 0.1378 | 0.0987 |
| rs7949720 | Imputed | G | DOM | 418 | 1.52 | 0.2398 | 0.9502 | 2.433 | 1.783 | 0.07457 | 0.11603 | 0.1378 | 0.0987 |
| rs7955901 | Imputed | C | ADD | 440 | 0.7285 | 0.1367 | 0.5573 | 0.9524 | 1.747 | 0.08065 | 0.46364 | 0.4184 | 0.498 |
| rs7955901 | Imputed | C | DOM | 440 | 0.7139 | 0.2105 | 0.4726 | 1.078 | -2.316 | 0.02054 | 0.46364 | 0.4184 | 0.498 |
| rs7956274 | Imputed | T | ADD | 426 | 0.7156 | 0.1398 | 0.5441 | 0.9412 | -1.601 | 0.1093 | 0.45423 | 0.4066 | 0.4898 |
| rs7956274 | Imputed | T | DOM | 426 | 0.7031 | 0.2129 | 0.4633 | 1.067 | -2.394 | 0.01667 | 0.45423 | 0.4066 | 0.4898 |
| rs7957932 | Imputed | T | GEN | 426 | | | | | -1.655 | 0.098 | 0.45423 | 0.4066 | 0.4898 |
| rs7957932 | Imputed | G | DOM | 439 | 0.7234 | 0.1368 | 0.5533 | 0.9459 | 6.165 | 0.04584 | 0.47039 | 0.4241 | 0.506 |
| rs7984504 | Imputed | G | DOM | 439 | 0.6888 | 0.212 | 0.4546 | 1.044 | -2.366 | 0.01797 | 0.47039 | 0.4241 | 0.506 |
| rs7984504 | Imputed | C | GEN | 443 | | | | | -1.758 | 0.07871 | 0.31603 | 0.3063 | 0.3234 |
| rs7999518 | Imputed | A | REC | 423 | 0.4462 | 0.248 | 0.2745 | 0.7255 | 0.4224 | 0.8096 | 0.49882 | 0.4385 | 0.543 |
| rs8026245 | Imputed | G | GEN | 442 | | | | | -3.254 | 0.001137 | 0.23416 | 0.2539 | 0.2191 |
| rs8026245 | Imputed | G | REC | 442 | 1.888 | 0.4309 | 0.8114 | 4.394 | 2.296 | 0.3173 | 0.23416 | 0.2539 | 0.2191 |
| rs8060725 | Genotyped | A | ADD | 443 | 0.6772 | 0.162 | 0.493 | 0.9303 | 1.475 | 0.1402 | 0.26298 | 0.2225 | 0.2937 |
| rs8103016 | Genotyped | A | ADD | 443 | 1.223 | 0.1622 | 0.8901 | 1.681 | -2.406 | 0.01613 | 0.22573 | 0.2461 | 0.2103 |
| rs8103016 | Genotyped | A | DOM | 443 | 1.343 | 0.1996 | 0.9084 | 1.987 | 1.242 | 0.2142 | 0.22573 | 0.2461 | 0.2103 |
| rs8104182 | Imputed | G | ADD | 440 | 1.298 | 0.1657 | 0.9382 | 1.796 | 1.479 | 0.1391 | 0.21591 | 0.2407 | 0.1972 |
| rs8104182 | Imputed | G | DOM | 440 | 1.4 | 0.1997 | 0.9468 | 2.071 | 1.575 | 0.1152 | 0.21591 | 0.2407 | 0.1972 |
| rs8129461 | Imputed | T | ADD | 441 | 0.3726 | 0.3715 | 0.1799 | 0.7717 | 1.686 | 0.09175 | 0.04989 | 0.0262 | 0.068 |
| rs8129461 | Imputed | T | DOM | 441 | 0.3187 | 0.3953 | 0.1469 | 0.6915 | -2.657 | 0.007877 | 0.04989 | 0.0262 | 0.068 |
| rs8130021 | Imputed | A | ADD | 442 | 0.4152 | 0.3729 | 0.1999 | 0.8624 | -2.893 | 0.003814 | 0.04638 | 0.0262 | 0.0618 |
| rs8130021 | Imputed | A | DOM | 442 | 0.3565 | 0.3985 | 0.1632 | 0.7784 | -2.357 | 0.01842 | 0.04638 | 0.0262 | 0.0618 |
| rs879961 | Imputed | T | ADD | 440 | 1.178 | 0.1585 | 0.8634 | 1.607 | -2.589 | 0.009634 | 0.28182 | 0.2974 | 0.27 |
| rs879961 | Imputed | T | DOM | 440 | 1.245 | 0.1948 | 0.8502 | 1.825 | 1.033 | 0.3014 | 0.28182 | 0.2974 | 0.27 |
| rs906353 | Imputed | A | DOM | 434 | 1.22 | 0.1967 | 0.8295 | 1.794 | 1.127 | 0.2598 | 0.3053 | 0.3172 | 0.2964 |
| rs915491 | Imputed | C | ADD | 441 | 1.329 | 0.1967 | 0.9042 | 1.955 | 1.01 | 0.3127 | 0.30839 | 0.3474 | 0.2789 |
| rs915493 | Imputed | T | DOM | 441 | 1.329 | 0.1967 | 0.9042 | 1.955 | 1.448 | 0.1476 | 0.30839 | 0.3474 | 0.2789 |
| rs915494 | Imputed | A | ADD | 422 | 1.399 | 0.1473 | 1.048 | 1.868 | 1.448 | 0.1476 | 0.32227 | 0.3683 | 0.286 |
| rs915494 | Imputed | A | DOM | 422 | 1.486 | 0.1999 | 1.004 | 2.199 | 2.281 | 0.02256 | 0.32227 | 0.3683 | 0.286 |
| rs917295 | Imputed | C | DOM | 443 | 0.5934 | 0.2016 | 0.3997 | 0.881 | 1.982 | 0.0475 | 0.34312 | 0.3115 | 0.3671 |
| rs9284851 | Imputed | A | GEN | 436 | | | | | -2.589 | 0.009637 | 0.34633 | 0.3537 | 0.3407 |
| rs9293464 | Imputed | A | REC | 435 | 1.207 | 0.2381 | 0.7571 | 1.925 | 1.977 | 0.3722 | 0.45862 | 0.4545 | 0.4617 |
| rs9295154 | Genotyped | G | DOM | 443 | 1.463 | 0.2215 | 0.9479 | 2.259 | 0.791 | 0.429 | 0.13995 | 0.1545 | 0.129 |
| rs9310221 | Imputed | A | DOM | 393 | 0.8966 | 0.2237 | 0.5784 | 1.39 | 1.719 | 0.08569 | 0.42875 | 0.426 | 0.4308 |
| rs9310699 | Genotyped | T | GEN | 443 | | | | | -0.4881 | 0.6255 | 0.31828 | 0.322 | 0.3155 |
| rs9310700 | Imputed | C | ADD | 443 | 1.048 | 0.1481 | 0.7837 | 1.401 | 0.308 | 0.8573 | 0.31941 | 0.3246 | 0.3155 |
| rs9310700 | Imputed | C | GEN | 443 | | | | | 0.3148 | 0.7529 | 0.31941 | 0.3246 | 0.3155 |
| rs9310701 | Imputed | G | GEN | 443 | | | | | 0.8065 | 0.6682 | 0.33409 | 0.3429 | 0.3274 |

TABLE 16-continued

| SNP rs # | SOURCE | ALLELE (A1) | MODEL | NMISS | | | | | ATORVA_A1_HZ_COUNT | ATORVA_HET_COUNT | | ATORVA_A2_HZ_COUNT | | | PRAVA_A1_HZ_COUNT | PRAVA_HET_COUNT | PRAVA_A2_HZ_COUNT |
|---|---|---|---|---|---|---|---|---|---|---|---|---|---|---|---|---|---|
| rs9310704 | Imputed | G | GEN | 436 | | | | | | | | | | | | | |
| rs9319185 | Imputed | C | GEN | 441 | | | | | | | | | | | | | |
| rs9319186 | Imputed | T | GEN | 443 | | | | | | | | | | | | | |
| rs9327555 | Imputed | T | DOM | 443 | 0.5934 | 0.2016 | 0.3997 | 0.881 | 1.977 | 0.3722 | 1 | 0.34633 | 0.3537 | 0.3407 | | | |
| rs9403367 | Imputed | C | DOM | 443 | 1.038 | 0.1992 | 0.7027 | 1.534 | 0.9349 | 0.6266 | 0.4378 | 0.31293 | 0.2989 | 0.3234 | | | |
| rs9419608 | Imputed | G | REC | 430 | 0.5885 | 0.2576 | 0.3552 | 0.9749 | 0.4224 | 0.8096 | 0.3222 | 0.31603 | 0.3063 | 0.3234 | | | |
| rs9426437 | Imputed | T | DOM | 424 | 1.067 | 0.2164 | 0.6984 | 1.631 | −2.589 | 0.009637 | 0.1134 | 0.34312 | 0.3115 | 0.3671 | | | |
| rs9454967 | Imputed | G | DOM | 441 | 0.9744 | 0.2621 | 0.583 | 1.629 | 0.1891 | 0.85 | 0.3391 | 0.2246 | 0.2225 | 0.2262 | | | |
| rs9635511 | Imputed | T | DOM | 436 | 0.8692 | 0.2057 | 0.5809 | 1.301 | −2.059 | 0.03953 | 0.03324 | 0.45814 | 0.4098 | 0.4939 | | | |
| rs966583 | Imputed | A | ADD | 439 | 0.7596 | 0.1431 | 0.5738 | 1.005 | −2.059 | 0.7635 | 0.3217 | 0.43042 | 0.4355 | 0.4265 | | | |
| rs966583 | Imputed | A | DOM | 439 | 0.6781 | 0.203 | 0.4555 | 1.01 | 0.3009 | 0.9212 | 0.07328 | 0.0907 | 0.0895 | 0.0916 | | | |
| rs980263 | Imputed | T | GEN | 443 | | | | | −0.09893 | 0.4956 | 0.7678 | 0.41399 | 0.3915 | 0.4312 | | | |
| rs980264 | Imputed | T | GEN | 443 | | | | | −0.6814 | 0.05464 | 1 | 0.40091 | 0.3658 | 0.4277 | | | |
| rs9812206 | Imputed | G | ADD | 442 | 1.042 | 0.2668 | 0.6177 | 1.758 | −1.922 | 0.0557 | 1 | 0.40091 | 0.3658 | 0.4277 | | | |
| rs9812206 | Imputed | G | DOM | 442 | 1.042 | 0.2668 | 0.6177 | 1.758 | −1.913 | 0.5142 | 0.9151 | 0.33409 | 0.3429 | 0.3274 | | | |
| rs9813552 | Imputed | G | ADD | 442 | 1.042 | 0.2623 | 0.6235 | 1.743 | 1.33 | 0.5142 | 0.9151 | 0.33409 | 0.3429 | 0.3274 | | | |
| rs9813552 | Imputed | G | DOM | 442 | 1.077 | 0.2681 | 0.6368 | 1.821 | 0.1545 | 0.8772 | 0.09556 | 0.07692 | 0.0785 | 0.0757 | | | |
| rs9815037 | Imputed | T | ADD | 443 | 1.048 | 0.2622 | 0.6267 | 1.752 | 0.1545 | 0.8772 | 0.09556 | 0.07692 | 0.0785 | 0.0757 | | | |
| rs9815037 | Imputed | T | DOM | 443 | 1.083 | 0.2681 | 0.6401 | 1.831 | 0.1586 | 0.874 | 0.4984 | 0.07692 | 0.0785 | 0.0757 | | | |
| rs9819583 | Imputed | T | GEN | 443 | | | | | 0.2766 | 0.7821 | 0.4984 | 0.07675 | 0.0785 | 0.0754 | | | |
| rs9825349 | Imputed | A | ADD | 443 | 1.048 | 0.2622 | 0.6267 | 1.752 | 0.1778 | 0.8589 | 0.4982 | 0.07675 | 0.0785 | 0.0754 | | | |
| rs9825349 | Imputed | A | DOM | 443 | 1.083 | 0.2681 | 0.6401 | 1.831 | 0.2958 | 0.7674 | 0.4982 | 0.07675 | 0.0785 | 0.0754 | | | |
| rs9833118 | Imputed | G | ADD | 443 | 1.048 | 0.1481 | 0.7837 | 1.401 | 0.3148 | 0.7529 | 0.7429 | 0.31941 | 0.3155 | 0.3155 | | | |
| rs9833118 | Imputed | G | GEN | 443 | | | | | 0.308 | 0.8573 | 0.7429 | 0.31941 | 0.3246 | 0.3155 | | | |
| rs9834217 | Imputed | T | ADD | 443 | 1.017 | 0.2611 | 0.6096 | 1.696 | 0.06425 | 0.9488 | 0.5011 | 0.07788 | 0.0785 | 0.0774 | | | |
| rs9834217 | Imputed | T | DOM | 443 | 1.049 | 0.2668 | 0.6218 | 1.77 | 0.179 | 0.858 | 0.5011 | 0.07788 | 0.0785 | 0.0774 | | | |
| rs9838563 | Imputed | C | GEN | 437 | | | | | 1.084 | 0.5817 | 1 | 0.33066 | 0.3413 | 0.3226 | | | |
| rs9840460 | Imputed | T | ADD | 443 | 1.017 | 0.2611 | 0.6096 | 1.696 | 0.06425 | 0.9488 | 0.5011 | 0.07788 | 0.0785 | 0.0774 | | | |
| rs9840460 | Imputed | T | DOM | 443 | 1.049 | 0.2668 | 0.6218 | 1.77 | 0.179 | 0.858 | 0.5011 | 0.07788 | 0.0785 | 0.0774 | | | |
| rs9840756 | Imputed | A | ADD | 437 | 0.9995 | 0.2614 | 0.5988 | 1.668 | −0.00192 | 0.9985 | 0.5026 | 0.07895 | 0.0789 | 0.0789 | | | |
| rs9840756 | Imputed | A | DOM | 437 | 1.031 | 0.2671 | 0.6105 | 1.74 | −0.1127 | 0.9103 | 0.5026 | 0.07895 | 0.0789 | 0.0789 | | | |
| rs9847999 | Imputed | C | GEN | 436 | | | | | 1.977 | 0.3722 | 1 | 0.34633 | 0.3537 | 0.3407 | | | |
| rs9864769 | Imputed | C | GEN | 443 | | | | | 1.33 | 0.5142 | 0.9151 | 0.33409 | 0.3429 | 0.3274 | | | |
| rs9866421 | Genotyped | C | REC | 443 | 0.5895 | 0.2541 | 0.3583 | 0.9701 | −2.08 | 0.03756 | 0.2848 | 0.42551 | 0.3979 | 0.4464 | | | |
| rs987296 | Imputed | T | GEN | 441 | | | | | 0.3297 | 0.848 | 0.5103 | 0.31859 | 0.316 | 0.316 | | | |
| rs9881685 | Imputed | A | ADD | 440 | 1.041 | 0.2668 | 0.6172 | 1.756 | 0.151 | 0.88 | 0.09541 | 0.07727 | 0.0789 | 0.076 | | | |
| rs9881685 | Imputed | A | DOM | 440 | 1.041 | 0.2668 | 0.6172 | 1.756 | 0.151 | 0.88 | 0.09541 | 0.07727 | 0.0789 | 0.076 | | | |
| rs992695 | Imputed | A | ADD | 442 | 1.16 | 0.158 | 0.8507 | 1.581 | 0.9366 | 0.3489 | 0.1596 | 0.28281 | 0.2974 | 0.2718 | | | |
| rs992695 | Imputed | C | DOM | 442 | 1.216 | 0.194 | 0.8313 | 1.778 | 1.008 | 0.3136 | 0.1596 | 0.28281 | 0.2974 | 0.2718 | | | |
| rs9936999 | Imputed | G | DOM | 266 | 0.7758 | 0.254 | 0.4716 | 1.276 | −0.9992 | 0.3177 | 0.2862 | 0.35714 | 0.3571 | 0.3571 | | | |

| SNP rs # | PRAVA_A1_HZ_COUNT | PRAVA_HET_COUNT | PRAVA_A2_COUNT |
|---|---|---|---|
| rs77638540 | 1 | 33 | 218 |
| rs72746987 | 0 | 21 | 231 |
| rs10021016 | 12 | 95 | 145 |
| rs10021016 | 12 | 95 | 145 |
| rs10051148 | 23 | 120 | 109 |
| rs10054055 | 29 | 120 | 102 |
| rs10067895 | 35 | 118 | 97 |
| rs10100725 | 8 | 71 | 173 |
| rs10128531 | 3 | 46 | 188 |

TABLE 16-continued

| | | | | | | | | |
|---|---|---|---|---|---|---|---|---|
| rs10181743 | Imputed | G | ADD | 417 | 35 | 90 | 54 | 40 | 119 | 79 |
| rs10199127 | Imputed | T | DOM | 431 | 17 | 84 | 86 | 34 | 97 | 113 |
| rs10270624 | Imputed | G | DOM | 409 | 8 | 59 | 112 | 7 | 63 | 160 |
| rs1030006 | Imputed | G | REC | 434 | 40 | 92 | 55 | 58 | 120 | 69 |
| rs1031811 | Imputed | A | REC | 434 | 29 | 77 | 81 | 16 | 107 | 124 |
| rs10430870 | Genotyped | G | GEN | 443 | 20 | 69 | 102 | 9 | 93 | 150 |
| rs10430870 | Genotyped | G | REC | 443 | 20 | 69 | 102 | 9 | 93 | 150 |
| rs10469597 | Imputed | A | GEN | 411 | 13 | 66 | 98 | 15 | 104 | 115 |
| rs10469597 | Imputed | A | REC | 411 | 13 | 66 | 98 | 15 | 104 | 115 |
| rs10478919 | Imputed | G | DOM | 443 | 26 | 99 | 99 | 34 | 118 | 100 |
| rs10506623 | Imputed | C | ADD | 442 | 26 | 86 | 78 | 45 | 121 | 86 |
| rs10506623 | Imputed | C | DOM | 442 | 26 | 86 | 78 | 45 | 121 | 86 |
| rs10506626 | Imputed | A | ADD | 443 | 26 | 84 | 81 | 46 | 121 | 85 |
| rs10506626 | Imputed | A | DOM | 443 | 26 | 84 | 81 | 46 | 121 | 85 |
| rs10509477 | Imputed | T | DOM | 443 | 29 | 83 | 79 | 27 | 101 | 124 |
| rs10517918 | Imputed | G | DOM | 433 | 32 | 98 | 58 | 43 | 122 | 80 |
| rs10517924 | Imputed | A | REC | 442 | 42 | 94 | 55 | 52 | 126 | 73 |
| rs10519362 | Imputed | G | DOM | 434 | 6 | 58 | 122 | 6 | 54 | 188 |
| rs10520072 | Imputed | T | DOM | 443 | 27 | 65 | 99 | 33 | 119 | 100 |
| rs10737390 | Imputed | T | DOM | 418 | 30 | 90 | 59 | 35 | 122 | 82 |
| rs10742851 | Imputed | T | REC | 443 | 18 | 80 | 93 | 16 | 109 | 127 |
| rs10743685 | Imputed | G | GEN | 435 | 34 | 95 | 59 | 33 | 131 | 83 |
| rs10743685 | Imputed | G | REC | 435 | 34 | 95 | 59 | 33 | 131 | 83 |
| rs10749293 | Imputed | G | DOM | 441 | 26 | 84 | 80 | 26 | 96 | 129 |
| rs10749294 | Imputed | A | DOM | 443 | 23 | 78 | 90 | 19 | 95 | 138 |
| rs10753760 | Imputed | T | ADD | 423 | 36 | 80 | 69 | 50 | 102 | 86 |
| rs10753760 | Imputed | T | GEN | 423 | 36 | 80 | 69 | 50 | 102 | 86 |
| rs10772362 | Imputed | T | ADD | 443 | 7 | 65 | 119 | 12 | 93 | 147 |
| rs10784891 | Imputed | C | ADD | 422 | 30 | 89 | 65 | 58 | 111 | 69 |
| rs10784891 | Imputed | C | DOM | 422 | 30 | 89 | 65 | 58 | 111 | 69 |
| rs10784891 | Imputed | C | GEN | 422 | 30 | 89 | 65 | 58 | 111 | 69 |
| rs10787923 | Imputed | G | DOM | 439 | 26 | 83 | 79 | 26 | 96 | 129 |
| rs10787924 | Imputed | T | DOM | 443 | 23 | 78 | 90 | 19 | 95 | 138 |
| rs10787949 | Imputed | A | DOM | 442 | 29 | 84 | 78 | 29 | 100 | 122 |
| rs10787951 | Imputed | G | DOM | 441 | 29 | 83 | 78 | 29 | 100 | 122 |
| rs10787983 | Imputed | C | GEN | 441 | 29 | 83 | 79 | 27 | 100 | 123 |
| rs10794733 | Imputed | C | ADD | 439 | 13 | 73 | 104 | 32 | 110 | 107 |
| rs10818280 | Imputed | G | DOM | 432 | 10 | 71 | 106 | 21 | 114 | 110 |
| rs10860586 | Imputed | A | ADD | 431 | 44 | 93 | 48 | 67 | 121 | 58 |
| rs10860586 | Imputed | A | GEN | 431 | 44 | 93 | 48 | 67 | 121 | 58 |
| rs10870473 | Imputed | A | ADD | 177 | 4 | 35 | 28 | 12 | 39 | 59 |
| rs10870473 | Imputed | A | DOM | 177 | 4 | 35 | 28 | 12 | 39 | 59 |
| rs10879240 | Imputed | C | ADD | 428 | 30 | 92 | 66 | 60 | 111 | 69 |
| rs10879240 | Imputed | C | GEN | 428 | 30 | 92 | 66 | 60 | 111 | 69 |
| rs10879242 | Imputed | A | ADD | 421 | 26 | 86 | 73 | 45 | 116 | 75 |
| rs10879242 | Imputed | A | DOM | 421 | 26 | 86 | 73 | 45 | 116 | 75 |
| rs10879245 | Imputed | G | DOM | 421 | 26 | 86 | 73 | 45 | 116 | 75 |
| rs10879245 | Imputed | G | DOM | 421 | 26 | 86 | 73 | 45 | 116 | 75 |
| rs10879249 | Imputed | T | ADD | 440 | 26 | 87 | 77 | 45 | 121 | 84 |
| rs10879249 | Imputed | T | DOM | 440 | 26 | 87 | 77 | 45 | 121 | 84 |
| rs10886429 | Imputed | A | DOM | 441 | 29 | 82 | 80 | 27 | 101 | 122 |
| rs10886449 | Imputed | G | DOM | 440 | 28 | 76 | 86 | 21 | 97 | 132 |
| rs10886451 | Imputed | G | DOM | 440 | 28 | 76 | 86 | 21 | 97 | 132 |

TABLE 16-continued

| SNP | Status | Allele | Model | | | | | |
|---|---|---|---|---|---|---|---|---|
| rs10886452 | Imputed | A | DOM | 440 | 30 | 82 | 78 | 26 | 101 | 123 |
| rs10886456 | Imputed | G | DOM | 440 | 28 | 76 | 86 | 21 | 97 | 132 |
| rs10886463 | Imputed | C | DOM | 442 | 30 | 83 | 78 | 29 | 100 | 122 |
| rs10886465 | Imputed | A | DOM | 441 | 30 | 83 | 78 | 28 | 100 | 122 |
| rs10886526 | Imputed | C | DOM | 439 | 28 | 83 | 78 | 26 | 101 | 123 |
| rs10922903 | Imputed | C | REC | 440 | 34 | 99 | 56 | 46 | 120 | 85 |
| rs10941126 | Imputed | G | ADD | 443 | 3 | 22 | 166 | 7 | 23 | 222 |
| rs10941126 | Imputed | G | DOM | 443 | 3 | 22 | 166 | 7 | 23 | 222 |
| rs10947980 | Imputed | G | ADD | 439 | 10 | 80 | 100 | 17 | 97 | 135 |
| rs11059376 | Imputed | T | ADD | 401 | 3 | 53 | 118 | 8 | 57 | 162 |
| rs11072995 | Imputed | T | GEN | 439 | 13 | 59 | 118 | 8 | 74 | 167 |
| rs11072995 | Imputed | T | REC | 439 | 13 | 59 | 118 | 8 | 74 | 167 |
| rs11081202 | Genotyped | G | GEN | 443 | 22 | 66 | 103 | 10 | 97 | 145 |
| rs11081202 | Genotyped | G | REC | 443 | 22 | 66 | 103 | 10 | 97 | 145 |
| rs110965 | Imputed | C | GEN | 420 | 34 | 77 | 71 | 17 | 112 | 109 |
| rs11124962 | Imputed | A | DOM | 437 | 11 | 78 | 101 | 21 | 81 | 145 |
| rs11116596 | Imputed | T | DOM | 443 | 26 | 66 | 99 | 34 | 118 | 100 |
| rs11178531 | Imputed | A | ADD | 439 | 34 | 92 | 64 | 67 | 117 | 65 |
| rs11178531 | Imputed | A | DOM | 439 | 34 | 92 | 64 | 67 | 117 | 65 |
| rs11178583 | Imputed | A | ADD | 443 | 26 | 87 | 78 | 45 | 121 | 86 |
| rs11178583 | Imputed | A | DOM | 443 | 26 | 87 | 78 | 45 | 121 | 86 |
| rs11178589 | Imputed | T | ADD | 437 | 26 | 87 | 77 | 45 | 120 | 82 |
| rs11178589 | Imputed | T | DOM | 437 | 26 | 87 | 77 | 45 | 120 | 82 |
| rs11178594 | Imputed | C | ADD | 441 | 26 | 88 | 76 | 45 | 125 | 81 |
| rs11178594 | Imputed | C | DOM | 441 | 26 | 88 | 76 | 45 | 125 | 81 |
| rs11178602 | Imputed | T | ADD | 439 | 26 | 87 | 76 | 45 | 124 | 81 |
| rs11178602 | Imputed | T | DOM | 439 | 26 | 87 | 76 | 45 | 124 | 81 |
| rs11178648 | Imputed | T | ADD | 440 | 26 | 83 | 80 | 46 | 120 | 85 |
| rs11178648 | Imputed | T | DOM | 440 | 26 | 83 | 80 | 46 | 120 | 85 |
| rs11198877 | Imputed | A | DOM | 441 | 30 | 82 | 78 | 26 | 102 | 123 |
| rs11198942 | Imputed | T | DOM | 443 | 29 | 83 | 79 | 27 | 101 | 124 |
| rs11221075 | Imputed | A | ADD | 417 | 0 | 27 | 152 | 5 | 58 | 175 |
| rs11242020 | Imputed | T | DOM | 443 | 26 | 66 | 99 | 34 | 118 | 100 |
| rs11242021 | Imputed | T | DOM | 443 | 27 | 65 | 99 | 33 | 119 | 100 |
| rs11242022 | Imputed | T | DOM | 443 | 27 | 65 | 99 | 33 | 119 | 100 |
| rs11242023 | Imputed | T | DOM | 443 | 27 | 65 | 99 | 33 | 119 | 100 |
| rs11149349 | Imputed | T | DOM | 434 | 1 | 55 | 133 | 11 | 54 | 180 |
| rs11149350 | Imputed | A | ADD | 443 | 6 | 60 | 125 | 24 | 70 | 158 |
| rs11149350 | Imputed | A | DOM | 443 | 6 | 60 | 125 | 24 | 70 | 158 |
| rs11576627 | Imputed | T | ADD | 441 | 7 | 43 | 140 | 6 | 40 | 205 |
| rs11576627 | Imputed | T | DOM | 441 | 7 | 43 | 140 | 6 | 40 | 205 |
| rs11630050 | Imputed | G | GEN | 442 | 14 | 69 | 108 | 10 | 90 | 151 |
| rs11630050 | Imputed | G | REC | 442 | 14 | 69 | 108 | 10 | 90 | 151 |
| rs11633024 | Imputed | C | GEN | 442 | 14 | 69 | 108 | 10 | 90 | 151 |
| rs11633024 | Imputed | C | REC | 442 | 14 | 69 | 108 | 10 | 90 | 151 |
| rs11636298 | Imputed | G | GEN | 443 | 13 | 64 | 114 | 9 | 81 | 162 |
| rs11636298 | Imputed | G | REC | 443 | 13 | 64 | 114 | 9 | 81 | 162 |
| rs11637363 | Imputed | C | GEN | 420 | 14 | 65 | 105 | 10 | 84 | 142 |
| rs11637363 | Imputed | C | REC | 420 | 14 | 65 | 105 | 10 | 84 | 142 |
| rs11637813 | Imputed | A | GEN | 442 | 14 | 69 | 108 | 10 | 90 | 151 |
| rs11637813 | Imputed | A | REC | 442 | 14 | 69 | 108 | 10 | 90 | 151 |
| rs11638043 | Imputed | C | GEN | 420 | 14 | 65 | 105 | 10 | 84 | 142 |
| rs11638043 | Imputed | C | REC | 420 | 14 | 65 | 105 | 10 | 84 | 142 |

TABLE 16-continued

| | | | | | | | | |
|---|---|---|---|---|---|---|---|---|
| rs11638115 | Imputed | A | GEN | 439 | 13 | 59 | 118 | 8 | 74 | 167 |
| rs11638115 | Imputed | A | REC | 439 | 13 | 59 | 118 | 8 | 74 | 167 |
| rs11638444 | Imputed | C | GEN | 442 | 13 | 64 | 113 | 10 | 81 | 161 |
| rs11682946 | Imputed | A | ADD | 86 | 0 | 12 | 28 | 0 | 5 | 41 |
| rs11682946 | Imputed | A | DOM | 86 | 0 | 12 | 28 | 0 | 5 | 41 |
| rs11717157 | Imputed | T | ADD | 442 | 19 | 86 | 86 | 28 | 102 | 121 |
| rs11717157 | Imputed | T | GEN | 442 | 19 | 86 | 86 | 28 | 102 | 121 |
| rs11724055 | Imputed | A | DOM | 443 | 6 | 37 | 148 | 7 | 81 | 164 |
| rs11743355 | Imputed | C | ADD | 443 | 3 | 22 | 166 | 7 | 23 | 222 |
| rs11743355 | Imputed | C | DOM | 443 | 3 | 22 | 166 | 7 | 23 | 222 |
| rs11746806 | Imputed | T | ADD | 443 | 3 | 22 | 166 | 7 | 23 | 222 |
| rs11746806 | Imputed | T | DOM | 443 | 3 | 22 | 166 | 7 | 23 | 222 |
| rs11746959 | Imputed | T | ADD | 443 | 3 | 22 | 166 | 7 | 23 | 222 |
| rs11746959 | Imputed | T | DOM | 443 | 3 | 22 | 166 | 7 | 23 | 222 |
| rs11749272 | Imputed | T | DOM | 443 | 26 | 66 | 99 | 34 | 118 | 100 |
| rs11839636 | Imputed | C | GEN | 441 | 17 | 79 | 93 | 30 | 103 | 119 |
| rs11839785 | Imputed | C | GEN | 441 | 17 | 79 | 93 | 30 | 103 | 119 |
| rs11853619 | Imputed | C | REC | 440 | 13 | 63 | 114 | 9 | 80 | 161 |
| rs11853619 | Imputed | C | GEN | 440 | 13 | 63 | 114 | 9 | 80 | 161 |
| rs11856780 | Imputed | A | REC | 440 | 13 | 63 | 114 | 9 | 80 | 161 |
| rs11856780 | Imputed | A | DOM | 440 | 14 | 85 | 85 | 14 | 94 | 134 |
| rs11901899 | Imputed | C | REC | 426 | 29 | 77 | 81 | 16 | 107 | 124 |
| rs11903290 | Imputed | G | ADD | 439 | 1 | 8 | 181 | 1 | 29 | 219 |
| rs11909480 | Imputed | G | DOM | 439 | 1 | 8 | 181 | 1 | 29 | 219 |
| rs11909480 | Imputed | G | ADD | 440 | 4 | 34 | 153 | 2 | 28 | 219 |
| rs11910289 | Imputed | T | DOM | 440 | 4 | 34 | 153 | 2 | 28 | 219 |
| rs11910289 | Genotyped | C | GEN | 443 | 19 | 90 | 82 | 30 | 103 | 119 |
| rs11920375 | Imputed | G | DOM | 443 | 0 | 29 | 162 | 1 | 37 | 214 |
| rs11926319 | Imputed | T | REC | 440 | 18 | 70 | 101 | 27 | 108 | 116 |
| rs11933744 | Imputed | C | REC | 441 | 17 | 71 | 101 | 26 | 109 | 117 |
| rs11934919 | Imputed | C | REC | 441 | 17 | 71 | 101 | 26 | 109 | 117 |
| rs11934957 | Imputed | A | REC | 434 | 43 | 84 | 60 | 49 | 130 | 68 |
| rs11959206 | Imputed | C | REC | 404 | 33 | 90 | 51 | 47 | 111 | 72 |
| rs12038613 | Imputed | T | DOM | 442 | 9 | 75 | 107 | 12 | 73 | 166 |
| rs12151417 | Imputed | T | DOM | 441 | 27 | 65 | 98 | 36 | 118 | 97 |
| rs12153185 | Imputed | C | DOM | 441 | 3 | 28 | 159 | 4 | 38 | 209 |
| rs12182651 | Imputed | C | DOM | 443 | 2 | 23 | 166 | 0 | 20 | 232 |
| rs12235345 | Imputed | C | GEN | 439 | 13 | 59 | 118 | 8 | 74 | 167 |
| rs12324786 | Imputed | T | REC | 439 | 13 | 59 | 118 | 8 | 74 | 167 |
| rs12324786 | Imputed | G | DOM | 407 | 23 | 80 | 71 | 38 | 111 | 84 |
| rs12336958 | Imputed | C | ADD | 441 | 7 | 43 | 140 | 6 | 40 | 205 |
| rs12407412 | Imputed | C | DOM | 441 | 7 | 43 | 140 | 6 | 40 | 205 |
| rs12407412 | Imputed | C | GEN | 436 | 20 | 69 | 100 | 9 | 89 | 149 |
| rs12418971 | Imputed | C | REC | 436 | 20 | 69 | 100 | 9 | 89 | 149 |
| rs12418971 | Imputed | T | REC | 443 | 18 | 95 | 78 | 34 | 113 | 105 |
| rs12241967 | Imputed | T | REC | 438 | 4 | 56 | 129 | 5 | 57 | 187 |
| rs12420184 | Imputed | G | DOM | 419 | 14 | 89 | 80 | 18 | 112 | 106 |
| rs12433968 | Imputed | A | DOM | 427 | 3 | 23 | 158 | 2 | 43 | 198 |
| rs12445477 | Genotyped | T | ADD | 443 | 5 | 43 | 143 | 5 | 77 | 170 |
| rs12447191 | Genotyped | T | DOM | 443 | 5 | 43 | 143 | 5 | 77 | 170 |
| rs12447191 | Imputed | A | REC | 434 | 69 | 78 | 40 | 61 | 140 | 46 |
| rs12465349 | Imputed | C | ADD | 441 | 4 | 60 | 126 | 22 | 69 | 160 |
| rs12247340 | | | | | | | | | | |

TABLE 16-continued

| | | | | | | | | | |
|---|---|---|---|---|---|---|---|---|---|
| rs1247340 | Imputed | C | DOM | 441 | 4 | 60 | 126 | 22 | 69 | 160 |
| rs1247341 | Imputed | C | ADD | 441 | 4 | 61 | 126 | 21 | 69 | 160 |
| rs1247341 | Imputed | C | DOM | 441 | 4 | 61 | 126 | 21 | 69 | 160 |
| rs1247343 | Imputed | C | DOM | 441 | 1 | 55 | 134 | 17 | 54 | 180 |
| rs12509758 | Imputed | C | DOM | 436 | 7 | 68 | 112 | 17 | 65 | 167 |
| rs12515472 | Imputed | A | DOM | 443 | 6 | 62 | 123 | 5 | 52 | 195 |
| rs12548906 | Imputed | G | ADD | 415 | 10 | 67 | 100 | 6 | 64 | 168 |
| rs12596240 | Imputed | G | DOM | 443 | 26 | 99 | 66 | 51 | 119 | 82 |
| rs12618781 | Imputed | A | DOM | 440 | 40 | 98 | 51 | 56 | 124 | 71 |
| rs12678600 | Imputed | A | DOM | 439 | 18 | 77 | 94 | 26 | 113 | 111 |
| rs12692229 | Imputed | T | ADD | 443 | 31 | 94 | 66 | 19 | 117 | 116 |
| rs12713324 | Imputed | T | DOM | 443 | 9 | 75 | 107 | 12 | 74 | 166 |
| rs12719415 | Imputed | T | DOM | 443 | 27 | 65 | 99 | 33 | 119 | 100 |
| rs12820589 | Imputed | G | ADD | 418 | 5 | 59 | 120 | 11 | 75 | 148 |
| rs12820589 | Imputed | G | DOM | 418 | 5 | 59 | 120 | 11 | 75 | 148 |
| rs12831292 | Imputed | G | ADD | 436 | 26 | 86 | 74 | 45 | 124 | 81 |
| rs12831292 | Imputed | G | DOM | 436 | 26 | 86 | 74 | 45 | 124 | 81 |
| rs13012636 | Imputed | G | REC | 433 | 29 | 77 | 80 | 16 | 107 | 124 |
| rs13038146 | Imputed | C | ADD | 443 | 34 | 80 | 77 | 24 | 109 | 119 |
| rs13038146 | Imputed | C | GEN | 443 | 34 | 80 | 77 | 24 | 109 | 119 |
| rs13038146 | Imputed | C | REC | 443 | 34 | 80 | 77 | 24 | 109 | 119 |
| rs13089860 | Imputed | A | DOM | 364 | 39 | 63 | 61 | 50 | 97 | 54 |
| rs13102419 | Imputed | T | REC | 439 | 42 | 94 | 54 | 51 | 125 | 73 |
| rs13194907 | Imputed | A | ADD | 443 | 1 | 27 | 163 | 3 | 30 | 219 |
| rs13194907 | Imputed | A | DOM | 443 | 1 | 27 | 163 | 3 | 30 | 219 |
| rs13195745 | Imputed | A | ADD | 443 | 1 | 27 | 163 | 3 | 30 | 219 |
| rs13195745 | Imputed | A | DOM | 443 | 1 | 27 | 163 | 3 | 30 | 219 |
| rs13265054 | Imputed | T | DOM | 434 | 17 | 76 | 94 | 25 | 114 | 108 |
| rs13273002 | Imputed | A | GEN | 443 | 6 | 59 | 126 | 9 | 80 | 163 |
| rs13282131 | Imputed | C | ADD | 440 | 47 | 85 | 58 | 39 | 129 | 82 |
| rs13282131 | Imputed | C | GEN | 440 | 47 | 85 | 58 | 39 | 129 | 82 |
| rs13282131 | Imputed | C | REC | 440 | 47 | 85 | 58 | 39 | 129 | 82 |
| rs1330052 | Imputed | G | GEN | 443 | 19 | 89 | 83 | 35 | 112 | 105 |
| rs1335721 | Imputed | A | REC | 406 | 33 | 91 | 51 | 47 | 111 | 73 |
| rs1336382 | Imputed | T | DOM | 443 | 29 | 83 | 79 | 27 | 101 | 124 |
| rs1336383 | Imputed | T | DOM | 443 | 29 | 83 | 79 | 27 | 101 | 124 |
| rs1336407 | Imputed | T | DOM | 442 | 29 | 83 | 79 | 27 | 101 | 123 |
| rs1336409 | Imputed | T | DOM | 442 | 29 | 83 | 79 | 27 | 101 | 123 |
| rs1336596 | Imputed | A | DOM | 440 | 28 | 87 | 75 | 28 | 126 | 96 |
| rs13387284 | Imputed | A | DOM | 408 | 31 | 93 | 50 | 43 | 120 | 71 |
| rs13401462 | Imputed | C | DOM | 417 | 50 | 80 | 48 | 58 | 123 | 58 |
| rs13409045 | Imputed | T | ADD | 442 | 36 | 96 | 59 | 55 | 110 | 86 |
| rs1349284 | Imputed | T | GEN | 443 | 20 | 83 | 88 | 28 | 103 | 121 |
| rs1355715 | Imputed | T | ADD | 442 | 0 | 18 | 173 | 1 | 31 | 219 |
| rs1357696 | Imputed | A | GEN | 434 | 19 | 93 | 75 | 31 | 105 | 111 |
| rs1357698 | Imputed | G | GEN | 436 | 20 | 93 | 75 | 32 | 105 | 111 |
| rs1357699 | Imputed | G | GEN | 436 | 20 | 93 | 75 | 32 | 105 | 111 |
| rs1363273 | Imputed | C | REC | 421 | 43 | 90 | 50 | 58 | 122 | 58 |
| rs1373601 | Imputed | A | DOM | 404 | 26 | 80 | 64 | 27 | 120 | 87 |
| rs1375829 | Imputed | C | GEN | 443 | 20 | 83 | 88 | 28 | 103 | 121 |
| rs1395748 | Imputed | A | DOM | 441 | 17 | 89 | 85 | 23 | 104 | 123 |
| rs1414865 | Imputed | T | DOM | 442 | 29 | 84 | 78 | 29 | 100 | 122 |
| rs1414873 | Imputed | A | DOM | 442 | 29 | 83 | 79 | 27 | 101 | 123 |

TABLE 16-continued

| | | | | | | | | |
|---|---|---|---|---|---|---|---|---|
| rs1414876 | Imputed | C | DOM | 442 | 29 | 83 | 79 | 27 | 101 | 123 |
| rs1424643 | Imputed | G | ADD | 430 | 11 | 74 | 99 | 13 | 69 | 164 |
| rs1424643 | Imputed | G | DOM | 430 | 11 | 74 | 99 | 13 | 69 | 164 |
| rs1424648 | Imputed | T | DOM | 438 | 11 | 74 | 105 | 12 | 71 | 165 |
| rs1429321 | Imputed | A | DOM | 432 | 10 | 72 | 105 | 12 | 71 | 162 |
| rs1429326 | Imputed | T | ADD | 433 | 9 | 70 | 109 | 10 | 67 | 168 |
| rs1429326 | Imputed | T | DOM | 433 | 9 | 70 | 109 | 10 | 67 | 168 |
| rs1444741 | Imputed | A | DOM | 407 | 24 | 79 | 68 | 22 | 119 | 95 |
| rs1449916 | Imputed | C | DOM | 270 | 33 | 53 | 32 | 44 | 75 | 33 |
| rs1459523 | Imputed | A | ADD | 442 | 19 | 86 | 86 | 28 | 102 | 121 |
| rs1459523 | Imputed | A | GEN | 442 | 19 | 86 | 86 | 28 | 102 | 121 |
| rs1466352 | Imputed | T | GEN | 443 | 20 | 91 | 80 | 30 | 105 | 117 |
| rs1466353 | Imputed | G | GEN | 443 | 20 | 91 | 80 | 30 | 105 | 117 |
| rs1476714 | Imputed | A | DOM | 439 | 27 | 65 | 98 | 33 | 118 | 98 |
| rs1486723 | Imputed | C | REC | 434 | 17 | 90 | 78 | 37 | 122 | 90 |
| rs1495375 | Imputed | A | ADD | 421 | 26 | 86 | 73 | 45 | 116 | 75 |
| rs1495375 | Imputed | A | DOM | 421 | 26 | 86 | 73 | 45 | 116 | 75 |
| rs1495381 | Imputed | T | GEN | 442 | 35 | 95 | 60 | 25 | 126 | 101 |
| rs1495381 | Imputed | T | REC | 442 | 35 | 95 | 60 | 25 | 126 | 101 |
| rs1498061 | Imputed | C | ADD | 200 | 1 | 22 | 60 | 8 | 36 | 73 |
| rs1498992 | Imputed | G | DOM | 428 | 22 | 75 | 87 | 34 | 113 | 97 |
| rs1499001 | Imputed | T | DOM | 437 | 16 | 66 | 105 | 24 | 102 | 124 |
| rs1512988 | Imputed | A | ADD | 442 | 26 | 86 | 78 | 45 | 121 | 86 |
| rs1512988 | Imputed | A | DOM | 442 | 26 | 86 | 78 | 45 | 121 | 86 |
| rs1512989 | Imputed | T | ADD | 442 | 26 | 86 | 78 | 45 | 121 | 86 |
| rs1512989 | Imputed | T | DOM | 442 | 26 | 86 | 78 | 45 | 121 | 86 |
| rs1512991 | Imputed | T | ADD | 425 | 30 | 89 | 64 | 63 | 113 | 66 |
| rs1512991 | Imputed | T | DOM | 425 | 30 | 89 | 64 | 63 | 113 | 66 |
| rs1512991 | Imputed | T | GEN | 425 | 30 | 89 | 64 | 63 | 113 | 66 |
| rs1524303 | Imputed | T | GEN | 436 | 19 | 86 | 83 | 28 | 101 | 119 |
| rs1524306 | Imputed | C | ADD | 441 | 19 | 86 | 86 | 28 | 102 | 120 |
| rs1524306 | Imputed | C | GEN | 441 | 19 | 86 | 86 | 28 | 102 | 120 |
| rs1524310 | Imputed | G | ADD | 438 | 19 | 85 | 86 | 27 | 101 | 120 |
| rs1524310 | Imputed | G | GEN | 438 | 19 | 85 | 86 | 27 | 101 | 120 |
| rs1524321 | Imputed | C | GEN | 441 | 20 | 91 | 80 | 28 | 105 | 117 |
| rs1527059 | Imputed | A | DOM | 441 | 1 | 24 | 165 | 0 | 62 | 189 |
| rs152707 | Imputed | A | ADD | 443 | 34 | 94 | 63 | 43 | 119 | 90 |
| rs152707 | Imputed | A | GEN | 443 | 34 | 94 | 63 | 43 | 119 | 90 |
| rs152712 | Genotyped | C | ADD | 443 | 34 | 94 | 63 | 43 | 119 | 90 |
| rs152712 | Genotyped | C | GEN | 443 | 34 | 94 | 63 | 43 | 119 | 90 |
| rs1533994 | Imputed | T | ADD | 443 | 20 | 91 | 80 | 30 | 105 | 117 |
| rs1535866 | Imputed | G | DOM | 440 | 7 | 72 | 111 | 14 | 71 | 165 |
| rs1563773 | Imputed | T | GEN | 439 | 20 | 90 | 79 | 30 | 105 | 115 |
| rs1563774 | Imputed | T | GEN | 439 | 20 | 90 | 77 | 45 | 121 | 115 |
| rs1567740 | Imputed | A | ADD | 439 | 26 | 87 | 77 | 45 | 121 | 83 |
| rs1567740 | Imputed | T | DOM | 439 | 26 | 87 | 80 | 30 | 105 | 83 |
| rs1575573 | Imputed | A | DOM | 396 | 2 | 61 | 110 | 3 | 78 | 142 |
| rs1577497 | Imputed | C | REC | 408 | 33 | 91 | 52 | 47 | 112 | 73 |
| rs1581514 | Imputed | A | ADD | 429 | 19 | 86 | 80 | 28 | 101 | 115 |
| rs1581514 | Imputed | T | GEN | 429 | 19 | 86 | 80 | 28 | 101 | 115 |
| rs1582321 | Imputed | T | DOM | 443 | 26 | 99 | 66 | 51 | 119 | 82 |
| rs1582322 | Imputed | A | DOM | 438 | 26 | 98 | 66 | 49 | 119 | 80 |
| rs1582323 | Imputed | A | DOM | 437 | 26 | 98 | 66 | 48 | 119 | 80 |

TABLE 16-continued

| | | | | | | | | | |
|---|---|---|---|---|---|---|---|---|---|
| rs1592485 | Imputed | C | DOM | 443 | 32 | 95 | 64 | 58 | 116 | 78 |
| rs1600954 | Imputed | T | ADD | 423 | 47 | 92 | 46 | 52 | 114 | 72 |
| rs1600954 | Imputed | T | GEN | 423 | 47 | 92 | 46 | 52 | 114 | 72 |
| rs6938626 | Imputed | G | DOM | 435 | 15 | 63 | 109 | 19 | 100 | 129 |
| rs6964300 | Imputed | G | ADD | 439 | 6 | 43 | 140 | 5 | 80 | 165 |
| rs6964300 | Imputed | G | DOM | 439 | 6 | 43 | 140 | 5 | 80 | 165 |
| rs6986282 | Imputed | G | ADD | 442 | 1 | 8 | 182 | 1 | 29 | 221 |
| rs7007620 | Imputed | G | DOM | 408 | 7 | 66 | 104 | 13 | 75 | 143 |
| rs7007620 | Imputed | G | ADD | 408 | 7 | 66 | 104 | 13 | 75 | 143 |
| rs7014326 | Imputed | G | DOM | 441 | 16 | 88 | 87 | 24 | 101 | 125 |
| rs7047957 | Imputed | C | DOM | 439 | 7 | 64 | 118 | 7 | 56 | 187 |
| rs705261 | Imputed | A | REC | 442 | 37 | 93 | 60 | 28 | 125 | 99 |
| rs7073341 | Imputed | A | ADD | 441 | 1 | 17 | 172 | 1 | 10 | 240 |
| rs7073341 | Imputed | A | DOM | 441 | 1 | 17 | 172 | 1 | 10 | 240 |
| rs7138702 | Imputed | G | ADD | 443 | 9 | 45 | 137 | 6 | 62 | 184 |
| rs7189710 | Imputed | T | ADD | 430 | 33 | 77 | 75 | 23 | 108 | 114 |
| rs7189710 | Imputed | T | GEN | 430 | 33 | 77 | 75 | 23 | 108 | 114 |
| rs7189710 | Imputed | T | REC | 430 | 33 | 77 | 75 | 23 | 108 | 114 |
| rs7310176 | Imputed | T | ADD | 443 | 4 | 43 | 144 | 9 | 79 | 164 |
| rs7310176 | Imputed | T | DOM | 443 | 4 | 43 | 144 | 9 | 79 | 164 |
| rs17358860 | Imputed | A | DOM | 416 | 9 | 38 | 134 | 9 | 83 | 143 |
| rs17370541 | Imputed | T | GEN | 397 | 24 | 85 | 64 | 28 | 113 | 83 |
| rs17370541 | Imputed | T | REC | 397 | 24 | 85 | 64 | 28 | 113 | 83 |
| rs17526574 | Imputed | G | GEN | 443 | 19 | 79 | 93 | 30 | 103 | 119 |
| rs17530747 | Imputed | C | DOM | 374 | 14 | 82 | 64 | 18 | 106 | 90 |
| rs17649114 | Imputed | T | ADD | 440 | 12 | 63 | 114 | 10 | 59 | 182 |
| rs17766172 | Imputed | A | REC | 428 | 17 | 84 | 81 | 38 | 102 | 106 |
| rs1818885 | Imputed | G | GEN | 443 | 19 | 86 | 86 | 28 | 103 | 121 |
| rs1832222 | Imputed | G | DOM | 443 | 29 | 83 | 79 | 27 | 102 | 123 |
| rs1861327 | Imputed | G | DOM | 433 | 26 | 98 | 64 | 51 | 116 | 78 |
| rs1868581 | Imputed | G | ADD | 436 | 19 | 83 | 86 | 28 | 101 | 119 |
| rs1868581 | Imputed | G | GEN | 436 | 19 | 83 | 86 | 28 | 101 | 119 |
| rs1874313 | Imputed | A | ADD | 443 | 26 | 87 | 78 | 45 | 121 | 86 |
| rs1874313 | Imputed | A | DOM | 443 | 26 | 87 | 78 | 45 | 121 | 86 |
| rs1876409 | Imputed | C | DOM | 443 | 17 | 89 | 85 | 25 | 104 | 123 |
| rs1913201 | Imputed | G | ADD | 432 | 30 | 90 | 65 | 63 | 116 | 68 |
| rs1913201 | Imputed | G | DOM | 432 | 30 | 90 | 65 | 63 | 116 | 68 |
| rs1913201 | Imputed | G | GEN | 432 | 30 | 90 | 65 | 63 | 116 | 68 |
| rs1916922 | Imputed | T | DOM | 435 | 19 | 83 | 86 | 27 | 101 | 119 |
| rs1936871 | Genotyped | G | DOM | 443 | 40 | 86 | 65 | 49 | 129 | 74 |
| rs1961157 | Imputed | T | REC | 442 | 41 | 96 | 54 | 48 | 131 | 72 |
| rs1987179 | Imputed | T | ADD | 417 | 6 | 37 | 139 | 7 | 81 | 147 |
| rs1987179 | Imputed | T | DOM | 417 | 6 | 37 | 139 | 7 | 81 | 147 |
| rs1990023 | Imputed | C | DOM | 443 | 26 | 66 | 99 | 34 | 118 | 100 |
| rs1995025 | Imputed | C | DOM | 433 | 4 | 61 | 121 | 2 | 57 | 188 |
| rs2016194 | Imputed | G | DOM | 443 | 27 | 65 | 99 | 33 | 119 | 100 |
| rs2023651 | Imputed | G | ADD | 429 | 13 | 62 | 109 | 14 | 72 | 159 |
| rs2024902 | Imputed | A | ADD | 442 | 1 | 27 | 163 | 3 | 30 | 218 |
| rs2024902 | Imputed | A | DOM | 442 | 1 | 27 | 163 | 3 | 30 | 218 |
| rs2025107 | Imputed | A | DOM | 442 | 3 | 28 | 159 | 4 | 38 | 210 |
| rs2025108 | Imputed | A | DOM | 442 | 3 | 28 | 159 | 4 | 38 | 210 |
| rs2031987 | Imputed | T | GEN | 443 | 19 | 79 | 93 | 30 | 103 | 119 |
| rs2052428 | Imputed | C | DOM | 427 | 46 | 79 | 60 | 58 | 122 | 62 |

TABLE 16-continued

| | | | | | | | | | |
|---|---|---|---|---|---|---|---|---|---|
| rs2053230 | Imputed | C | ADD | 391 | 0 | 61 | 109 | 2 | 86 | 133 |
| rs2062448 | Imputed | T | DOM | 442 | 0 | 28 | 162 | 0 | 40 | 212 |
| rs2063420 | Imputed | C | REC | 442 | 32 | 101 | 57 | 47 | 128 | 77 |
| rs2063591 | Imputed | C | ADD | 441 | 36 | 92 | 63 | 69 | 117 | 64 |
| rs2063591 | Imputed | C | DOM | 441 | 36 | 92 | 63 | 69 | 117 | 64 |
| rs208026 | Genotyped | A | DOM | 443 | 8 | 81 | 102 | 11 | 79 | 162 |
| rs208029 | Imputed | T | DOM | 422 | 7 | 75 | 101 | 10 | 60 | 169 |
| rs208757 | Imputed | G | DOM | 435 | 8 | 73 | 108 | 10 | 60 | 176 |
| rs2095586 | Imputed | A | DOM | 442 | 28 | 84 | 79 | 25 | 103 | 123 |
| rs2095606 | Imputed | A | DOM | 436 | 27 | 90 | 70 | 28 | 132 | 89 |
| rs2102374 | Imputed | A | ADD | 437 | 13 | 87 | 90 | 16 | 104 | 127 |
| rs2102374 | Imputed | A | DOM | 437 | 13 | 87 | 90 | 16 | 104 | 127 |
| rs2108426 | Imputed | C | DOM | 443 | 27 | 65 | 99 | 33 | 119 | 100 |
| rs2110664 | Imputed | A | DOM | 399 | 14 | 77 | 81 | 16 | 83 | 128 |
| rs2132242 | Imputed | A | ADD | 440 | 26 | 88 | 76 | 45 | 125 | 80 |
| rs2132242 | Imputed | A | DOM | 440 | 26 | 88 | 76 | 45 | 125 | 80 |
| rs2158958 | Imputed | A | DOM | 443 | 27 | 65 | 99 | 33 | 119 | 100 |
| rs2158961 | Imputed | A | DOM | 443 | 20 | 67 | 104 | 23 | 120 | 109 |
| rs2163046 | Imputed | A | DOM | 436 | 9 | 75 | 105 | 12 | 72 | 163 |
| rs2180286 | Imputed | G | DOM | 443 | 49 | 82 | 60 | 69 | 130 | 53 |
| rs2180684 | Imputed | A | DOM | 433 | 3 | 49 | 134 | 5 | 37 | 205 |
| rs2188079 | Imputed | C | ADD | 443 | 39 | 92 | 60 | 43 | 133 | 76 |
| rs2188079 | Imputed | C | GEN | 443 | 39 | 92 | 60 | 43 | 133 | 76 |
| rs2190598 | Imputed | T | DOM | 443 | 27 | 65 | 99 | 33 | 119 | 100 |
| rs2190600 | Imputed | A | DOM | 440 | 27 | 65 | 98 | 35 | 118 | 97 |
| rs2224184 | Genotyped | T | DOM | 443 | 49 | 82 | 60 | 68 | 131 | 53 |
| rs2247066 | Imputed | A | DOM | 441 | 17 | 89 | 85 | 23 | 104 | 123 |
| rs2248236 | Imputed | C | ADD | 443 | 9 | 47 | 135 | 9 | 100 | 143 |
| rs2248236 | Imputed | C | DOM | 443 | 9 | 47 | 135 | 9 | 100 | 143 |
| rs2265733 | Imputed | C | ADD | 437 | 13 | 87 | 90 | 16 | 104 | 127 |
| rs2265733 | Imputed | C | DOM | 437 | 13 | 87 | 90 | 16 | 104 | 127 |
| rs2270584 | Imputed | A | DOM | 441 | 26 | 83 | 81 | 46 | 120 | 85 |
| rs2270584 | Imputed | A | DOM | 441 | 26 | 83 | 81 | 46 | 120 | 85 |
| rs2270586 | Imputed | A | ADD | 442 | 26 | 84 | 81 | 46 | 120 | 85 |
| rs2270586 | Imputed | A | DOM | 442 | 26 | 84 | 81 | 46 | 120 | 85 |
| rs229775 | Imputed | A | REC | 443 | 18 | 78 | 95 | 34 | 113 | 105 |
| rs229815 | Imputed | T | REC | 432 | 20 | 64 | 103 | 39 | 109 | 97 |
| rs229829 | Imputed | C | REC | 413 | 19 | 59 | 97 | 41 | 103 | 94 |
| rs229831 | Imputed | A | REC | 441 | 17 | 77 | 96 | 34 | 113 | 104 |
| rs2317057 | Imputed | T | ADD | 368 | 4 | 47 | 112 | 11 | 81 | 113 |
| rs2322100 | Genotyped | A | REC | 443 | 20 | 71 | 100 | 11 | 95 | 146 |
| rs2322101 | Imputed | A | REC | 440 | 20 | 71 | 98 | 11 | 95 | 145 |
| rs2327929 | Imputed | G | ADD | 441 | 42 | 87 | 62 | 43 | 121 | 86 |
| rs2332844 | Imputed | A | ADD | 282 | 89 | 28 | 3 | 110 | 49 | 3 |
| rs2332844 | Imputed | A | REC | 282 | 89 | 28 | 3 | 110 | 49 | 3 |
| rs2349170 | Imputed | G | DOM | 443 | 18 | 68 | 105 | 14 | 78 | 160 |
| rs2356722 | Imputed | G | DOM | 443 | 16 | 88 | 87 | 23 | 101 | 128 |
| rs2364956 | Imputed | T | ADD | 415 | 5 | 51 | 122 | 10 | 50 | 177 |
| rs2373793 | Imputed | G | ADD | 435 | 6 | 54 | 130 | 3 | 52 | 190 |
| rs2373793 | Imputed | G | DOM | 435 | 6 | 54 | 130 | 3 | 52 | 190 |
| rs238252 | Imputed | G | ADD | 434 | 3 | 48 | 137 | 4 | 54 | 188 |
| rs238252 | Imputed | G | DOM | 434 | 3 | 48 | 137 | 4 | 54 | 188 |
| rs2383903 | Imputed | G | DOM | 443 | 15 | 64 | 112 | 19 | 102 | 131 |

TABLE 16-continued

| | | | | | | | | |
|---|---|---|---|---|---|---|---|---|
| rs2387945 | Imputed | G | DOM | 436 | 4 | 62 | 122 | 2 | 57 | 189 |
| rs2389863 | Imputed | A | DOM | 432 | 9 | 46 | 131 | 9 | 96 | 141 |
| rs2389866 | Imputed | C | DOM | 443 | 9 | 47 | 135 | 9 | 100 | 143 |
| rs2389869 | Imputed | C | DOM | 443 | 9 | 47 | 135 | 9 | 100 | 143 |
| rs2389870 | Genotyped | C | DOM | 443 | 6 | 38 | 147 | 7 | 84 | 161 |
| rs2418494 | Imputed | G | ADD | 423 | 40 | 98 | 43 | 79 | 122 | 41 |
| rs2418494 | Imputed | G | GEN | 423 | 40 | 98 | 43 | 79 | 122 | 41 |
| rs2418541 | Imputed | A | DOM | 443 | 26 | 66 | 99 | 34 | 118 | 100 |
| rs2418542 | Imputed | A | DOM | 443 | 26 | 66 | 99 | 34 | 118 | 100 |
| rs2423556 | Imputed | C | DOM | 433 | 49 | 77 | 56 | 69 | 130 | 52 |
| rs2437688 | Imputed | C | ADD | 443 | 3 | 46 | 142 | 0 | 38 | 214 |
| rs2456809 | Imputed | G | DOM | 438 | 17 | 87 | 84 | 25 | 104 | 121 |
| rs2456811 | Imputed | T | ADD | 436 | 13 | 87 | 89 | 16 | 104 | 127 |
| rs2456811 | Imputed | T | DOM | 436 | 13 | 87 | 89 | 16 | 104 | 127 |
| rs2476976 | Imputed | C | DOM | 442 | 27 | 85 | 79 | 26 | 100 | 125 |
| rs2484911 | Imputed | A | DOM | 443 | 26 | 78 | 87 | 22 | 96 | 134 |
| rs2488557 | Imputed | C | DOM | 431 | 0 | 45 | 141 | 5 | 57 | 183 |
| rs250162 | Imputed | C | ADD | 429 | 5 | 62 | 119 | 11 | 103 | 129 |
| rs250162 | Imputed | C | DOM | 429 | 5 | 62 | 119 | 11 | 103 | 129 |
| rs2560708 | Imputed | C | ADD | 436 | 5 | 48 | 137 | 10 | 75 | 161 |
| rs2617841 | Imputed | T | DOM | 412 | 14 | 56 | 106 | 14 | 97 | 125 |
| rs2622499 | Imputed | G | DOM | 443 | 9 | 47 | 135 | 9 | 100 | 143 |
| rs264129 | Imputed | G | DOM | 443 | 20 | 67 | 104 | 23 | 120 | 109 |
| rs2642936 | Imputed | T | ADD | 428 | 6 | 58 | 119 | 6 | 83 | 156 |
| rs2660633 | Imputed | A | DOM | 443 | 17 | 89 | 85 | 25 | 104 | 123 |
| rs2660634 | Imputed | C | DOM | 443 | 17 | 89 | 85 | 25 | 104 | 123 |
| rs2660648 | Imputed | A | DOM | 437 | 13 | 87 | 90 | 16 | 104 | 127 |
| rs2660648 | Imputed | A | DOM | 437 | 13 | 87 | 90 | 16 | 104 | 127 |
| rs2681505 | Imputed | T | ADD | 443 | 7 | 66 | 118 | 12 | 93 | 147 |
| rs277411 | Imputed | G | DOM | 442 | 0 | 17 | 173 | 0 | 22 | 230 |
| rs2832634 | Imputed | G | DOM | 442 | 4 | 34 | 153 | 2 | 29 | 220 |
| rs2832637 | Imputed | T | ADD | 442 | 4 | 34 | 153 | 2 | 29 | 220 |
| rs2843167 | Imputed | A | DOM | 442 | 16 | 84 | 91 | 23 | 103 | 125 |
| rs2876227 | Imputed | C | ADD | 442 | 33 | 82 | 76 | 23 | 111 | 117 |
| rs2876227 | Imputed | C | GEN | 442 | 33 | 82 | 76 | 23 | 111 | 117 |
| rs2882097 | Imputed | A | DOM | 443 | 29 | 83 | 79 | 27 | 101 | 124 |
| rs2909862 | Imputed | G | DOM | 416 | 29 | 92 | 59 | 31 | 126 | 79 |
| rs3001945 | Imputed | T | DOM | 435 | 4 | 61 | 122 | 2 | 57 | 189 |
| rs3011020 | Imputed | C | DOM | 436 | 4 | 62 | 122 | 2 | 57 | 189 |
| rs36071725 | Genotyped | C | ADD | 443 | 16 | 88 | 87 | 26 | 110 | 116 |
| rs36071725 | Genotyped | C | GEN | 443 | 16 | 88 | 87 | 26 | 110 | 116 |
| rs373983 | Imputed | G | DOM | 414 | 31 | 104 | 48 | 38 | 98 | 95 |
| rs3743794 | Imputed | C | DOM | 434 | 26 | 97 | 65 | 47 | 120 | 79 |
| rs3756154 | Imputed | C | ADD | 416 | 6 | 38 | 138 | 7 | 83 | 144 |
| rs3756154 | Imputed | C | DOM | 416 | 6 | 38 | 138 | 7 | 83 | 144 |
| rs3775850 | Imputed | A | DOM | 443 | 6 | 37 | 148 | 7 | 81 | 164 |
| rs3775851 | Imputed | C | DOM | 443 | 6 | 37 | 148 | 7 | 81 | 164 |
| rs3793044 | Imputed | C | ADD | 443 | 1 | 27 | 163 | 3 | 30 | 219 |
| rs3793053 | Imputed | C | DOM | 443 | 3 | 27 | 163 | 3 | 30 | 219 |
| rs3796246 | Imputed | C | DOM | 436 | 0 | 27 | 158 | 4 | 36 | 208 |
| rs3806003 | Imputed | A | ADD | 442 | 1 | 29 | 162 | 1 | 38 | 212 |
| rs3806003 | Imputed | A | DOM | 443 | 1 | 27 | 163 | 3 | 30 | 219 |
| rs3806003 | Imputed | A | DOM | 443 | 1 | 27 | 163 | 3 | 30 | 219 |

TABLE 16-continued

| rs ID | Status | Allele | Model | N1 | N2 | N3 | N4 | N5 | N6 |
|---|---|---|---|---|---|---|---|---|---|
| rs3806004 | Imputed | T | DOM | 442 | 3 | 28 | 159 | 4 | 38 | 210 |
| rs3806010 | Imputed | T | DOM | 442 | 3 | 28 | 159 | 4 | 38 | 210 |
| rs3806014 | Imputed | T | DOM | 430 | 3 | 27 | 153 | 4 | 37 | 206 |
| rs3806015 | Imputed | A | DOM | 426 | 3 | 27 | 152 | 4 | 37 | 203 |
| rs3806018 | Imputed | A | DOM | 442 | 3 | 28 | 159 | 4 | 38 | 210 |
| rs3806019 | Imputed | T | DOM | 438 | 3 | 28 | 158 | 4 | 38 | 207 |
| rs3806024 | Imputed | A | DOM | 442 | 4 | 28 | 159 | 4 | 38 | 209 |
| rs3915080 | Imputed | T | GEN | 436 | 20 | 93 | 75 | 32 | 105 | 111 |
| rs3942254 | Imputed | T | ADD | 420 | 26 | 74 | 78 | 45 | 113 | 84 |
| rs3942254 | Imputed | T | DOM | 420 | 26 | 74 | 78 | 45 | 113 | 84 |
| rs3945085 | Imputed | A | DOM | 441 | 31 | 81 | 79 | 29 | 99 | 122 |
| rs3976737 | Imputed | G | ADD | 377 | 9 | 41 | 108 | 4 | 61 | 154 |
| rs399485 | Imputed | A | DOM | 437 | 10 | 91 | 89 | 15 | 86 | 146 |
| rs4029119 | Imputed | G | ADD | 443 | 3 | 22 | 166 | 7 | 23 | 222 |
| rs4029119 | Imputed | G | DOM | 443 | 3 | 22 | 166 | 7 | 23 | 222 |
| rs4076201 | Imputed | G | GEN | 420 | 14 | 65 | 105 | 10 | 84 | 142 |
| rs4076201 | Imputed | G | REC | 420 | 14 | 65 | 105 | 10 | 84 | 142 |
| rs41395945 | Imputed | G | ADD | 441 | 4 | 34 | 153 | 2 | 28 | 220 |
| rs41395945 | Imputed | G | DOM | 441 | 4 | 34 | 153 | 2 | 28 | 220 |
| rs41146972 | Genotyped | T | DOM | 443 | 7 | 66 | 118 | 7 | 57 | 188 |
| rs4238087 | Imputed | G | DOM | 402 | 4 | 26 | 140 | 4 | 59 | 169 |
| rs4251569 | Imputed | T | ADD | 441 | 4 | 28 | 159 | 4 | 62 | 184 |
| rs4251569 | Imputed | T | DOM | 441 | 4 | 28 | 159 | 4 | 62 | 184 |
| rs4273613 | Imputed | T | ADD | 443 | 3 | 22 | 166 | 7 | 23 | 222 |
| rs4273613 | Imputed | T | DOM | 443 | 3 | 22 | 166 | 7 | 23 | 222 |
| rs4291049 | Imputed | T | REC | 432 | 42 | 84 | 58 | 50 | 130 | 68 |
| rs4315598 | Imputed | T | ADD | 443 | 34 | 80 | 77 | 24 | 109 | 119 |
| rs4315598 | Imputed | T | GEN | 443 | 34 | 80 | 77 | 24 | 109 | 119 |
| rs4315598 | Imputed | T | REC | 443 | 34 | 80 | 77 | 24 | 109 | 119 |
| rs4321395 | Imputed | A | DOM | 408 | 31 | 93 | 50 | 43 | 120 | 71 |
| rs4321596 | Genotyped | T | REC | 443 | 16 | 66 | 109 | 10 | 82 | 160 |
| rs4324417 | Imputed | T | DOM | 443 | 54 | 84 | 53 | 60 | 119 | 73 |
| rs4328619 | Genotyped | G | DOM | 443 | 41 | 78 | 72 | 45 | 140 | 67 |
| rs4338909 | Imputed | T | ADD | 440 | 40 | 84 | 65 | 52 | 113 | 86 |
| rs4370878 | Imputed | G | DOM | 443 | 29 | 82 | 79 | 27 | 101 | 122 |
| rs4379434 | Genotyped | T | DOM | 440 | 39 | 85 | 67 | 46 | 118 | 88 |
| rs4416407 | Imputed | T | DOM | 443 | 70 | 79 | 39 | 81 | 101 | 67 |
| rs4417899 | Imputed | C | REC | 437 | 39 | 79 | 70 | 67 | 101 | 81 |
| rs4442732 | Imputed | A | ADD | 335 | 19 | 54 | 65 | 26 | 84 | 87 |
| rs4444612 | Imputed | G | ADD | 443 | 34 | 80 | 77 | 24 | 109 | 119 |
| rs4444612 | Imputed | G | GEN | 443 | 34 | 80 | 77 | 24 | 109 | 119 |
| rs4450660 | Imputed | C | REC | 438 | 11 | 78 | 101 | 21 | 81 | 146 |
| rs4509702 | Imputed | C | DOM | 440 | 29 | 82 | 79 | 27 | 101 | 122 |
| rs4526920 | Imputed | C | DOM | 443 | 19 | 79 | 93 | 30 | 103 | 119 |
| rs4533145 | Imputed | T | DOM | 441 | 2 | 54 | 133 | 3 | 45 | 204 |
| rs4557006 | Imputed | A | REC | 401 | 31 | 93 | 50 | 43 | 115 | 69 |
| rs4570530 | Imputed | C | ADD | 440 | 29 | 82 | 79 | 27 | 101 | 122 |
| rs4615971 | Imputed | C | DOM | 440 | 28 | 83 | 79 | 26 | 101 | 123 |
| rs4628119 | Imputed | A | DOM | 442 | 10 | 66 | 115 | 16 | 82 | 153 |
| rs4664443 | Imputed | C | ADD | 442 | 36 | 96 | 59 | 55 | 110 | 86 |
| rs4688259 | Imputed | T | DOM | 438 | 70 | 79 | 39 | 81 | 102 | 67 |
| rs4688632 | Imputed | G | REC | 429 | 38 | 79 | 68 | 68 | 98 | 78 |

TABLE 16-continued

| SNP | Status | Allele | Model | | | | | | |
|---|---|---|---|---|---|---|---|---|---|
| rs4695284 | Imputed | A | ADD | 194 | 0 | 16 | 60 | 1 | 16 | 101 |
| rs4700302 | Imputed | A | ADD | 399 | 1 | 33 | 139 | 2 | 36 | 188 |
| rs4702720 | Imputed | A | ADD | 359 | 10 | 48 | 97 | 12 | 85 | 107 |
| rs4702720 | Imputed | A | DOM | 359 | 10 | 48 | 97 | 12 | 85 | 107 |
| rs4711091 | Genotyped | G | GEN | 443 | 37 | 102 | 52 | 61 | 125 | 66 |
| rs4714484 | Imputed | A | ADD | 439 | 3 | 49 | 137 | 5 | 73 | 172 |
| rs4736802 | Imputed | G | DOM | 442 | 39 | 84 | 67 | 46 | 118 | 88 |
| rs4760785 | Imputed | A | ADD | 432 | 30 | 90 | 65 | 63 | 116 | 68 |
| rs4760785 | Imputed | A | DOM | 432 | 30 | 90 | 65 | 63 | 116 | 68 |
| rs4760894 | Imputed | T | GEN | 432 | 30 | 90 | 65 | 63 | 116 | 68 |
| rs4760894 | Imputed | T | ADD | 432 | 30 | 90 | 65 | 63 | 116 | 68 |
| rs4760894 | Imputed | T | DOM | 432 | 30 | 90 | 65 | 63 | 116 | 68 |
| rs4760895 | Imputed | A | GEN | 432 | 30 | 90 | 65 | 63 | 116 | 68 |
| rs4760895 | Imputed | A | ADD | 432 | 30 | 90 | 65 | 63 | 116 | 68 |
| rs4760895 | Imputed | A | DOM | 432 | 30 | 90 | 65 | 63 | 116 | 68 |
| rs4764738 | Imputed | A | GEN | 430 | 55 | 88 | 44 | 70 | 122 | 51 |
| rs4764738 | Imputed | A | ADD | 430 | 55 | 88 | 44 | 70 | 122 | 51 |
| rs4764974 | Imputed | T | ADD | 431 | 44 | 93 | 48 | 67 | 121 | 58 |
| rs4764974 | Imputed | T | GEN | 431 | 44 | 93 | 48 | 67 | 121 | 58 |
| rs4798366 | Imputed | G | REC | 429 | 25 | 73 | 89 | 13 | 110 | 119 |
| rs483159 | Imputed | T | DOM | 386 | 4 | 66 | 94 | 6 | 55 | 161 |
| rs4836502 | Imputed | T | DOM | 443 | 27 | 65 | 99 | 33 | 119 | 100 |
| rs4836507 | Imputed | C | DOM | 442 | 27 | 66 | 98 | 35 | 119 | 97 |
| rs4836744 | Imputed | A | ADD | 443 | 13 | 76 | 102 | 25 | 119 | 108 |
| rs4836744 | Imputed | A | DOM | 443 | 13 | 76 | 102 | 25 | 119 | 108 |
| rs4848944 | Genotyped | C | REC | 443 | 35 | 89 | 67 | 61 | 131 | 60 |
| rs4851529 | Imputed | A | DOM | 442 | 34 | 79 | 77 | 49 | 127 | 73 |
| rs4851531 | Imputed | T | DOM | 442 | 36 | 81 | 74 | 57 | 124 | 70 |
| rs4858046 | Genotyped | T | GEN | 443 | 20 | 91 | 80 | 30 | 105 | 117 |
| rs4878214 | Imputed | A | ADD | 261 | 11 | 40 | 65 | 22 | 53 | 70 |
| rs4880803 | Imputed | A | ADD | 439 | 13 | 73 | 104 | 32 | 110 | 107 |
| rs489441 | Imputed | A | ADD | 409 | 11 | 78 | 85 | 16 | 87 | 132 |
| rs489441 | Imputed | A | DOM | 409 | 11 | 78 | 85 | 16 | 87 | 132 |
| rs4896568 | Imputed | G | DOM | 410 | 10 | 62 | 104 | 16 | 78 | 140 |
| rs4938851 | Imputed | T | DOM | 443 | 13 | 66 | 112 | 11 | 61 | 180 |
| rs4964416 | Imputed | C | DOM | 443 | 52 | 80 | 59 | 61 | 131 | 60 |
| rs5756669 | Imputed | C | DOM | 443 | 54 | 84 | 53 | 60 | 119 | 73 |
| rs6033138 | Imputed | C | GEN | 443 | 34 | 80 | 77 | 24 | 109 | 119 |
| rs6033138 | Imputed | C | REC | 443 | 34 | 80 | 77 | 24 | 109 | 119 |
| rs6040619 | Imputed | C | ADD | 439 | 34 | 80 | 73 | 24 | 109 | 118 |
| rs6040619 | Imputed | C | GEN | 439 | 34 | 81 | 73 | 24 | 109 | 118 |
| rs6040619 | Imputed | C | REC | 439 | 34 | 81 | 73 | 24 | 109 | 118 |
| rs6040625 | Imputed | T | ADD | 442 | 34 | 82 | 75 | 24 | 109 | 118 |
| rs6040625 | Imputed | T | GEN | 442 | 34 | 82 | 75 | 24 | 109 | 118 |
| rs6040625 | Imputed | T | REC | 442 | 34 | 82 | 75 | 24 | 109 | 118 |
| rs6040630 | Imputed | A | ADD | 441 | 34 | 80 | 76 | 24 | 108 | 119 |
| rs6040630 | Imputed | A | GEN | 441 | 34 | 80 | 76 | 24 | 108 | 119 |
| rs6040630 | Imputed | A | REC | 441 | 34 | 80 | 76 | 24 | 108 | 119 |
| rs6040633 | Imputed | A | ADD | 442 | 34 | 80 | 76 | 24 | 109 | 119 |
| rs6040633 | Imputed | A | GEN | 442 | 34 | 80 | 76 | 24 | 109 | 119 |
| rs6040633 | Imputed | A | REC | 442 | 34 | 80 | 76 | 24 | 109 | 119 |

TABLE 16-continued

| | | | | | | | | | |
|---|---|---|---|---|---|---|---|---|---|
| rs6040634 | Imputed | T | ADD | 441 | 34 | 81 | 75 | 24 | 109 | 118 |
| rs6040634 | Imputed | T | GEN | 441 | 34 | 81 | 75 | 24 | 109 | 118 |
| rs6040634 | Imputed | T | REC | 441 | 34 | 81 | 75 | 24 | 109 | 118 |
| rs6040636 | Imputed | T | ADD | 443 | 34 | 79 | 78 | 24 | 109 | 119 |
| rs6040636 | Imputed | T | GEN | 443 | 34 | 79 | 78 | 24 | 109 | 119 |
| rs6040636 | Imputed | T | REC | 443 | 34 | 79 | 78 | 24 | 109 | 119 |
| rs6040638 | Imputed | C | ADD | 443 | 34 | 80 | 77 | 24 | 109 | 119 |
| rs6040638 | Imputed | C | GEN | 443 | 34 | 80 | 77 | 24 | 109 | 119 |
| rs6040638 | Imputed | C | REC | 443 | 34 | 80 | 77 | 24 | 109 | 119 |
| rs6040644 | Imputed | A | ADD | 443 | 34 | 80 | 77 | 24 | 109 | 119 |
| rs6040644 | Imputed | A | GEN | 443 | 34 | 80 | 77 | 24 | 109 | 119 |
| rs6040644 | Imputed | A | REC | 443 | 34 | 80 | 77 | 24 | 109 | 119 |
| rs6040667 | Imputed | T | ADD | 424 | 34 | 79 | 69 | 24 | 108 | 110 |
| rs6040667 | Imputed | T | GEN | 424 | 34 | 79 | 69 | 24 | 108 | 110 |
| rs6040667 | Imputed | T | REC | 424 | 34 | 79 | 69 | 24 | 108 | 110 |
| rs6040668 | Imputed | C | ADD | 440 | 33 | 82 | 75 | 23 | 111 | 116 |
| rs6040668 | Imputed | C | GEN | 440 | 33 | 82 | 75 | 23 | 111 | 116 |
| rs6040668 | Imputed | C | REC | 440 | 33 | 82 | 75 | 23 | 111 | 116 |
| rs6043066 | Genotyped | G | DOM | 443 | 10 | 85 | 96 | 16 | 87 | 149 |
| rs6048146 | Imputed | G | DOM | 443 | 0 | 19 | 172 | 2 | 11 | 239 |
| rs6082725 | Genotyped | T | DOM | 443 | 0 | 19 | 172 | 2 | 11 | 239 |
| rs6131206 | Imputed | C | ADD | 424 | 23 | 75 | 86 | 15 | 87 | 138 |
| rs6131208 | Imputed | T | ADD | 440 | 33 | 79 | 77 | 23 | 109 | 119 |
| rs6131208 | Imputed | T | GEN | 440 | 33 | 79 | 77 | 23 | 109 | 119 |
| rs6131208 | Imputed | T | REC | 440 | 33 | 79 | 77 | 23 | 109 | 119 |
| rs6134243 | Imputed | C | ADD | 443 | 34 | 80 | 77 | 24 | 109 | 119 |
| rs6134243 | Imputed | C | GEN | 443 | 34 | 80 | 77 | 24 | 109 | 119 |
| rs6134243 | Imputed | C | REC | 443 | 34 | 80 | 77 | 24 | 109 | 119 |
| rs6136020 | Imputed | A | DOM | 441 | 8 | 49 | 134 | 8 | 64 | 178 |
| rs613799 | Imputed | C | DOM | 420 | 26 | 78 | 77 | 24 | 93 | 122 |
| rs644041 | Imputed | G | ADD | 402 | 11 | 77 | 83 | 16 | 87 | 128 |
| rs644041 | Imputed | G | DOM | 402 | 11 | 77 | 83 | 16 | 87 | 128 |
| rs647645 | Imputed | C | ADD | 441 | 37 | 87 | 66 | 44 | 135 | 72 |
| rs647645 | Imputed | C | GEN | 441 | 37 | 87 | 66 | 44 | 135 | 72 |
| rs647645 | Imputed | C | REC | 441 | 37 | 87 | 66 | 44 | 135 | 72 |
| rs6495554 | Imputed | C | ADD | 443 | 13 | 64 | 114 | 9 | 81 | 162 |
| rs6495554 | Imputed | C | GEN | 443 | 13 | 64 | 114 | 9 | 81 | 162 |
| rs6495554 | Imputed | C | REC | 443 | 13 | 64 | 114 | 9 | 81 | 162 |
| rs6495555 | Imputed | C | ADD | 443 | 13 | 64 | 114 | 9 | 81 | 162 |
| rs6495555 | Imputed | C | GEN | 443 | 13 | 64 | 114 | 9 | 81 | 162 |
| rs6495555 | Imputed | C | REC | 443 | 13 | 64 | 114 | 9 | 81 | 162 |
| rs6544728 | Imputed | T | DOM | 439 | 10 | 81 | 97 | 21 | 84 | 146 |
| rs6550705 | Imputed | C | ADD | 443 | 19 | 86 | 86 | 28 | 103 | 121 |
| rs6550705 | Imputed | C | GEN | 443 | 19 | 86 | 86 | 28 | 103 | 121 |
| rs6550707 | Imputed | T | ADD | 442 | 20 | 91 | 80 | 30 | 105 | 116 |
| rs658108 | Imputed | C | DOM | 443 | 26 | 78 | 87 | 22 | 96 | 134 |
| rs6593441 | Imputed | A | DOM | 412 | 0 | 50 | 129 | 3 | 48 | 182 |
| rs668732 | Imputed | A | DOM | 442 | 46 | 95 | 50 | 49 | 137 | 65 |
| rs671041 | Imputed | A | DOM | 443 | 26 | 78 | 87 | 22 | 96 | 134 |
| rs6719700 | Imputed | A | ADD | 434 | 8 | 68 | 113 | 10 | 64 | 171 |
| rs6719700 | Imputed | A | DOM | 434 | 8 | 68 | 113 | 10 | 64 | 171 |
| rs6722640 | Imputed | T | DOM | 441 | 37 | 81 | 73 | 57 | 125 | 68 |
| rs6743092 | Imputed | T | ADD | 434 | 59 | 80 | 48 | 50 | 138 | 59 |
| rs6743092 | Imputed | T | GEN | 434 | 59 | 80 | 48 | 50 | 138 | 59 |
| rs6743092 | Imputed | T | REC | 434 | 59 | 80 | 48 | 50 | 138 | 59 |

TABLE 16-continued

| | | | | | | | | |
|---|---|---|---|---|---|---|---|---|
| rs6744759 | Imputed | G | REC | 436 | 29 | 77 | 82 | 16 | 108 | 124 |
| rs6746170 | Imputed | A | DOM | 442 | 11 | 84 | 96 | 21 | 86 | 144 |
| rs6759922 | Imputed | A | DOM | 408 | 31 | 93 | 50 | 43 | 120 | 71 |
| rs6769864 | Imputed | T | GEN | 436 | 19 | 86 | 82 | 28 | 102 | 119 |
| rs6773932 | Imputed | C | GEN | 436 | 20 | 93 | 75 | 32 | 105 | 111 |
| rs6774353 | Imputed | A | GEN | 443 | 19 | 86 | 86 | 28 | 103 | 121 |
| rs6781670 | Imputed | C | GEN | 443 | 20 | 83 | 88 | 28 | 103 | 121 |
| rs6786431 | Imputed | A | GEN | 436 | 20 | 93 | 75 | 32 | 105 | 111 |
| rs6789091 | Imputed | T | GEN | 436 | 20 | 93 | 75 | 32 | 105 | 111 |
| rs6791296 | Imputed | T | ADD | 426 | 1 | 36 | 143 | 2 | 70 | 174 |
| rs6792662 | Imputed | G | DOM | 434 | 70 | 78 | 39 | 80 | 100 | 67 |
| rs6797574 | Imputed | G | GEN | 436 | 20 | 93 | 75 | 32 | 105 | 111 |
| rs6797882 | Imputed | G | GEN | 436 | 20 | 93 | 75 | 32 | 105 | 111 |
| rs6805139 | Imputed | G | DOM | 442 | 67 | 81 | 43 | 76 | 101 | 74 |
| rs6806043 | Imputed | C | ADD | 441 | 19 | 86 | 86 | 28 | 102 | 120 |
| rs6806043 | Imputed | C | GEN | 441 | 19 | 86 | 86 | 28 | 102 | 120 |
| rs6850716 | Imputed | C | GEN | 443 | 9 | 62 | 120 | 15 | 93 | 144 |
| rs6867153 | Imputed | A | REC | 434 | 43 | 84 | 60 | 49 | 130 | 68 |
| rs687047 | Imputed | C | ADD | 443 | 0 | 32 | 159 | 5 | 60 | 187 |
| rs6871041 | Imputed | G | DOM | 418 | 16 | 62 | 104 | 15 | 112 | 109 |
| rs688358 | Imputed | A | ADD | 427 | 0 | 32 | 154 | 5 | 58 | 178 |
| rs6888012 | Imputed | A | REC | 432 | 43 | 84 | 59 | 49 | 129 | 68 |
| rs6908481 | Imputed | C | REC | 400 | 35 | 78 | 58 | 37 | 113 | 79 |
| rs7032231 | Imputed | A | ADD | 423 | 31 | 74 | 77 | 20 | 95 | 126 |
| rs7067638 | Imputed | T | DOM | 442 | 0 | 51 | 139 | 3 | 49 | 200 |
| rs7077799 | Imputed | A | ADD | 442 | 29 | 83 | 79 | 27 | 101 | 123 |
| rs7082163 | Imputed | A | ADD | 440 | 0 | 49 | 139 | 4 | 47 | 201 |
| rs7082163 | Imputed | A | DOM | 440 | 0 | 49 | 139 | 4 | 47 | 201 |
| rs7089661 | Imputed | C | DOM | 442 | 28 | 84 | 79 | 25 | 103 | 123 |
| rs7101319 | Imputed | C | ADD | 431 | 0 | 50 | 136 | 4 | 46 | 195 |
| rs7101319 | Imputed | C | DOM | 431 | 0 | 50 | 136 | 4 | 46 | 195 |
| rs710832 | Genotyped | A | GEN | 443 | 6 | 70 | 115 | 17 | 101 | 134 |
| rs710832 | Genotyped | A | REC | 443 | 6 | 70 | 115 | 17 | 101 | 134 |
| rs7134262 | Imputed | T | GEN | 438 | 29 | 85 | 76 | 21 | 111 | 116 |
| rs7134262 | Imputed | T | REC | 438 | 29 | 85 | 76 | 21 | 111 | 116 |
| rs7134671 | Imputed | T | GEN | 443 | 29 | 97 | 65 | 38 | 114 | 100 |
| rs7138300 | Imputed | C | ADD | 432 | 30 | 90 | 65 | 63 | 116 | 68 |
| rs7138300 | Imputed | C | DOM | 432 | 30 | 90 | 65 | 63 | 116 | 68 |
| rs7138300 | Imputed | C | DOM | 432 | 30 | 90 | 65 | 63 | 116 | 68 |
| rs7163931 | Imputed | G | GEN | 443 | 13 | 64 | 114 | 9 | 81 | 162 |
| rs7163931 | Imputed | G | REC | 443 | 13 | 64 | 114 | 9 | 81 | 162 |
| rs7171486 | Genotyped | G | DOM | 443 | 15 | 84 | 92 | 39 | 123 | 90 |
| rs7172611 | Imputed | G | GEN | 443 | 13 | 64 | 114 | 9 | 81 | 162 |
| rs7172611 | Imputed | G | REC | 443 | 13 | 64 | 114 | 9 | 81 | 162 |
| rs7172689 | Imputed | T | GEN | 443 | 13 | 64 | 114 | 9 | 81 | 162 |
| rs7172689 | Imputed | T | REC | 440 | 13 | 68 | 107 | 10 | 90 | 151 |
| rs7175701 | Imputed | C | GEN | 443 | 14 | 64 | 114 | 9 | 81 | 162 |
| rs7180245 | Imputed | A | GEN | 443 | 13 | 64 | 114 | 9 | 81 | 162 |
| rs7180245 | Imputed | A | REC | 443 | 13 | 64 | 114 | 9 | 81 | 162 |
| rs7220603 | Genotyped | A | ADD | 443 | 19 | 92 | 80 | 17 | 103 | 132 |
| rs7282518 | Imputed | T | ADD | 387 | 3 | 46 | 113 | 5 | 58 | 162 |
| rs7283476 | Imputed | T | ADD | 441 | 1 | 8 | 182 | 1 | 29 | 220 |
| rs7283476 | Imputed | T | DOM | 441 | 1 | 8 | 182 | 1 | 29 | 220 |

TABLE 16-continued

| | | | | | | | | |
|---|---|---|---|---|---|---|---|---|
| rs7295817 | Imputed | C | GEN | 424 | 23 | 93 | 66 | 55 | 114 | 73 |
| rs7298255 | Imputed | A | ADD | 443 | 34 | 92 | 65 | 67 | 115 | 70 |
| rs7298255 | Imputed | A | DOM | 443 | 34 | 92 | 65 | 67 | 115 | 70 |
| rs7305832 | Imputed | C | GEN | 442 | 29 | 85 | 77 | 21 | 112 | 118 |
| rs7305832 | Imputed | C | REC | 442 | 29 | 85 | 77 | 21 | 112 | 118 |
| rs7331467 | Imputed | A | GEN | 443 | 19 | 89 | 83 | 35 | 112 | 105 |
| rs7392620 | Imputed | C | ADD | 437 | 12 | 74 | 103 | 32 | 110 | 106 |
| rs742827 | Imputed | A | ADD | 437 | 33 | 82 | 75 | 23 | 109 | 115 |
| rs742827 | Imputed | A | GEN | 437 | 33 | 82 | 75 | 23 | 109 | 115 |
| rs742827 | Imputed | A | REC | 437 | 33 | 82 | 75 | 23 | 109 | 115 |
| rs7446891 | Imputed | G | DOM | 443 | 27 | 65 | 99 | 33 | 119 | 100 |
| rs7448641 | Imputed | C | ADD | 443 | 3 | 22 | 166 | 7 | 23 | 222 |
| rs7448641 | Imputed | C | DOM | 443 | 3 | 22 | 166 | 7 | 23 | 222 |
| rs7484728 | Imputed | T | GEN | 443 | 29 | 97 | 65 | 38 | 114 | 100 |
| rs7499402 | Genotyped | A | ADD | 443 | 0 | 34 | 157 | 1 | 22 | 229 |
| rs7529851 | Imputed | A | ADD | 401 | 22 | 76 | 70 | 49 | 108 | 76 |
| rs7529851 | Imputed | A | GEN | 401 | 22 | 76 | 70 | 49 | 108 | 76 |
| rs7573951 | Imputed | G | ADD | 442 | 36 | 96 | 59 | 55 | 110 | 86 |
| rs7599198 | Imputed | T | DOM | 371 | 30 | 87 | 44 | 41 | 113 | 56 |
| rs7600050 | Imputed | C | ADD | 416 | 27 | 84 | 70 | 24 | 103 | 108 |
| rs7607712 | Imputed | T | ADD | 441 | 9 | 69 | 113 | 10 | 69 | 171 |
| rs7607712 | Imputed | T | DOM | 441 | 9 | 69 | 113 | 10 | 69 | 171 |
| rs7613492 | Imputed | G | GEN | 443 | 19 | 86 | 86 | 28 | 103 | 121 |
| rs7621663 | Imputed | G | ADD | 443 | 19 | 86 | 86 | 28 | 103 | 121 |
| rs7621663 | Imputed | G | GEN | 443 | 19 | 86 | 86 | 28 | 103 | 121 |
| rs7621663 | Imputed | G | REC | 443 | 19 | 86 | 86 | 28 | 103 | 121 |
| rs7626584 | Imputed | G | ADD | 442 | 0 | 18 | 173 | 1 | 31 | 219 |
| rs7684899 | Imputed | C | ADD | 417 | 6 | 37 | 139 | 7 | 81 | 147 |
| rs7684899 | Imputed | C | DOM | 417 | 6 | 37 | 139 | 7 | 81 | 147 |
| rs7701604 | Imputed | G | ADD | 443 | 3 | 22 | 166 | 7 | 23 | 222 |
| rs7701604 | Imputed | G | DOM | 443 | 3 | 22 | 166 | 7 | 23 | 222 |
| rs7703676 | Imputed | C | ADD | 443 | 3 | 22 | 166 | 7 | 23 | 222 |
| rs7703676 | Imputed | C | DOM | 443 | 3 | 22 | 166 | 7 | 23 | 222 |
| rs7708491 | Imputed | C | REC | 435 | 43 | 84 | 60 | 50 | 130 | 68 |
| rs7711358 | Imputed | A | DOM | 443 | 26 | 66 | 99 | 34 | 118 | 100 |
| rs7719448 | Imputed | G | REC | 436 | 44 | 84 | 60 | 49 | 130 | 69 |
| rs7724761 | Imputed | T | REC | 435 | 43 | 84 | 60 | 49 | 131 | 68 |
| rs7742476 | Imputed | T | DOM | 386 | 7 | 72 | 90 | 4 | 86 | 127 |
| rs7762993 | Imputed | A | ADD | 431 | 2 | 65 | 119 | 3 | 82 | 160 |
| rs7762993 | Imputed | A | DOM | 431 | 2 | 65 | 119 | 3 | 82 | 160 |
| rs7767265 | Imputed | G | ADD | 430 | 9 | 79 | 99 | 7 | 99 | 137 |
| rs7767265 | Imputed | G | DOM | 430 | 9 | 79 | 99 | 7 | 99 | 137 |
| rs7768128 | Imputed | G | REC | 439 | 5 | 76 | 108 | 19 | 76 | 155 |
| rs7771264 | Imputed | T | DOM | 441 | 14 | 67 | 108 | 18 | 88 | 146 |
| rs7773151 | Genotyped | C | DOM | 443 | 10 | 65 | 116 | 16 | 82 | 154 |
| rs7773210 | Genotyped | A | DOM | 443 | 10 | 65 | 116 | 16 | 82 | 154 |
| rs7808536 | Genotyped | G | DOM | 409 | 8 | 59 | 112 | 7 | 63 | 160 |
| rs7843510 | Imputed | G | DOM | 443 | 40 | 84 | 67 | 47 | 117 | 88 |
| rs7894867 | Imputed | T | DOM | 441 | 0 | 51 | 138 | 3 | 49 | 200 |
| rs7921834 | Imputed | C | DOM | 440 | 28 | 83 | 79 | 26 | 101 | 123 |
| rs7939893 | Imputed | C | ADD | 441 | 22 | 62 | 106 | 29 | 124 | 98 |
| rs7939893 | Imputed | C | DOM | 441 | 22 | 62 | 106 | 29 | 124 | 98 |
| rs7944513 | Imputed | T | GEN | 418 | 17 | 66 | 96 | 14 | 77 | 148 |

TABLE 16-continued

| | | | | | | | | |
|---|---|---|---|---|---|---|---|---|
| rs7944513 | Imputed | T | REC | 418 | 17 | 66 | 96 | 14 | 77 | 148 |
| rs7949720 | Imputed | G | ADD | 418 | 3 | 45 | 137 | 2 | 42 | 189 |
| rs7949720 | Imputed | G | DOM | 418 | 3 | 45 | 137 | 2 | 42 | 189 |
| rs7955901 | Imputed | C | ADD | 440 | 34 | 91 | 65 | 67 | 115 | 68 |
| rs7955901 | Imputed | C | DOM | 440 | 34 | 91 | 65 | 67 | 115 | 68 |
| rs7956274 | Imputed | T | ADD | 426 | 30 | 88 | 64 | 63 | 113 | 68 |
| rs7956274 | Imputed | T | DOM | 426 | 30 | 88 | 64 | 63 | 113 | 68 |
| rs7956274 | Imputed | T | GEN | 426 | 30 | 88 | 64 | 63 | 113 | 68 |
| rs7957932 | Imputed | G | ADD | 439 | 35 | 92 | 64 | 67 | 117 | 64 |
| rs7957932 | Imputed | G | DOM | 439 | 35 | 92 | 64 | 67 | 117 | 64 |
| rs7984504 | Imputed | C | GEN | 443 | 19 | 79 | 93 | 30 | 103 | 119 |
| rs7999518 | Imputed | A | REC | 423 | 29 | 99 | 51 | 74 | 117 | 53 |
| rs8026245 | Imputed | G | GEN | 442 | 14 | 69 | 108 | 10 | 90 | 151 |
| rs8026245 | Imputed | G | REC | 442 | 14 | 69 | 108 | 10 | 90 | 151 |
| rs8060725 | Genotyped | A | ADD | 443 | 11 | 63 | 117 | 18 | 112 | 122 |
| rs8103016 | Genotyped | A | ADD | 443 | 11 | 72 | 108 | 14 | 78 | 160 |
| rs8103016 | Genotyped | A | DOM | 443 | 11 | 72 | 108 | 14 | 78 | 160 |
| rs8104182 | Imputed | G | ADD | 440 | 10 | 71 | 108 | 11 | 77 | 163 |
| rs8104182 | Imputed | G | DOM | 440 | 10 | 71 | 108 | 11 | 77 | 163 |
| rs8129461 | Imputed | G | ADD | 441 | 1 | 8 | 182 | 1 | 32 | 217 |
| rs8129461 | Imputed | G | DOM | 441 | 1 | 8 | 182 | 1 | 32 | 217 |
| rs8130021 | Imputed | G | ADD | 442 | 1 | 8 | 182 | 1 | 29 | 221 |
| rs8130021 | Imputed | G | DOM | 442 | 1 | 8 | 182 | 1 | 29 | 221 |
| rs879961 | Imputed | T | ADD | 440 | 13 | 87 | 90 | 16 | 103 | 131 |
| rs879961 | Imputed | T | DOM | 440 | 13 | 87 | 90 | 16 | 103 | 131 |
| rs906353 | Imputed | A | DOM | 434 | 16 | 86 | 84 | 22 | 103 | 123 |
| rs915491 | Imputed | C | DOM | 441 | 28 | 76 | 86 | 21 | 98 | 132 |
| rs915493 | Imputed | T | DOM | 441 | 28 | 76 | 86 | 21 | 98 | 132 |
| rs915494 | Imputed | A | ADD | 422 | 29 | 79 | 78 | 22 | 91 | 123 |
| rs915494 | Imputed | A | DOM | 422 | 29 | 79 | 78 | 22 | 91 | 123 |
| rs917295 | Imputed | G | DOM | 443 | 27 | 65 | 99 | 33 | 119 | 100 |
| rs9284851 | Imputed | A | GEN | 436 | 20 | 93 | 75 | 32 | 105 | 111 |
| rs9293464 | Imputed | T | REC | 435 | 43 | 84 | 60 | 49 | 131 | 68 |
| rs9295154 | Genotyped | G | DOM | 443 | 3 | 53 | 135 | 9 | 47 | 196 |
| rs9310221 | Imputed | A | DOM | 393 | 29 | 86 | 54 | 36 | 121 | 67 |
| rs9310699 | Genotyped | T | GEN | 443 | 20 | 83 | 88 | 28 | 103 | 121 |
| rs9310700 | Imputed | C | ADD | 443 | 19 | 86 | 86 | 28 | 103 | 121 |
| rs9310700 | Imputed | C | GEN | 443 | 19 | 86 | 86 | 28 | 103 | 121 |
| rs9310701 | Imputed | C | GEN | 443 | 20 | 91 | 80 | 30 | 105 | 117 |
| rs9310704 | Imputed | C | GEN | 436 | 20 | 93 | 75 | 32 | 105 | 111 |
| rs9319185 | Imputed | C | GEN | 441 | 17 | 79 | 93 | 30 | 103 | 119 |
| rs9319186 | Imputed | T | GEN | 443 | 19 | 79 | 93 | 30 | 103 | 119 |
| rs9327555 | Imputed | T | DOM | 443 | 27 | 65 | 99 | 33 | 119 | 100 |
| rs9403367 | Imputed | C | DOM | 443 | 10 | 65 | 116 | 16 | 82 | 154 |
| rs9419608 | Imputed | C | REC | 430 | 28 | 94 | 61 | 57 | 130 | 60 |
| rs9426437 | Imputed | T | DOM | 424 | 33 | 96 | 57 | 40 | 123 | 75 |
| rs9454967 | Imputed | G | DOM | 441 | 3 | 28 | 159 | 4 | 38 | 209 |
| rs9635511 | Imputed | T | DOM | 436 | 26 | 96 | 67 | 47 | 119 | 81 |
| rs966583 | Imputed | A | ADD | 439 | 26 | 87 | 77 | 44 | 125 | 80 |
| rs966583 | Imputed | A | DOM | 439 | 26 | 87 | 77 | 44 | 125 | 80 |
| rs980263 | Imputed | T | GEN | 443 | 20 | 91 | 80 | 30 | 105 | 117 |
| rs980264 | Imputed | T | GEN | 443 | 20 | 91 | 80 | 30 | 105 | 117 |
| rs9812206 | Imputed | G | ADD | 442 | 0 | 30 | 161 | 0 | 38 | 213 |

TABLE 16-continued

| | | | | | | | | | |
|---|---|---|---|---|---|---|---|---|---|
| rs9812206 | Imputed | G | DOM | 442 | 0 | 30 | 161 | 0 | 38 | 213 |
| rs9813552 | Imputed | G | ADD | 442 | 0 | 30 | 161 | 1 | 36 | 214 |
| rs9813552 | Imputed | G | DOM | 442 | 0 | 30 | 161 | 1 | 36 | 214 |
| rs9815037 | Imputed | T | ADD | 443 | 0 | 30 | 161 | 1 | 36 | 215 |
| rs9815037 | Imputed | T | DOM | 443 | 0 | 30 | 161 | 1 | 36 | 215 |
| rs9819583 | Imputed | T | GEN | 443 | 20 | 83 | 88 | 28 | 103 | 121 |
| rs9825349 | Imputed | A | ADD | 443 | 0 | 30 | 161 | 1 | 36 | 215 |
| rs9825349 | Imputed | A | DOM | 443 | 0 | 30 | 161 | 1 | 36 | 215 |
| rs9833118 | Imputed | G | ADD | 443 | 19 | 86 | 86 | 28 | 103 | 121 |
| rs9833118 | Imputed | G | GEN | 443 | 19 | 86 | 86 | 28 | 103 | 121 |
| rs9834217 | Imputed | T | ADD | 443 | 0 | 30 | 161 | 1 | 37 | 214 |
| rs9834217 | Imputed | T | DOM | 443 | 0 | 30 | 161 | 1 | 37 | 214 |
| rs9838563 | Imputed | C | GEN | 437 | 20 | 89 | 80 | 28 | 104 | 116 |
| rs9840460 | Imputed | T | ADD | 443 | 0 | 30 | 161 | 1 | 37 | 214 |
| rs9840460 | Imputed | T | DOM | 443 | 0 | 30 | 161 | 1 | 37 | 214 |
| rs9840756 | Imputed | A | ADD | 437 | 0 | 30 | 160 | 1 | 37 | 209 |
| rs9840756 | Imputed | A | DOM | 437 | 0 | 30 | 160 | 1 | 37 | 209 |
| rs9847999 | Imputed | C | GEN | 436 | 20 | 93 | 75 | 32 | 105 | 111 |
| rs9864769 | Imputed | C | GEN | 443 | 20 | 91 | 80 | 30 | 105 | 117 |
| rs9866421 | Genotyped | C | REC | 443 | 29 | 94 | 68 | 57 | 111 | 84 |
| rs987296 | Imputed | T | GEN | 441 | 20 | 83 | 88 | 28 | 102 | 120 |
| rs9881685 | Imputed | A | ADD | 440 | 0 | 30 | 160 | 0 | 38 | 212 |
| rs9881685 | Imputed | A | DOM | 440 | 0 | 30 | 160 | 0 | 38 | 212 |
| rs992695 | Imputed | C | ADD | 442 | 13 | 87 | 90 | 16 | 105 | 131 |
| rs992695 | Imputed | C | DOM | 442 | 13 | 87 | 90 | 16 | 105 | 131 |
| rs9936999 | Imputed | G | DOM | 266 | 20 | 40 | 52 | 18 | 74 | 62 |

TABLE 17

| SNP rs # | SOURCE | ALLELE (A1) | MODEL | P | P(R) | OR | OR(R) | Q | I |
|---|---|---|---|---|---|---|---|---|---|
| rs77638540 | Genotyped | T | DOMINANT | 2.65E-03 | 0.0159 | 0.4686 | 0.4785 | 0.2317 | 30.09 |
| rs72746987 | Genotyped | A | DOMINANT | 3.12E-05 | 3.12E-05 | 0.337 | 0.337 | 0.9734 | 0 |
| rs10021016 | Genotyped | G | GENOTYPIC | 4.88E-04 | 0.000488 | 2.3201 | 2.3201 | 0.9885 | 0 |
| rs10021016 | Genotyped | G | RECESSIVE | 7.69E-04 | 0.0007685 | 2.2102 | 2.2102 | 0.9334 | 0 |
| rs10051148 | Imputed | C | DOMINANT | 0.000697 | 0.000697 | 0.6715 | 0.6715 | 0.7678 | 0 |
| rs10054055 | Imputed | T | DOMINANT | 0.0008519 | 0.0008519 | 0.6758 | 0.6758 | 0.8098 | 0 |
| rs10067895 | Imputed | A | DOMINANT | 9.99E-04 | 0.0009994 | 0.6775 | 0.6775 | 0.9204 | 0 |
| rs10100725 | Imputed | C | DOMINANT | 5.54E-05 | 5.54E-05 | 0.5929 | 0.5929 | 0.3989 | 0 |
| rs10128531 | Imputed | T | ADDITIVE | 1.54E-03 | 0.001541 | 1.4677 | 1.4677 | 0.921 | 0 |
| rs10181743 | Imputed | G | ADDITIVE | 9.76E-05 | 9.76E-05 | 1.4004 | 1.4004 | 0.3524 | 0 |
| rs10199127 | Imputed | T | DOMINANT | 4.59E-05 | 4.59E-05 | 1.6169 | 1.6169 | 0.3286 | 0 |
| rs10270624 | Imputed | G | DOMINANT | 2.16E-04 | 0.0003017 | 1.5776 | 1.5804 | 0.3061 | 4.53 |
| rs1030006 | Imputed | G | RECESSIVE | 7.93E-05 | 7.93E-05 | 1.7557 | 1.7557 | 0.577 | 0 |
| rs1031811 | Imputed | A | RECESSIVE | 6.16E-03 | 0.006159 | 1.7624 | 1.7624 | 0.7766 | 0 |
| rs10430870 | Genotyped | G | GENOTYPIC | 3.07E-03 | 3.07E-03 | 2.094 | 2.094 | 0.4823 | 0 |
| rs10430870 | Genotyped | G | RECESSIVE | 0.003991 | 0.003991 | 2.0223 | 2.0223 | 0.6273 | 0 |
| rs10469597 | Imputed | A | GENOTYPIC | 4.70E-05 | 4.70E-05 | 2.5398 | 2.5398 | 0.9742 | 0 |
| rs10469597 | Imputed | A | RECESSIVE | 4.85E-05 | 4.85E-05 | 2.4663 | 2.4663 | 0.8923 | 0 |
| rs10478919 | Imputed | G | DOMINANT | 5.77E-04 | 0.0005772 | 0.6679 | 0.6679 | 0.7414 | 0 |
| rs10506623 | Imputed | C | ADDITIVE | 0.0001433 | 0.0001433 | 0.7177 | 0.7177 | 0.7038 | 0 |
| rs10506623 | Imputed | C | DOMINANT | 8.28E-05 | 8.28E-05 | 0.6159 | 0.6159 | 0.9559 | 0 |
| rs10506626 | Imputed | A | ADDITIVE | 7.58E-05 | 7.58E-05 | 0.7112 | 0.7112 | 0.422 | 0 |
| rs10506626 | Imputed | A | DOMINANT | 8.52E-06 | 8.52E-06 | 0.5838 | 0.5838 | 0.8702 | 0 |
| rs10509477 | Imputed | T | DOMINANT | 8.97E-05 | 8.97E-05 | 1.5819 | 1.5819 | 0.6066 | 0 |
| rs10517918 | Imputed | G | RECESSIVE | 6.05E-05 | 6.05E-05 | 1.8264 | 1.8264 | 0.4972 | 0 |
| rs10517924 | Imputed | A | RECESSIVE | 7.80E-05 | 7.80E-05 | 1.7459 | 1.7459 | 0.7576 | 0 |
| rs10519362 | Imputed | G | DOMINANT | 0.001678 | 0.001678 | 1.4934 | 1.4934 | 0.9592 | 0 |
| rs10520072 | Imputed | T | DOMINANT | 0.0005579 | 0.0005579 | 0.6664 | 0.6664 | 0.9359 | 0 |
| rs10737390 | Imputed | T | DOMINANT | 5.50E-05 | 5.50E-05 | 0.6131 | 0.6131 | 0.5051 | 0 |
| rs10742851 | Imputed | T | RECESSIVE | 9.69E-05 | 9.69E-05 | 0.3726 | 0.3726 | 0.5568 | 0 |
| rs10743685 | Imputed | G | GENOTYPIC | 6.86E-05 | 6.86E-05 | 2.0019 | 2.0019 | 0.8416 | 0 |
| rs10743685 | Imputed | G | RECESSIVE | 1.49E-04 | 0.0001485 | 1.8297 | 1.8297 | 0.5748 | 0 |
| rs10749293 | Imputed | G | DOMINANT | 6.75E-05 | 6.75E-05 | 1.5947 | 1.5947 | 0.7622 | 0 |
| rs10749294 | Imputed | A | DOMINANT | 1.82E-04 | 1.82E-04 | 1.55 | 1.55 | 0.8529 | 0 |
| rs10753760 | Imputed | T | ADDITIVE | 5.13E-05 | 5.13E-05 | 1.4174 | 1.4174 | 0.7656 | 0 |
| rs10753760 | Imputed | T | GENOTYPIC | 5.49E-05 | 5.49E-05 | 2.0466 | 2.0466 | 0.7902 | 0 |
| rs10772362 | Imputed | T | ADDITIVE | 1.62E-05 | 1.62E-05 | 0.6474 | 0.6474 | 0.7786 | 0 |
| rs10784891 | Imputed | C | ADDITIVE | 3.04E-04 | 0.0003039 | 0.7309 | 0.7309 | 0.7572 | 0 |
| rs10784891 | Imputed | C | DOMINANT | 1.43E-04 | 1.43E-04 | 0.6151 | 0.6151 | 0.793 | 0 |
| rs10784891 | Imputed | C | GENOTYPIC | 1.13E-03 | 1.13E-03 | 0.564 | 0.564 | 0.5692 | 0 |
| rs10787923 | Imputed | G | DOMINANT | 6.49E-05 | 6.49E-05 | 1.5969 | 1.5969 | 0.7212 | 0 |
| rs10787924 | Imputed | T | DOMINANT | 1.60E-04 | 0.0001596 | 1.5563 | 1.5563 | 0.8327 | 0 |
| rs10787949 | Imputed | A | DOMINANT | 0.0001459 | 0.0001459 | 1.5599 | 1.5599 | 0.592 | 0 |
| rs10787951 | Imputed | G | DOMINANT | 0.0001459 | 0.0001459 | 1.5599 | 1.5599 | 0.592 | 0 |
| rs10787983 | Imputed | C | DOMINANT | 0.0001474 | 0.0001474 | 1.5574 | 1.5574 | 0.6777 | 0 |
| rs10794733 | Imputed | C | ADDITIVE | 0.00276 | 0.00276 | 0.7628 | 0.7628 | 0.9657 | 0 |
| rs10818280 | Imputed | C | DOMINANT | 1.66E-03 | 0.00166 | 0.6922 | 0.6922 | 0.8399 | 0 |
| rs10860586 | Imputed | A | ADDITIVE | 9.56E-05 | 9.56E-05 | 1.3855 | 1.3855 | 0.4436 | 0 |
| rs10860586 | Imputed | A | GENOTYPIC | 9.35E-05 | 9.35E-05 | 1.9196 | 1.9196 | 0.4483 | 0 |
| rs10870473 | Imputed | A | ADDITIVE | 9.61E-05 | 9.61E-05 | 0.569 | 0.569 | 0.6419 | 0 |
| rs10870473 | Imputed | A | DOMINANT | 3.52E-05 | 3.52E-05 | 0.4776 | 0.4776 | 0.9449 | 0 |
| rs10879240 | Imputed | C | ADDITIVE | 5.56E-04 | 0.0005557 | 0.7439 | 0.7439 | 0.8062 | 0 |
| rs10879240 | Imputed | C | GENOTYPIC | 0.001627 | 0.001627 | 0.5771 | 0.5771 | 0.5726 | 0 |
| rs10879242 | Imputed | A | ADDITIVE | 2.20E-04 | 0.0002198 | 0.7269 | 0.7269 | 0.7534 | 0 |
| rs10879242 | Imputed | A | DOMINANT | 7.97E-05 | 7.97E-05 | 0.6177 | 0.6177 | 0.8661 | 0 |
| rs10879245 | Imputed | G | ADDITIVE | 2.20E-04 | 0.0002198 | 0.7269 | 0.7269 | 0.7534 | 0 |
| rs10879245 | Imputed | G | DOMINANT | 7.97E-05 | 7.97E-05 | 0.6177 | 0.6177 | 0.8661 | 0 |
| rs10879249 | Imputed | T | ADDITIVE | 7.98E-05 | 7.98E-05 | 0.7098 | 0.7098 | 0.7061 | 0 |
| rs10879249 | Imputed | T | DOMINANT | 3.54E-05 | 3.54E-05 | 0.6036 | 0.6036 | 0.9476 | 0 |
| rs10886429 | Imputed | A | DOMINANT | 1.10E-04 | 1.10E-04 | 1.5741 | 1.5741 | 0.6665 | 0 |
| rs10886449 | Imputed | G | DOMINANT | 0.0002256 | 0.0002256 | 1.5385 | 1.5385 | 0.68 | 0 |
| rs10886451 | Imputed | G | DOMINANT | 2.26E-04 | 0.0002256 | 1.5385 | 1.5385 | 0.68 | 0 |
| rs10886452 | Imputed | A | DOMINANT | 0.0001459 | 0.0001459 | 1.5599 | 1.5599 | 0.592 | 0 |
| rs10886456 | Imputed | G | DOMINANT | 0.0002256 | 0.0002256 | 1.5385 | 1.5385 | 0.68 | 0 |
| rs10886463 | Imputed | C | DOMINANT | 0.0001545 | 0.0001545 | 1.5578 | 1.5578 | 0.6315 | 0 |
| rs10886465 | Imputed | A | DOMINANT | 8.63E-05 | 8.63E-05 | 1.5827 | 1.5827 | 0.5622 | 0 |
| rs10886526 | Imputed | C | DOMINANT | 1.47E-04 | 0.0001474 | 1.5574 | 1.5574 | 0.6777 | 0 |
| rs10922903 | Imputed | C | RECESSIVE | 9.19E-05 | 9.19E-05 | 0.5329 | 0.5329 | 0.4609 | 0 |
| rs10941126 | Imputed | G | ADDITIVE | 1.27E-05 | 1.27E-05 | 0.2451 | 0.2451 | 0.6218 | 0 |
| rs10941126 | Imputed | G | DOMINANT | 2.81E-05 | 2.81E-05 | 0.2509 | 0.2509 | 0.6535 | 0 |
| rs10947980 | Imputed | G | ADDITIVE | 7.93E-05 | 7.93E-05 | 0.6897 | 0.6897 | 0.3212 | 0 |
| rs11059376 | Imputed | T | ADDITIVE | 5.53E-05 | 5.53E-05 | 1.5704 | 1.5704 | 0.929 | 0 |
| rs11072995 | Imputed | T | GENOTYPIC | 0.0002433 | 0.0002433 | 3.2596 | 3.2596 | 0.6428 | 0 |
| rs11072995 | Imputed | T | RECESSIVE | 0.0003025 | 0.0003025 | 3.164 | 3.164 | 0.6989 | 0 |
| rs11081202 | Genotyped | G | GENOTYPIC | 2.03E-03 | 0.002028 | 1.979 | 1.979 | 0.4228 | 0 |
| rs11081202 | Genotyped | G | RECESSIVE | 5.63E-04 | 0.0005629 | 2.0891 | 2.0891 | 0.5637 | 0 |
| rs110965 | Imputed | C | GENOTYPIC | 6.88E-03 | 6.88E-03 | 1.7493 | 1.7493 | 0.9979 | 0 |
| rs11124962 | Imputed | A | DOMINANT | 0.000116 | 0.000116 | 1.5786 | 1.5786 | 0.4004 | 0 |

TABLE 17-continued

| SNP rs # | SOURCE | ALLELE (A1) | MODEL | P | P(R) | OR | OR(R) | Q | I |
|---|---|---|---|---|---|---|---|---|---|
| rs1116596 | Imputed | T | DOMINANT | 6.74E-04 | 0.000674 | 0.6707 | 0.6707 | 0.7616 | 0 |
| rs11178531 | Imputed | A | ADDITIVE | 1.67E-03 | 1.67E-03 | 0.7662 | 0.7662 | 0.8942 | 0 |
| rs11178531 | Imputed | A | DOMINANT | 2.00E-04 | 0.0001996 | 0.6214 | 0.6214 | 0.9419 | 0 |
| rs11178583 | Imputed | A | ADDITIVE | 8.27E-05 | 8.27E-05 | 0.7104 | 0.7104 | 0.7004 | 0 |
| rs11178583 | Imputed | A | DOMINANT | 3.96E-05 | 3.96E-05 | 0.6056 | 0.6056 | 0.9636 | 0 |
| rs11178589 | Imputed | T | ADDITIVE | 6.68E-05 | 6.68E-05 | 0.7079 | 0.7079 | 0.7072 | 0 |
| rs11178589 | Imputed | T | DOMINANT | 3.53E-05 | 3.53E-05 | 0.6015 | 0.6015 | 0.9599 | 0 |
| rs11178594 | Imputed | C | ADDITIVE | 0.0001049 | 0.0001049 | 0.7148 | 0.7148 | 0.7211 | 0 |
| rs11178594 | Imputed | C | DOMINANT | 4.13E-05 | 4.13E-05 | 0.6065 | 0.6065 | 0.8956 | 0 |
| rs11178602 | Imputed | T | ADDITIVE | 8.81E-05 | 8.81E-05 | 0.7122 | 0.7122 | 0.7436 | 0 |
| rs11178602 | Imputed | T | DOMINANT | 3.05E-05 | 3.05E-05 | 0.6016 | 0.6016 | 0.8568 | 0 |
| rs11178648 | Imputed | T | ADDITIVE | 0.0002031 | 0.0002031 | 0.7267 | 0.7267 | 0.6332 | 0 |
| rs11178648 | Imputed | T | DOMINANT | 1.72E-05 | 1.72E-05 | 0.5945 | 0.5945 | 0.939 | 0 |
| rs11198877 | Imputed | T | DOMINANT | 1.33E-04 | 0.0001326 | 1.5641 | 1.5641 | 0.6136 | 0 |
| rs11198942 | Imputed | T | DOMINANT | 8.97E-05 | 8.97E-05 | 1.5819 | 1.5819 | 0.6066 | 0 |
| rs11221075 | Imputed | A | ADDITIVE | 0.002129 | 0.002129 | 0.6684 | 0.6684 | 0.6989 | 0 |
| rs11242020 | Imputed | T | DOMINANT | 0.0005976 | 0.0005976 | 0.6685 | 0.6685 | 0.6979 | 0 |
| rs11242021 | Imputed | T | DOMINANT | 0.000699 | 0.000699 | 0.6712 | 0.6712 | 0.8706 | 0 |
| rs11242022 | Imputed | T | DOMINANT | 0.0007669 | 0.0007669 | 0.6732 | 0.6732 | 0.8443 | 0 |
| rs11242023 | Imputed | T | DOMINANT | 0.0009289 | 0.0009289 | 0.677 | 0.677 | 0.8728 | 0 |
| rs1149349 | Imputed | T | DOMINANT | 7.39E-05 | 7.39E-05 | 1.6656 | 1.6656 | 0.8419 | 0 |
| rs1149350 | Imputed | A | ADDITIVE | 1.42E-05 | 1.42E-05 | 1.5752 | 1.5752 | 0.893 | 0 |
| rs1149350 | Imputed | A | DOMINANT | 5.15E-06 | 5.15E-06 | 1.7451 | 1.7451 | 0.7691 | 0 |
| rs11576627 | Imputed | T | ADDITIVE | 0.0002162 | 0.0002162 | 1.5806 | 1.5806 | 0.4132 | 0 |
| rs11576627 | Imputed | T | DOMINANT | 1.75E-04 | 0.0001751 | 1.6594 | 1.6594 | 0.4028 | 0 |
| rs11630050 | Imputed | G | GENOTYPIC | 0.0001769 | 0.0001769 | 3.0849 | 3.0849 | 0.8542 | 0 |
| rs11630050 | Imputed | G | RECESSIVE | 0.0001739 | 0.0001739 | 3.0436 | 3.0436 | 0.9473 | 0 |
| rs11633024 | Imputed | C | GENOTYPIC | 0.0001769 | 0.0001769 | 3.0849 | 3.0849 | 0.8542 | 0 |
| rs11633024 | Imputed | C | RECESSIVE | 0.0001739 | 0.0001739 | 3.0436 | 3.0436 | 0.9473 | 0 |
| rs11636298 | Imputed | G | GENOTYPIC | 0.0001106 | 0.0001106 | 3.4591 | 3.4591 | 0.8474 | 0 |
| rs11636298 | Imputed | G | RECESSIVE | 0.0001586 | 0.0001586 | 3.317 | 3.317 | 0.9056 | 0 |
| rs11637363 | Imputed | C | GENOTYPIC | 0.0001099 | 0.0001099 | 3.1869 | 3.1869 | 0.7516 | 0 |
| rs11637363 | Imputed | C | RECESSIVE | 0.0001027 | 0.0001027 | 3.1534 | 3.1534 | 0.8534 | 0 |
| rs11637813 | Imputed | A | GENOTYPIC | 0.0001769 | 0.0001769 | 3.0849 | 3.0849 | 0.8542 | 0 |
| rs11637813 | Imputed | A | RECESSIVE | 0.0001739 | 0.0001739 | 3.0436 | 3.0436 | 0.9473 | 0 |
| rs11638043 | Imputed | C | GENOTYPIC | 1.79E-04 | 0.0001788 | 3.0118 | 3.0118 | 0.8819 | 0 |
| rs11638043 | Imputed | C | RECESSIVE | 0.0001717 | 0.0001717 | 2.9756 | 2.9756 | 0.9909 | 0 |
| rs11638115 | Imputed | A | GENOTYPIC | 0.0002433 | 0.0002433 | 3.2596 | 3.2596 | 0.6428 | 0 |
| rs11638115 | Imputed | A | RECESSIVE | 0.0003025 | 0.0003025 | 3.164 | 3.164 | 0.6989 | 0 |
| rs11638444 | Imputed | C | GENOTYPIC | 0.0001194 | 0.0001194 | 3.4378 | 3.4378 | 0.8647 | 0 |
| rs11717157 | Imputed | T | ADDITIVE | 8.91E-05 | 8.91E-05 | 1.3969 | 1.3969 | 0.7348 | 0 |
| rs11717157 | Imputed | T | GENOTYPIC | 5.30E-05 | 5.30E-05 | 2.0995 | 2.0995 | 0.9749 | 0 |
| rs11724055 | Imputed | A | DOMINANT | 0.00239 | 0.00239 | 0.6839 | 0.6839 | 0.4246 | 0 |
| rs11743355 | Imputed | C | ADDITIVE | 1.64E-05 | 1.64E-05 | 0.2366 | 0.2366 | 0.5626 | 0 |
| rs11743355 | Imputed | C | DOMINANT | 3.44E-05 | 3.44E-05 | 0.2417 | 0.2417 | 0.589 | 0 |
| rs11746806 | Imputed | T | ADDITIVE | 1.27E-05 | 1.27E-05 | 0.2451 | 0.2451 | 0.6218 | 0 |
| rs11746806 | Imputed | T | DOMINANT | 2.81E-05 | 2.81E-05 | 0.2509 | 0.2509 | 0.6535 | 0 |
| rs11746959 | Imputed | T | ADDITIVE | 1.27E-05 | 1.27E-05 | 0.2451 | 0.2451 | 0.6218 | 0 |
| rs11746959 | Imputed | T | DOMINANT | 2.81E-05 | 2.81E-05 | 0.2509 | 0.2509 | 0.6535 | 0 |
| rs11749272 | Imputed | T | DOMINANT | 0.0005772 | 0.0005772 | 0.6679 | 0.6679 | 0.7414 | 0 |
| rs11839636 | Imputed | C | GENOTYPIC | 7.59E-05 | 7.59E-05 | 2.2506 | 2.2506 | 0.9705 | 0 |
| rs11839785 | Imputed | C | GENOTYPIC | 7.97E-05 | 7.97E-05 | 2.2456 | 2.2456 | 0.9638 | 0 |
| rs11853619 | Imputed | C | GENOTYPIC | 0.0001175 | 0.0001175 | 3.4406 | 3.4406 | 0.8594 | 0 |
| rs11853619 | Imputed | C | RECESSIVE | 0.0001702 | 0.0001702 | 3.2975 | 3.2975 | 0.9191 | 0 |
| rs11856780 | Imputed | A | GENOTYPIC | 0.0001175 | 0.0001175 | 3.4406 | 3.4406 | 0.8594 | 0 |
| rs11856780 | Imputed | A | RECESSIVE | 0.0001702 | 0.0001702 | 3.2975 | 3.2975 | 0.9191 | 0 |
| rs11901899 | Imputed | A | DOMINANT | 3.44E-04 | 0.001093 | 1.5287 | 1.539 | 0.2722 | 17.07 |
| rs11903290 | Imputed | C | RECESSIVE | 0.006295 | 0.006295 | 1.7598 | 1.7598 | 0.7724 | 0 |
| rs11909480 | Imputed | G | ADDITIVE | 0.001521 | 0.001521 | 0.4399 | 0.4399 | 0.3262 | 0 |
| rs11909480 | Imputed | G | DOMINANT | 0.001914 | 0.001964 | 0.4405 | 0.4406 | 0.3163 | 0.41 |
| rs11910289 | Imputed | T | ADDITIVE | 0.001496 | 0.001496 | 1.8584 | 1.8584 | 0.5088 | 0 |
| rs11910289 | Imputed | T | DOMINANT | 0.001453 | 0.001453 | 1.9004 | 1.9004 | 0.599 | 0 |
| rs11920375 | Genotyped | C | GENOTYPIC | 7.94E-05 | 7.94E-05 | 2.0435 | 2.0435 | 0.8995 | 0 |
| rs11926319 | Imputed | G | DOMINANT | 9.79E-05 | 9.79E-05 | 0.5435 | 0.5435 | 0.854 | 0 |
| rs11933744 | Imputed | T | RECESSIVE | 9.01E-05 | 9.01E-05 | 2.5682 | 2.5682 | 0.6941 | 0 |
| rs11934919 | Imputed | C | RECESSIVE | 9.01E-05 | 9.01E-05 | 2.5682 | 2.5682 | 0.6941 | 0 |
| rs11934957 | Imputed | C | RECESSIVE | 9.01E-05 | 9.01E-05 | 2.5682 | 2.5682 | 0.6941 | 0 |
| rs11959206 | Imputed | A | RECESSIVE | 3.66E-05 | 3.66E-05 | 0.5455 | 0.5455 | 0.7414 | 0 |
| rs12038613 | Imputed | C | RECESSIVE | 7.06E-05 | 7.06E-05 | 0.5252 | 0.5252 | 0.5509 | 0 |
| rs12151417 | Imputed | T | DOMINANT | 6.45E-04 | 0.0006449 | 1.5021 | 1.5021 | 0.7699 | 0 |
| rs12153185 | Imputed | T | DOMINANT | 0.001052 | 0.001052 | 0.6792 | 0.6792 | 0.8684 | 0 |
| rs12182651 | Imputed | T | DOMINANT | 5.94E-05 | 5.94E-05 | 1.9576 | 1.9576 | 0.6125 | 0 |
| rs12235345 | Imputed | C | DOMINANT | 3.59E-04 | 0.005622 | 1.8464 | 1.8177 | 0.2149 | 34.98 |
| rs12324786 | Imputed | T | GENOTYPIC | 0.0002433 | 0.0002433 | 3.2596 | 3.2596 | 0.6428 | 0 |
| rs12324786 | Imputed | T | RECESSIVE | 0.0003025 | 0.0003025 | 3.164 | 3.164 | 0.6989 | 0 |
| rs12336958 | Imputed | G | DOMINANT | 7.27E-05 | 7.27E-05 | 1.6549 | 1.6549 | 0.457 | 0 |
| rs12407412 | Imputed | C | ADDITIVE | 0.0002548 | 0.0002548 | 1.5719 | 1.5719 | 0.384 | 0 |
| rs12407412 | Imputed | C | DOMINANT | 2.10E-04 | 2.10E-04 | 1.6487 | 1.6487 | 0.368 | 0 |

TABLE 17-continued

| SNP rs # | SOURCE | ALLELE (A1) | MODEL | P | P(R) | OR | OR(R) | Q | I |
|---|---|---|---|---|---|---|---|---|---|
| rs12418971 | Imputed | C | GENOTYPIC | 0.001802 | 0.001802 | 2.2011 | 2.2011 | 0.4612 | 0 |
| rs12418971 | Imputed | C | RECESSIVE | 0.002813 | 0.002813 | 2.095 | 2.095 | 0.5916 | 0 |
| rs1241967 | Imputed | T | RECESSIVE | 0.000111 | 0.000111 | 0.4573 | 0.4573 | 0.3307 | 0 |
| rs12420184 | Imputed | G | DOMINANT | 4.91E−05 | 4.91E−05 | 0.5847 | 0.5847 | 0.5393 | 0 |
| rs12433968 | Imputed | T | DOMINANT | 4.10E−05 | 4.10E−05 | 0.6109 | 0.6109 | 0.318 | 0 |
| rs12445477 | Imputed | A | DOMINANT | 6.95E−05 | 6.95E−05 | 0.5027 | 0.5027 | 0.3771 | 0 |
| rs12447191 | Genotyped | T | ADDITIVE | 0.0002095 | 0.0002095 | 0.6717 | 0.6717 | 0.8037 | 0 |
| rs12447191 | Genotyped | T | DOMINANT | 2.32E−04 | 0.004396 | 0.6338 | 0.6204 | 0.1898 | 41.82 |
| rs12465349 | Imputed | A | RECESSIVE | 0.00192 | 0.00192 | 1.513 | 1.513 | 0.7914 | 0 |
| rs12247340 | Imputed | C | ADDITIVE | 5.07E−05 | 5.07E−05 | 1.5296 | 1.5296 | 0.9256 | 0 |
| rs12247340 | Imputed | C | DOMINANT | 1.08E−05 | 1.08E−05 | 1.7083 | 1.7083 | 0.8426 | 0 |
| rs12247341 | Imputed | C | ADDITIVE | 5.04E−05 | 5.04E−05 | 1.5303 | 1.5303 | 0.9761 | 0 |
| rs12247341 | Imputed | C | DOMINANT | 1.08E−05 | 1.08E−05 | 1.7098 | 1.7098 | 0.7759 | 0 |
| rs12247343 | Imputed | C | DOMINANT | 6.53E−05 | 6.53E−05 | 1.6756 | 1.6756 | 0.9862 | 0 |
| rs12509758 | Imputed | C | DOMINANT | 0.0001489 | 0.0001489 | 1.5799 | 1.5799 | 0.3277 | 0 |
| rs12515472 | Imputed | A | DOMINANT | 0.005408 | 0.005408 | 1.4022 | 1.4022 | 0.5945 | 0 |
| rs12548906 | Imputed | G | ADDITIVE | 3.90E−03 | 3.90E−03 | 1.3761 | 1.3761 | 0.5561 | 0 |
| rs12596240 | Imputed | G | DOMINANT | 4.46E−05 | 4.46E−05 | 0.6107 | 0.6107 | 0.5739 | 0 |
| rs12618781 | Imputed | A | DOMINANT | 5.33E−05 | 5.33E−05 | 0.5924 | 0.5924 | 0.6396 | 0 |
| rs12678600 | Imputed | A | DOMINANT | 5.58E−05 | 5.58E−05 | 0.6235 | 0.6235 | 0.8084 | 0 |
| rs12692229 | Imputed | T | ADDITIVE | 5.68E−03 | 0.005681 | 1.271 | 1.271 | 0.7737 | 0 |
| rs12713324 | Imputed | T | DOMINANT | 0.0005653 | 0.0005653 | 1.5061 | 1.5061 | 0.7503 | 0 |
| rs12719415 | Imputed | T | DOMINANT | 6.99E−04 | 6.99E−04 | 0.6712 | 0.6712 | 0.8706 | 0 |
| rs12820589 | Imputed | G | ADDITIVE | 3.73E−05 | 3.73E−05 | 1.5773 | 1.5773 | 0.4594 | 0 |
| rs12820589 | Imputed | G | DOMINANT | 8.50E−05 | 8.50E−05 | 1.6354 | 1.6354 | 0.3309 | 0 |
| rs12831292 | Imputed | G | ADDITIVE | 1.08E−04 | 0.0001082 | 0.7143 | 0.7143 | 0.7244 | 0 |
| rs12831292 | Imputed | G | DOMINANT | 3.86E−05 | 3.86E−05 | 0.6038 | 0.6038 | 0.8742 | 0 |
| rs13012636 | Imputed | G | RECESSIVE | 0.005887 | 0.005887 | 1.7676 | 1.7676 | 0.7851 | 0 |
| rs13038146 | Imputed | C | ADDITIVE | 0.0001909 | 0.0001909 | 1.3722 | 1.3722 | 0.8246 | 0 |
| rs13038146 | Imputed | C | GENOTYPIC | 0.0002206 | 0.0002206 | 1.9531 | 1.9531 | 0.7476 | 0 |
| rs13038146 | Imputed | C | RECESSIVE | 0.00156 | 0.00156 | 1.7021 | 1.7021 | 0.4049 | 0 |
| rs13089860 | Imputed | A | DOMINANT | 0.001151 | 0.001151 | 0.6379 | 0.6379 | 0.8916 | 0 |
| rs13102419 | Imputed | T | RECESSIVE | 7.45E−05 | 7.45E−05 | 1.7512 | 1.7512 | 0.8001 | 0 |
| rs13194907 | Imputed | A | ADDITIVE | 7.20E−05 | 7.20E−05 | 1.9871 | 1.9871 | 0.9631 | 0 |
| rs13194907 | Imputed | A | DOMINANT | 4.88E−05 | 4.88E−05 | 2.0957 | 2.0957 | 0.9413 | 0 |
| rs13195745 | Imputed | A | ADDITIVE | 7.54E−05 | 7.54E−05 | 1.9837 | 1.9837 | 0.9685 | 0 |
| rs13195745 | Imputed | A | DOMINANT | 5.13E−05 | 5.13E−05 | 2.0917 | 2.0917 | 0.9353 | 0 |
| rs13265054 | Imputed | T | DOMINANT | 0.0001224 | 0.0001224 | 0.6362 | 0.6362 | 0.7096 | 0 |
| rs13273002 | Imputed | A | GENOTYPIC | 8.64E−05 | 8.64E−05 | 0.2714 | 0.2714 | 0.8433 | 0 |
| rs13282131 | Imputed | C | ADDITIVE | 0.000217 | 0.000217 | 1.3612 | 1.3612 | 0.7192 | 0 |
| rs13282131 | Imputed | C | GENOTYPIC | 0.00017 | 0.00017 | 1.8797 | 1.8797 | 0.7696 | 0 |
| rs13282131 | Imputed | C | RECESSIVE | 0.0009795 | 0.0009795 | 1.6011 | 1.6011 | 0.9829 | 0 |
| rs13330052 | Imputed | G | GENOTYPIC | 8.27E−05 | 8.27E−05 | 2.0747 | 2.0747 | 0.9516 | 0 |
| rs1335721 | Imputed | A | RECESSIVE | 7.06E−05 | 7.06E−05 | 0.5252 | 0.5252 | 0.5509 | 0 |
| rs1336382 | Imputed | T | DOMINANT | 9.54E−05 | 9.54E−05 | 1.5804 | 1.5804 | 0.6104 | 0 |
| rs1336383 | Imputed | T | DOMINANT | 8.97E−05 | 8.97E−05 | 1.5819 | 1.5819 | 0.6066 | 0 |
| rs1336407 | Imputed | T | DOMINANT | 1.35E−04 | 0.0001345 | 1.5612 | 1.5612 | 0.6665 | 0 |
| rs1336409 | Imputed | T | DOMINANT | 0.0001345 | 0.0001345 | 1.5612 | 1.5612 | 0.6665 | 0 |
| rs1336596 | Imputed | A | DOMINANT | 8.41E−06 | 8.41E−06 | 0.5875 | 0.5875 | 0.3994 | 0 |
| rs13387284 | Imputed | A | DOMINANT | 4.10E−05 | 4.10E−05 | 0.5856 | 0.5856 | 0.5635 | 0 |
| rs13401462 | Imputed | C | DOMINANT | 4.87E−06 | 4.87E−06 | 1.8734 | 1.8734 | 0.4869 | 0 |
| rs13409045 | Imputed | T | ADDITIVE | 8.99E−05 | 8.99E−05 | 0.7108 | 0.7108 | 0.8294 | 0 |
| rs1349284 | Imputed | C | GENOTYPIC | 7.91E−05 | 7.91E−05 | 2.0683 | 2.0683 | 0.8608 | 0 |
| rs1355715 | Imputed | T | ADDITIVE | 0.0001691 | 0.0001691 | 0.5021 | 0.5021 | 0.6625 | 0 |
| rs1357696 | Imputed | A | GENOTYPIC | 8.12E−05 | 8.12E−05 | 2.0503 | 2.0503 | 0.8139 | 0 |
| rs1357698 | Imputed | A | GENOTYPIC | 7.29E−05 | 7.29E−05 | 2.0604 | 2.0604 | 0.7974 | 0 |
| rs1357699 | Imputed | T | GENOTYPIC | 7.29E−05 | 7.29E−05 | 2.0604 | 2.0604 | 0.7974 | 0 |
| rs1363273 | Imputed | C | RECESSIVE | 7.91E−05 | 7.91E−05 | 0.5543 | 0.5543 | 0.8284 | 0 |
| rs1373601 | Imputed | A | DOMINANT | 6.34E−05 | 6.34E−05 | 0.6152 | 0.6152 | 0.3644 | 0 |
| rs1375829 | Imputed | C | GENOTYPIC | 7.91E−05 | 7.91E−05 | 2.0683 | 2.0683 | 0.8608 | 0 |
| rs1395748 | Imputed | G | DOMINANT | 7.51E−05 | 7.51E−05 | 0.6306 | 0.6306 | 0.7714 | 0 |
| rs1414865 | Imputed | T | DOMINANT | 1.46E−04 | 0.0001459 | 1.5599 | 1.5599 | 0.592 | 0 |
| rs1414873 | Imputed | A | DOMINANT | 0.0001345 | 0.0001345 | 1.5612 | 1.5612 | 0.6665 | 0 |
| rs1414876 | Imputed | C | DOMINANT | 1.35E−04 | 1.35E−04 | 1.5612 | 1.5612 | 0.6665 | 0 |
| rs1424643 | Imputed | G | ADDITIVE | 4.44E−04 | 0.0004437 | 1.4199 | 1.4199 | 0.4926 | 0 |
| rs1424643 | Imputed | G | DOMINANT | 4.24E−04 | 0.0004238 | 1.5226 | 1.5226 | 0.7796 | 0 |
| rs1424648 | Imputed | T | DOMINANT | 1.80E−03 | 1.80E−03 | 1.4456 | 1.4456 | 0.4734 | 0 |
| rs1429321 | Imputed | A | DOMINANT | 7.84E−04 | 7.84E−04 | 1.4871 | 1.4871 | 0.8099 | 0 |
| rs1429326 | Imputed | T | ADDITIVE | 0.0007358 | 0.0007358 | 1.3974 | 1.3974 | 0.5449 | 0 |
| rs1429326 | Imputed | T | DOMINANT | 0.0004785 | 0.0004785 | 1.5125 | 1.5125 | 0.8054 | 0 |
| rs1444741 | Imputed | A | DOMINANT | 3.42E−05 | 3.42E−05 | 0.605 | 0.605 | 0.3326 | 0 |
| rs1449916 | Imputed | C | DOMINANT | 2.24E−05 | 2.52E−05 | 0.5247 | 0.5244 | 0.3143 | 1.22 |
| rs1459523 | Imputed | A | ADDITIVE | 8.91E−05 | 8.91E−05 | 1.3969 | 1.3969 | 0.7348 | 0 |
| rs1459523 | Imputed | A | GENOTYPIC | 5.30E−05 | 5.30E−05 | 2.0995 | 2.0995 | 0.9749 | 0 |
| rs1466352 | Imputed | T | GENOTYPIC | 7.67E−05 | 7.67E−05 | 2.0358 | 2.0358 | 0.8969 | 0 |
| rs1466353 | Imputed | G | GENOTYPIC | 7.61E−05 | 7.61E−05 | 2.0365 | 2.0365 | 0.898 | 0 |
| rs1476714 | Imputed | A | DOMINANT | 0.0007134 | 0.0007134 | 0.6713 | 0.6713 | 0.8712 | 0 |
| rs1486723 | Imputed | C | RECESSIVE | 0.0003279 | 0.0003279 | 0.4982 | 0.4982 | 0.4282 | 0 |

TABLE 17-continued

| SNP rs # | SOURCE | ALLELE (A1) | MODEL | P | P(R) | OR | OR(R) | Q | I |
|---|---|---|---|---|---|---|---|---|---|
| rs1495375 | Imputed | A | ADDITIVE | 0.0002198 | 0.0002198 | 0.7269 | 0.7269 | 0.7534 | 0 |
| rs1495375 | Imputed | A | DOMINANT | 7.97E−05 | 7.97E−05 | 0.6177 | 0.6177 | 0.8661 | 0 |
| rs1495381 | Imputed | T | GENOTYPIC | 0.00257 | 0.00257 | 1.6918 | 1.6918 | 0.6996 | 0 |
| rs1495381 | Imputed | T | RECESSIVE | 0.0004641 | 0.0004641 | 1.7303 | 1.7303 | 0.8349 | 0 |
| rs1498061 | Imputed | C | ADDITIVE | 1.30E−04 | 0.0001304 | 0.5363 | 0.5363 | 0.5167 | 0 |
| rs1498992 | Imputed | G | DOMINANT | 1.21E−04 | 0.0001213 | 0.6388 | 0.6388 | 0.4443 | 0 |
| rs1499001 | Imputed | T | DOMINANT | 4.88E−05 | 4.88E−05 | 0.6155 | 0.6155 | 0.3606 | 0 |
| rs1512988 | Imputed | A | ADDITIVE | 8.41E−05 | 8.41E−05 | 0.7101 | 0.7101 | 0.6962 | 0 |
| rs1512988 | Imputed | A | DOMINANT | 4.47E−05 | 4.47E−05 | 0.6074 | 0.6074 | 0.9954 | 0 |
| rs1512989 | Imputed | T | ADDITIVE | 8.41E−05 | 8.41E−05 | 0.7101 | 0.7101 | 0.6962 | 0 |
| rs1512989 | Imputed | T | DOMINANT | 4.47E−05 | 4.47E−05 | 0.6074 | 0.6074 | 0.9954 | 0 |
| rs1512991 | Imputed | T | ADDITIVE | 0.000399 | 0.000399 | 0.7396 | 0.7396 | 0.8085 | 0 |
| rs1512991 | Imputed | T | DOMINANT | 0.0001092 | 0.0001092 | 0.6115 | 0.6115 | 0.9069 | 0 |
| rs1512991 | Imputed | T | GENOTYPIC | 0.001397 | 0.001397 | 0.5777 | 0.5777 | 0.6436 | 0 |
| rs1524303 | Imputed | T | GENOTYPIC | 8.11E−05 | 8.11E−05 | 2.0455 | 2.0455 | 0.9122 | 0 |
| rs1524306 | Imputed | C | ADDITIVE | 8.11E−05 | 8.11E−05 | 1.3995 | 1.3995 | 0.7142 | 0 |
| rs1524306 | Imputed | C | GENOTYPIC | 4.94E−05 | 4.94E−05 | 2.1056 | 2.1056 | 0.9589 | 0 |
| rs1524310 | Imputed | G | ADDITIVE | 7.36E−05 | 7.36E−05 | 1.404 | 1.404 | 0.6761 | 0 |
| rs1524310 | Imputed | G | GENOTYPIC | 4.72E−05 | 4.72E−05 | 2.1176 | 2.1176 | 0.9271 | 0 |
| rs1524321 | Imputed | C | GENOTYPIC | 6.09E−05 | 6.09E−05 | 2.0756 | 2.0756 | 0.7818 | 0 |
| rs1527059 | Imputed | A | DOMINANT | 0.004607 | 0.004607 | 0.6321 | 0.6321 | 0.3968 | 0 |
| rs152707 | Imputed | A | ADDITIVE | 6.74E−05 | 6.74E−05 | 0.7127 | 0.7127 | 0.5137 | 0 |
| rs152707 | Imputed | A | GENOTYPIC | 9.17E−05 | 9.17E−05 | 0.4993 | 0.4993 | 0.3954 | 0 |
| rs152712 | Genotyped | C | ADDITIVE | 4.47E−05 | 4.47E−05 | 0.7064 | 0.7064 | 0.5198 | 0 |
| rs152712 | Genotyped | C | GENOTYPIC | 5.75E−05 | 5.75E−05 | 0.4894 | 0.4894 | 0.3791 | 0 |
| rs1533994 | Imputed | T | GENOTYPIC | 6.29E−05 | 6.29E−05 | 2.0565 | 2.0565 | 0.9308 | 0 |
| rs1535866 | Imputed | G | DOMINANT | 0.0004273 | 0.001126 | 1.5272 | 1.5369 | 0.2795 | 14.48 |
| rs1563773 | Imputed | T | GENOTYPIC | 8.07E−05 | 8.07E−05 | 2.0358 | 2.0358 | 0.9519 | 0 |
| rs1563774 | Imputed | T | GENOTYPIC | 8.07E−05 | 8.07E−05 | 2.0374 | 2.0374 | 0.8993 | 0 |
| rs1567740 | Imputed | T | ADDITIVE | 8.27E−05 | 8.27E−05 | 0.7104 | 0.7104 | 0.7004 | 0 |
| rs1567740 | Imputed | T | DOMINANT | 3.96E−05 | 3.96E−05 | 0.6056 | 0.6056 | 0.9636 | 0 |
| rs1572573 | Imputed | A | DOMINANT | 6.70E−05 | 6.70E−05 | 1.64 | 1.64 | 0.4852 | 0 |
| rs1577497 | Imputed | C | RECESSIVE | 7.41E−05 | 7.41E−05 | 0.5263 | 0.5263 | 0.5573 | 0 |
| rs1581514 | Imputed | T | ADDITIVE | 8.95E−05 | 8.95E−05 | 1.3993 | 1.3993 | 0.6083 | 0 |
| rs1581514 | Imputed | T | GENOTYPIC | 5.07E−05 | 5.07E−05 | 2.1081 | 2.1081 | 0.8699 | 0 |
| rs1582321 | Imputed | T | DOMINANT | 4.17E−05 | 4.17E−05 | 0.6096 | 0.6096 | 0.5879 | 0 |
| rs1582322 | Imputed | A | DOMINANT | 6.86E−05 | 6.86E−05 | 0.6175 | 0.6175 | 0.5471 | 0 |
| rs1582323 | Imputed | A | DOMINANT | 6.70E−05 | 6.70E−05 | 0.6171 | 0.6171 | 0.5101 | 0 |
| rs1592485 | Imputed | C | DOMINANT | 6.80E−05 | 6.80E−05 | 0.6167 | 0.6167 | 0.53 | 0 |
| rs1600954 | Imputed | T | ADDITIVE | 6.34E−05 | 6.34E−05 | 1.4064 | 1.4064 | 0.7548 | 0 |
| rs1600954 | Imputed | T | GENOTYPIC | 5.95E−05 | 5.95E−05 | 1.9926 | 1.9926 | 0.7001 | 0 |
| rs16938626 | Imputed | G | DOMINANT | 6.17E−05 | 6.17E−05 | 0.6242 | 0.6242 | 0.8167 | 0 |
| rs16964300 | Imputed | G | ADDITIVE | 0.0001511 | 0.0001511 | 0.6665 | 0.6665 | 0.8478 | 0 |
| rs16964300 | Imputed | G | DOMINANT | 0.0001894 | 0.003074 | 0.6299 | 0.618 | 0.2025 | 38.44 |
| rs16986282 | Imputed | G | DOMINANT | 0.001578 | 0.02315 | 0.4237 | 0.4355 | 0.1825 | 43.73 |
| rs17007620 | Imputed | G | ADDITIVE | 6.23E−05 | 6.23E−05 | 1.5131 | 1.5131 | 0.4281 | 0 |
| rs17007620 | Imputed | G | DOMINANT | 3.79E−05 | 3.79E−05 | 1.684 | 1.684 | 0.4732 | 0 |
| rs17014326 | Imputed | G | DOMINANT | 3.13E−05 | 3.13E−05 | 0.6151 | 0.6151 | 0.5429 | 0 |
| rs17047957 | Imputed | C | DOMINANT | 0.001421 | 0.001421 | 1.5018 | 1.5018 | 0.8023 | 0 |
| rs1705261 | Imputed | A | RECESSIVE | 0.0006289 | 0.0006289 | 1.7058 | 1.7058 | 0.7466 | 0 |
| rs17073341 | Imputed | A | ADDITIVE | 0.000719 | 0.03367 | 2.0963 | 1.9757 | 0.1667 | 47.71 |
| rs17073341 | Imputed | A | DOMINANT | 0.0008057 | 0.0341 | 2.0915 | 1.9741 | 0.1677 | 47.47 |
| rs17138702 | Imputed | G | ADDITIVE | 6.91E−05 | 6.91E−05 | 0.6037 | 0.6037 | 0.343 | 0 |
| rs17189710 | Imputed | T | ADDITIVE | 0.00017 | 0.00017 | 1.3762 | 1.3762 | 0.8443 | 0 |
| rs17189710 | Imputed | T | GENOTYPIC | 0.000209 | 0.000209 | 1.959 | 1.959 | 0.738 | 0 |
| rs17189710 | Imputed | T | RECESSIVE | 0.001525 | 0.001525 | 1.7043 | 1.7043 | 0.4016 | 0 |
| rs17310176 | Imputed | T | ADDITIVE | 0.0009735 | 0.001436 | 0.6909 | 0.6922 | 0.3063 | 4.46 |
| rs17310176 | Imputed | T | DOMINANT | 0.0008163 | 0.01496 | 0.6548 | 0.6669 | 0.1994 | 39.27 |
| rs17358860 | Imputed | A | DOMINANT | 0.002078 | 0.002078 | 0.6804 | 0.6804 | 0.407 | 0 |
| rs17370541 | Imputed | T | GENOTYPIC | 9.33E−05 | 9.33E−05 | 2.055 | 2.055 | 0.3333 | 0 |
| rs17370541 | Imputed | T | RECESSIVE | 6.92E−05 | 6.92E−05 | 1.969 | 1.969 | 0.671 | 0 |
| rs17526574 | Imputed | G | GENOTYPIC | 7.89E−05 | 7.89E−05 | 2.2297 | 2.2297 | 0.9421 | 0 |
| rs17530747 | Imputed | T | DOMINANT | 8.45E−05 | 8.45E−05 | 0.6272 | 0.6272 | 0.3668 | 0 |
| rs17649114 | Imputed | C | DOMINANT | 0.002429 | 0.002429 | 1.4394 | 1.4394 | 0.4375 | 0 |
| rs17766172 | Imputed | A | RECESSIVE | 0.0002007 | 0.0005167 | 0.4665 | 0.4683 | 0.2878 | 11.48 |
| rs1818885 | Imputed | G | GENOTYPIC | 5.46E−05 | 5.46E−05 | 2.1046 | 2.1046 | 0.983 | 0 |
| rs1832222 | Imputed | G | DOMINANT | 0.0001515 | 0.0001515 | 1.5562 | 1.5562 | 0.6814 | 0 |
| rs1861327 | Imputed | G | DOMINANT | 4.17E−05 | 4.17E−05 | 0.6096 | 0.6096 | 0.5879 | 0 |
| rs1868581 | Imputed | G | ADDITIVE | 7.20E−05 | 7.20E−05 | 1.4042 | 1.4042 | 0.6755 | 0 |
| rs1868581 | Imputed | G | GENOTYPIC | 4.84E−05 | 4.84E−05 | 2.1147 | 2.1147 | 0.9348 | 0 |
| rs1874313 | Imputed | A | ADDITIVE | 0.0001307 | 0.0001307 | 0.7177 | 0.7177 | 0.586 | 0 |
| rs1874313 | Imputed | A | DOMINANT | 5.03E−05 | 5.03E−05 | 0.6096 | 0.6096 | 0.9203 | 0 |
| rs1876409 | Imputed | C | DOMINANT | 6.56E−05 | 6.56E−05 | 0.6278 | 0.6278 | 0.8104 | 0 |
| rs1913201 | Imputed | G | ADDITIVE | 0.0004633 | 0.0004633 | 0.7392 | 0.7392 | 0.7118 | 0 |
| rs1913201 | Imputed | G | DOMINANT | 0.0002642 | 0.0002642 | 0.6285 | 0.6285 | 0.7714 | 0 |
| rs1913201 | Imputed | G | GENOTYPIC | 0.001515 | 0.001515 | 0.574 | 0.574 | 0.5208 | 0 |
| rs1916922 | Imputed | T | GENOTYPIC | 8.22E−05 | 8.22E−05 | 2.1096 | 2.1096 | 0.9454 | 0 |
| rs1936871 | Genotyped | G | DOMINANT | 9.04E−05 | 9.04E−05 | 0.6214 | 0.6214 | 0.3679 | 0 |

TABLE 17-continued

| SNP rs # | SOURCE | ALLELE (A1) | MODEL | P | P(R) | OR | OR(R) | Q | I |
|---|---|---|---|---|---|---|---|---|---|
| rs1961157 | Imputed | T | RECESSIVE | 8.54E−05 | 8.54E−05 | 0.5553 | 0.5553 | 0.4429 | 0 |
| rs1987179 | Imputed | T | ADDITIVE | 0.001935 | 0.001935 | 0.7236 | 0.7236 | 0.8673 | 0 |
| rs1987179 | Imputed | T | DOMINANT | 0.000396 | 0.000396 | 0.6536 | 0.6536 | 0.8664 | 0 |
| rs1990023 | Imputed | T | DOMINANT | 0.0005303 | 0.0005303 | 0.6661 | 0.6661 | 0.7286 | 0 |
| rs1995025 | Imputed | C | DOMINANT | 0.001961 | 0.001961 | 1.5088 | 1.5088 | 0.5064 | 0 |
| rs2016194 | Imputed | G | DOMINANT | 0.0007182 | 0.0007182 | 0.6718 | 0.6718 | 0.875 | 0 |
| rs2023651 | Imputed | T | ADDITIVE | 3.73E−05 | 3.73E−05 | 0.6532 | 0.6532 | 0.5375 | 0 |
| rs2024902 | Imputed | A | ADDITIVE | 7.20E−05 | 7.20E−05 | 1.9871 | 1.9871 | 0.9631 | 0 |
| rs2024902 | Imputed | A | DOMINANT | 4.88E−05 | 4.88E−05 | 2.0957 | 2.0957 | 0.9413 | 0 |
| rs2025107 | Imputed | A | DOMINANT | 5.94E−05 | 5.94E−05 | 1.9576 | 1.9576 | 0.6125 | 0 |
| rs2025108 | Imputed | T | DOMINANT | 8.65E−05 | 8.65E−05 | 1.9168 | 1.9168 | 0.7647 | 0 |
| rs2031987 | Imputed | T | GENOTYPIC | 7.93E−05 | 7.93E−05 | 2.2431 | 2.2431 | 0.9603 | 0 |
| rs2052428 | Imputed | C | DOMINANT | 0.0001903 | 0.0001903 | 0.6109 | 0.6109 | 0.7253 | 0 |
| rs2053230 | Imputed | C | ADDITIVE | 6.65E−05 | 6.65E−05 | 0.5491 | 0.5491 | 0.7036 | 0 |
| rs2062448 | Imputed | T | DOMINANT | 9.26E−05 | 9.26E−05 | 0.5424 | 0.5424 | 0.9524 | 0 |
| rs2063420 | Imputed | C | RECESSIVE | 8.43E−05 | 8.43E−05 | 1.8009 | 1.8009 | 0.8175 | 0 |
| rs2063591 | Imputed | C | ADDITIVE | 0.001336 | 0.001336 | 0.7622 | 0.7622 | 0.8243 | 0 |
| rs2063591 | Imputed | C | DOMINANT | 0.0001828 | 0.0001828 | 0.619 | 0.619 | 0.9374 | 0 |
| rs208026 | Genotyped | A | DOMINANT | 0.0009159 | 0.0009159 | 1.4777 | 1.4777 | 0.8719 | 0 |
| rs208029 | Imputed | T | DOMINANT | 0.0032 | 0.0032 | 1.4242 | 1.4242 | 0.911 | 0 |
| rs208757 | Imputed | G | DOMINANT | 0.002063 | 0.002063 | 1.4401 | 1.4401 | 0.8897 | 0 |
| rs2095586 | Imputed | A | DOMINANT | 9.55E−05 | 9.55E−05 | 1.582 | 1.582 | 0.6057 | 0 |
| rs2095606 | Imputed | A | DOMINANT | 6.15E−06 | 6.15E−06 | 0.5812 | 0.5812 | 0.4893 | 0 |
| rs2102374 | Imputed | A | ADDITIVE | 2.38E−05 | 2.38E−05 | 0.6664 | 0.6664 | 0.4161 | 0 |
| rs2102374 | Imputed | A | DOMINANT | 1.59E−05 | 1.59E−05 | 0.6016 | 0.6016 | 0.9592 | 0 |
| rs2108426 | Imputed | C | DOMINANT | 0.0007182 | 0.0007182 | 0.6718 | 0.6718 | 0.875 | 0 |
| rs2110664 | Imputed | A | DOMINANT | 0.0002336 | 0.0002336 | 1.5536 | 1.5536 | 0.3488 | 0 |
| rs2132242 | Imputed | A | ADDITIVE | 0.0001077 | 0.0001077 | 0.7156 | 0.7156 | 0.7142 | 0 |
| rs2132242 | Imputed | A | DOMINANT | 5.48E−05 | 5.48E−05 | 0.6098 | 0.6098 | 0.9205 | 0 |
| rs2158958 | Imputed | A | DOMINANT | 0.000699 | 0.000699 | 0.6712 | 0.6712 | 0.8706 | 0 |
| rs2158961 | Imputed | G | DOMINANT | 0.000697 | 0.000697 | 0.6715 | 0.6715 | 0.7678 | 0 |
| rs2163046 | Imputed | A | DOMINANT | 0.0008376 | 0.0008376 | 1.4873 | 1.4873 | 0.9201 | 0 |
| rs2180286 | Imputed | G | DOMINANT | 0.001385 | 0.001385 | 0.6528 | 0.6528 | 0.6017 | 0 |
| rs2180684 | Imputed | A | DOMINANT | 0.0009602 | 0.0009602 | 1.6598 | 1.6598 | 0.8934 | 0 |
| rs2188079 | Imputed | C | ADDITIVE | 7.00E−05 | 7.00E−05 | 1.3978 | 1.3978 | 0.4286 | 0 |
| rs2188079 | Imputed | C | GENOTYPIC | 4.81E−05 | 4.81E−05 | 2.0195 | 2.0195 | 0.6225 | 0 |
| rs2190598 | Imputed | T | DOMINANT | 0.000699 | 0.000699 | 0.6712 | 0.6712 | 0.8706 | 0 |
| rs2190600 | Imputed | A | DOMINANT | 0.0009994 | 0.0009994 | 0.6775 | 0.6775 | 0.9204 | 0 |
| rs2224184 | Genotyped | T | DOMINANT | 0.001793 | 0.001793 | 0.6621 | 0.6621 | 0.6649 | 0 |
| rs2247066 | Imputed | A | DOMINANT | 7.51E−05 | 7.51E−05 | 0.6306 | 0.6306 | 0.7714 | 0 |
| rs2248236 | Imputed | C | ADDITIVE | 0.0005358 | 0.0005358 | 0.6815 | 0.6815 | 0.4894 | 0 |
| rs2248236 | Imputed | C | DOMINANT | 0.0001555 | 0.0001555 | 0.619 | 0.619 | 0.8208 | 0 |
| rs2265733 | Imputed | C | ADDITIVE | 2.38E−05 | 2.38E−05 | 0.6664 | 0.6664 | 0.4161 | 0 |
| rs2265733 | Imputed | C | DOMINANT | 1.59E−05 | 1.59E−05 | 0.6016 | 0.6016 | 0.9592 | 0 |
| rs2270584 | Imputed | A | ADDITIVE | 0.0001667 | 0.0001667 | 0.7239 | 0.7239 | 0.6562 | 0 |
| rs2270584 | Imputed | A | DOMINANT | 1.41E−05 | 1.41E−05 | 0.5915 | 0.5915 | 0.9146 | 0 |
| rs2270586 | Imputed | A | ADDITIVE | 0.0001716 | 0.0001716 | 0.7243 | 0.7243 | 0.6525 | 0 |
| rs2270586 | Imputed | A | DOMINANT | 1.54E−05 | 1.54E−05 | 0.5928 | 0.5928 | 0.9252 | 0 |
| rs229775 | Imputed | A | RECESSIVE | 0.000111 | 0.000111 | 0.4573 | 0.4573 | 0.3307 | 0 |
| rs229815 | Imputed | T | RECESSIVE | 0.0002282 | 0.0002282 | 0.4565 | 0.4565 | 0.4856 | 0 |
| rs229829 | Imputed | C | RECESSIVE | 0.0005435 | 0.0005435 | 0.5446 | 0.5446 | 0.5763 | 0 |
| rs229831 | Imputed | A | RECESSIVE | 0.0002275 | 0.002067 | 0.469 | 0.4773 | 0.2519 | 23.81 |
| rs2317057 | Imputed | T | ADDITIVE | 0.002089 | 0.002089 | 0.7151 | 0.7151 | 0.9648 | 0 |
| rs2322100 | Genotyped | T | RECESSIVE | 0.000848 | 0.000848 | 2.0921 | 2.0921 | 0.3268 | 0 |
| rs2322101 | Imputed | A | RECESSIVE | 0.0008488 | 0.0008488 | 2.0923 | 2.0923 | 0.3199 | 0 |
| rs2327929 | Imputed | G | RECESSIVE | 6.56E−05 | 6.56E−05 | 1.7968 | 1.7968 | 0.3419 | 0 |
| rs2332844 | Imputed | A | ADDITIVE | 2.83E−05 | 2.83E−05 | 1.7997 | 1.7997 | 0.9786 | 0 |
| rs2332844 | Imputed | A | RECESSIVE | 0.0001148 | 0.0001148 | 1.8396 | 1.8396 | 0.9347 | 0 |
| rs2349170 | Imputed | G | DOMINANT | 0.0004675 | 0.0004675 | 1.5226 | 1.5226 | 0.4042 | 0 |
| rs2356722 | Imputed | G | DOMINANT | 2.78E−05 | 2.78E−05 | 0.6136 | 0.6136 | 0.5952 | 0 |
| rs2364956 | Imputed | T | ADDITIVE | 7.88E−05 | 7.88E−05 | 1.5326 | 1.5326 | 0.464 | 0 |
| rs2373793 | Imputed | G | ADDITIVE | 0.0006153 | 0.0006153 | 1.4555 | 1.4555 | 0.5436 | 0 |
| rs2373793 | Imputed | G | DOMINANT | 0.0002422 | 0.0002422 | 1.5984 | 1.5984 | 0.3199 | 0 |
| rs238252 | Imputed | G | ADDITIVE | 3.92E−05 | 3.92E−05 | 1.6115 | 1.6115 | 0.7369 | 0 |
| rs238252 | Imputed | G | DOMINANT | 2.65E−05 | 2.65E−05 | 1.7462 | 1.7462 | 0.5867 | 0 |
| rs2383903 | Imputed | G | DOMINANT | 9.89E−05 | 9.89E−05 | 0.6336 | 0.6336 | 0.873 | 0 |
| rs2387945 | Imputed | G | DOMINANT | 0.002288 | 0.002288 | 1.4967 | 1.4967 | 0.5359 | 0 |
| rs2389863 | Imputed | A | DOMINANT | 0.0005489 | 0.0005489 | 0.6585 | 0.6585 | 0.8176 | 0 |
| rs2389866 | Imputed | C | DOMINANT | 0.000396 | 0.000396 | 0.6536 | 0.6536 | 0.8664 | 0 |
| rs2389869 | Imputed | C | DOMINANT | 0.000396 | 0.000396 | 0.6536 | 0.6536 | 0.8664 | 0 |
| rs2389870 | Genotyped | C | DOMINANT | 0.003433 | 0.003433 | 0.6945 | 0.6945 | 0.3965 | 0 |
| rs2418494 | Imputed | G | ADDITIVE | 0.002097 | 0.002097 | 0.7772 | 0.7772 | 0.4019 | 0 |
| rs2418494 | Imputed | G | GENOTYPIC | 0.001772 | 0.001772 | 0.5989 | 0.5989 | 0.3574 | 0 |
| rs2418541 | Imputed | A | DOMINANT | 0.0005303 | 0.0005303 | 0.6661 | 0.6661 | 0.7286 | 0 |
| rs2418542 | Imputed | A | DOMINANT | 0.0005772 | 0.0005772 | 0.6679 | 0.6679 | 0.7414 | 0 |
| rs2423556 | Imputed | C | DOMINANT | 0.001354 | 0.001354 | 0.6507 | 0.6507 | 0.5885 | 0 |
| rs2437688 | Imputed | C | ADDITIVE | 0.004791 | 0.004791 | 1.4661 | 1.4661 | 0.9462 | 0 |
| rs2456809 | Imputed | G | DOMINANT | 6.91E−05 | 6.91E−05 | 0.6286 | 0.6286 | 0.7989 | 0 |

TABLE 17-continued

| SNP rs # | SOURCE | ALLELE (A1) | MODEL | P | P(R) | OR | OR(R) | Q | I |
|---|---|---|---|---|---|---|---|---|---|
| rs2456811 | Imputed | T | ADDITIVE | 2.64E-05 | 2.64E-05 | 0.6679 | 0.6679 | 0.4268 | 0 |
| rs2456811 | Imputed | T | DOMINANT | 1.79E-05 | 1.79E-05 | 0.6034 | 0.6034 | 0.9743 | 0 |
| rs2476976 | Imputed | C | DOMINANT | 0.0002835 | 0.0002835 | 1.5277 | 1.5277 | 0.6105 | 0 |
| rs2484911 | Imputed | A | DOMINANT | 0.0002659 | 0.0002659 | 1.5304 | 1.5304 | 0.8231 | 0 |
| rs2488557 | Imputed | C | DOMINANT | 9.46E-05 | 9.46E-05 | 0.5776 | 0.5776 | 0.6502 | 0 |
| rs250162 | Imputed | C | ADDITIVE | 0.000113 | 0.0003838 | 0.6768 | 0.6731 | 0.2772 | 15.32 |
| rs250162 | Imputed | C | DOMINANT | 4.84E-05 | 0.0006095 | 0.6135 | 0.6056 | 0.2344 | 29.27 |
| rs2560708 | Imputed | T | ADDITIVE | 0.0002656 | 0.0002656 | 0.6487 | 0.6487 | 0.5707 | 0 |
| rs2617841 | Imputed | G | DOMINANT | 0.0002103 | 0.0002103 | 0.633 | 0.633 | 0.4225 | 0 |
| rs2622499 | Imputed | G | DOMINANT | 0.0004741 | 0.0004741 | 0.6573 | 0.6573 | 0.8397 | 0 |
| rs264129 | Imputed | T | DOMINANT | 0.0007594 | 0.0007594 | 0.6718 | 0.6718 | 0.7413 | 0 |
| rs2642936 | Imputed | T | ADDITIVE | 9.35E-05 | 9.35E-05 | 1.4936 | 1.4936 | 0.3776 | 0 |
| rs2660633 | Imputed | A | DOMINANT | 6.56E-05 | 6.56E-05 | 0.6278 | 0.6278 | 0.8104 | 0 |
| rs2660634 | Imputed | C | DOMINANT | 6.56E-05 | 6.56E-05 | 0.6278 | 0.6278 | 0.8104 | 0 |
| rs2660648 | Imputed | A | ADDITIVE | 2.38E-05 | 2.38E-05 | 0.6664 | 0.6664 | 0.4161 | 0 |
| rs2660648 | Imputed | A | DOMINANT | 1.59E-05 | 1.59E-05 | 0.6016 | 0.6016 | 0.9592 | 0 |
| rs2681505 | Imputed | T | ADDITIVE | 1.62E-05 | 1.62E-05 | 0.6474 | 0.6474 | 0.7786 | 0 |
| rs277411 | Imputed | G | DOMINANT | 4.27E-05 | 4.27E-05 | 0.3261 | 0.3261 | 0.7363 | 0 |
| rs2832634 | Imputed | G | ADDITIVE | 0.001422 | 0.001422 | 1.8637 | 1.8637 | 0.4977 | 0 |
| rs2832637 | Imputed | T | ADDITIVE | 0.001422 | 0.001422 | 1.8637 | 1.8637 | 0.4977 | 0 |
| rs2843167 | Imputed | A | DOMINANT | 4.64E-05 | 4.64E-05 | 0.6208 | 0.6208 | 0.6602 | 0 |
| rs2876227 | Imputed | C | ADDITIVE | 0.0004318 | 0.0004318 | 1.3526 | 1.3526 | 0.8494 | 0 |
| rs2876227 | Imputed | C | GENOTYPIC | 0.0004406 | 0.0004406 | 1.9073 | 1.9073 | 0.726 | 0 |
| rs2882097 | Imputed | A | DOMINANT | 8.97E-05 | 8.97E-05 | 1.5819 | 1.5819 | 0.6066 | 0 |
| rs2909862 | Imputed | G | DOMINANT | 8.19E-05 | 8.19E-05 | 1.7275 | 1.7275 | 0.4161 | 0 |
| rs3001945 | Imputed | T | DOMINANT | 0.001929 | 0.001929 | 1.5254 | 1.5254 | 0.656 | 0 |
| rs3011020 | Imputed | C | DOMINANT | 0.002194 | 0.002194 | 1.4992 | 1.4992 | 0.5299 | 0 |
| rs36071725 | Genotyped | C | ADDITIVE | 4.45E-06 | 4.45E-06 | 1.4999 | 1.4999 | 0.8099 | 0 |
| rs36071725 | Genotyped | C | GENOTYPIC | 2.95E-06 | 1.95E-05 | 2.5235 | 2.5053 | 0.2811 | 13.92 |
| rs373983 | Imputed | G | DOMINANT | 0.001847 | 0.001847 | 1.4715 | 1.4715 | 0.5548 | 0 |
| rs3743794 | Imputed | G | DOMINANT | 9.02E-05 | 9.02E-05 | 0.6224 | 0.6224 | 0.5016 | 0 |
| rs3756154 | Imputed | C | ADDITIVE | 0.001935 | 0.001935 | 0.7236 | 0.7236 | 0.8673 | 0 |
| rs3756154 | Imputed | C | DOMINANT | 0.000396 | 0.000396 | 0.6536 | 0.6536 | 0.8664 | 0 |
| rs3775850 | Imputed | A | DOMINANT | 0.001884 | 0.001884 | 0.6779 | 0.6779 | 0.3941 | 0 |
| rs3775851 | Imputed | C | DOMINANT | 0.00239 | 0.00239 | 0.6839 | 0.6839 | 0.4246 | 0 |
| rs3793044 | Imputed | C | ADDITIVE | 9.83E-05 | 9.83E-05 | 1.9638 | 1.9638 | 0.8837 | 0 |
| rs3793044 | Imputed | C | DOMINANT | 6.76E-05 | 6.76E-05 | 2.0697 | 2.0697 | 0.9811 | 0 |
| rs3793053 | Imputed | C | DOMINANT | 5.01E-05 | 5.01E-05 | 1.9787 | 1.9787 | 0.624 | 0 |
| rs3796246 | Imputed | G | DOMINANT | 8.90E-05 | 8.90E-05 | 0.5398 | 0.5398 | 0.4358 | 0 |
| rs3806003 | Imputed | A | ADDITIVE | 9.83E-05 | 9.83E-05 | 1.9638 | 1.9638 | 0.8837 | 0 |
| rs3806003 | Imputed | A | DOMINANT | 6.76E-05 | 6.76E-05 | 2.0697 | 2.0697 | 0.9811 | 0 |
| rs3806004 | Imputed | T | DOMINANT | 5.94E-05 | 5.94E-05 | 1.9576 | 1.9576 | 0.6125 | 0 |
| rs3806010 | Imputed | T | DOMINANT | 5.94E-05 | 5.94E-05 | 1.9576 | 1.9576 | 0.6125 | 0 |
| rs3806014 | Imputed | T | DOMINANT | 5.67E-05 | 5.67E-05 | 1.9649 | 1.9649 | 0.6221 | 0 |
| rs3806015 | Imputed | A | DOMINANT | 5.94E-05 | 5.94E-05 | 1.9576 | 1.9576 | 0.6125 | 0 |
| rs3806018 | Imputed | A | DOMINANT | 7.82E-05 | 7.82E-05 | 1.9419 | 1.9419 | 0.5908 | 0 |
| rs3806019 | Imputed | A | DOMINANT | 5.94E-05 | 5.94E-05 | 1.9576 | 1.9576 | 0.6125 | 0 |
| rs3806024 | Imputed | T | DOMINANT | 5.01E-05 | 5.01E-05 | 1.9787 | 1.9787 | 0.624 | 0 |
| rs3915080 | Imputed | A | GENOTYPIC | 5.44E-05 | 5.44E-05 | 2.0907 | 2.0907 | 0.9248 | 0 |
| rs3942254 | Imputed | T | ADDITIVE | 0.0001416 | 0.0001416 | 0.7166 | 0.7166 | 0.775 | 0 |
| rs3942254 | Imputed | T | DOMINANT | 7.52E-05 | 7.52E-05 | 0.6139 | 0.6139 | 0.912 | 0 |
| rs3945085 | Imputed | A | DOMINANT | 6.75E-05 | 6.75E-05 | 1.5947 | 1.5947 | 0.7622 | 0 |
| rs3976737 | Imputed | G | ADDITIVE | 4.73E-05 | 4.73E-05 | 0.6147 | 0.6147 | 0.6857 | 0 |
| rs399485 | Imputed | A | DOMINANT | 0.001322 | 0.001322 | 1.4553 | 1.4553 | 0.9598 | 0 |
| rs4029119 | Imputed | G | ADDITIVE | 2.65E-05 | 2.65E-05 | 0.2569 | 0.2569 | 0.4764 | 0 |
| rs4029119 | Imputed | G | DOMINANT | 5.81E-05 | 5.81E-05 | 0.2637 | 0.2637 | 0.5057 | 0 |
| rs4076201 | Imputed | G | GENOTYPIC | 0.0001779 | 0.0001779 | 3.0129 | 3.0129 | 0.881 | 0 |
| rs4076201 | Imputed | G | RECESSIVE | 0.0001745 | 0.0001745 | 2.9721 | 2.9721 | 0.9936 | 0 |
| rs41395945 | Imputed | G | ADDITIVE | 0.001422 | 0.001422 | 1.8637 | 1.8637 | 0.4977 | 0 |
| rs41395945 | Imputed | G | DOMINANT | 0.001383 | 0.001383 | 1.9054 | 1.9054 | 0.5854 | 0 |
| rs4146972 | Genotyped | T | DOMINANT | 0.002023 | 0.002023 | 1.4758 | 1.4758 | 0.7768 | 0 |
| rs4238087 | Imputed | G | DOMINANT | 0.001528 | 0.002511 | 0.6487 | 0.6459 | 0.2941 | 9.14 |
| rs4251569 | Imputed | T | ADDITIVE | 0.000865 | 0.000865 | 0.6585 | 0.6585 | 0.319 | 0 |
| rs4251569 | Imputed | T | DOMINANT | 0.001524 | 0.002494 | 0.6487 | 0.6458 | 0.2944 | 9.05 |
| rs4273613 | Imputed | T | ADDITIVE | 1.27E-05 | 1.27E-05 | 0.2451 | 0.2451 | 0.6218 | 0 |
| rs4273613 | Imputed | T | DOMINANT | 2.81E-05 | 2.81E-05 | 0.2509 | 0.2509 | 0.6535 | 0 |
| rs4291049 | Imputed | T | RECESSIVE | 6.91E-05 | 6.91E-05 | 0.5605 | 0.5605 | 0.8377 | 0 |
| rs4315598 | Imputed | T | ADDITIVE | 0.0002132 | 0.0002132 | 1.369 | 1.369 | 0.8084 | 0 |
| rs4315598 | Imputed | T | GENOTYPIC | 0.0002436 | 0.0002436 | 1.9445 | 1.9445 | 0.7616 | 0 |
| rs4315598 | Imputed | T | RECESSIVE | 0.001637 | 0.001637 | 1.6981 | 1.6981 | 0.4109 | 0 |
| rs4321395 | Imputed | A | DOMINANT | 4.10E-05 | 4.10E-05 | 0.5856 | 0.5856 | 0.5635 | 0 |
| rs4321596 | Genotyped | T | RECESSIVE | 0.001013 | 0.001013 | 2.3233 | 2.3233 | 0.5608 | 0 |
| rs4324417 | Imputed | T | DOMINANT | 9.41E-05 | 9.41E-05 | 1.6531 | 1.6531 | 0.6731 | 0 |
| rs4328619 | Genotyped | G | DOMINANT | 0.002587 | 0.002587 | 0.6704 | 0.6704 | 0.826 | 0 |
| rs4338909 | Imputed | T | ADDITIVE | 9.61E-05 | 9.61E-05 | 1.3842 | 1.3842 | 0.8254 | 0 |
| rs4370878 | Imputed | G | DOMINANT | 9.82E-05 | 9.82E-05 | 1.5785 | 1.5785 | 0.7378 | 0 |
| rs4379434 | Genotyped | T | DOMINANT | 9.48E-05 | 9.48E-05 | 1.6163 | 1.6163 | 0.9593 | 0 |
| rs4416407 | Imputed | T | DOMINANT | 0.0001694 | 0.0001694 | 1.6929 | 1.6929 | 0.489 | 0 |

TABLE 17-continued

| SNP rs # | SOURCE | ALLELE (A1) | MODEL | P | P(R) | OR | OR(R) | Q | I |
|---|---|---|---|---|---|---|---|---|---|
| rs4417899 | Imputed | C | RECESSIVE | 0.000157 | 0.000157 | 0.5892 | 0.5892 | 0.4805 | 0 |
| rs4442732 | Imputed | A | ADDITIVE | 8.41E−05 | 8.41E−05 | 0.6531 | 0.6531 | 0.3436 | 0 |
| rs4444612 | Imputed | G | ADDITIVE | 0.0001677 | 0.0001677 | 1.3768 | 1.3768 | 0.8476 | 0 |
| rs4444612 | Imputed | G | GENOTYPIC | 0.00021 | 0.00021 | 1.9589 | 1.9589 | 0.738 | 0 |
| rs4444612 | Imputed | G | RECESSIVE | 0.001571 | 0.001571 | 1.7015 | 1.7015 | 0.4057 | 0 |
| rs4450660 | Imputed | C | DOMINANT | 8.36E−05 | 8.36E−05 | 1.5918 | 1.5918 | 0.5023 | 0 |
| rs4509702 | Imputed | C | DOMINANT | 9.82E−05 | 9.82E−05 | 1.5785 | 1.5785 | 0.7378 | 0 |
| rs4526920 | Imputed | G | GENOTYPIC | 7.93E−05 | 7.93E−05 | 2.2431 | 2.2431 | 0.9603 | 0 |
| rs4533145 | Imputed | T | DOMINANT | 9.22E−05 | 9.22E−05 | 0.5529 | 0.5529 | 0.3518 | 0 |
| rs4557006 | Imputed | A | DOMINANT | 8.75E−05 | 8.75E−05 | 0.5972 | 0.5972 | 0.5878 | 0 |
| rs4570530 | Imputed | C | DOMINANT | 9.82E−05 | 9.82E−05 | 1.5785 | 1.5785 | 0.7378 | 0 |
| rs4615971 | Imputed | C | DOMINANT | 0.0001298 | 0.0001298 | 1.5635 | 1.5635 | 0.7109 | 0 |
| rs4628119 | Imputed | A | DOMINANT | 6.11E−05 | 6.11E−05 | 0.6205 | 0.6205 | 0.3365 | 0 |
| rs4664443 | Imputed | G | ADDITIVE | 7.56E−05 | 7.56E−05 | 0.7086 | 0.7086 | 0.8496 | 0 |
| rs4688259 | Imputed | T | DOMINANT | 0.0001678 | 0.0001678 | 1.6935 | 1.6935 | 0.4878 | 0 |
| rs4688632 | Imputed | G | RECESSIVE | 0.0001642 | 0.0001642 | 0.5987 | 0.5987 | 0.51 | 0 |
| rs4695284 | Imputed | A | ADDITIVE | 8.64E−05 | 8.64E−05 | 1.894 | 1.894 | 0.3836 | 0 |
| rs4700302 | Imputed | A | ADDITIVE | 9.09E−05 | 9.09E−05 | 0.5243 | 0.5243 | 0.8943 | 0 |
| rs4702720 | Imputed | A | ADDITIVE | 0.0001094 | 0.0001094 | 0.6414 | 0.6414 | 0.5372 | 0 |
| rs4702720 | Imputed | A | DOMINANT | 0.0001621 | 0.0001621 | 0.5989 | 0.5989 | 0.3199 | 0 |
| rs4711091 | Genotyped | G | GENOTYPIC | 9.08E−05 | 9.08E−05 | 1.8967 | 1.8967 | 0.4866 | 0 |
| rs4714484 | Imputed | A | ADDITIVE | 4.13E−05 | 4.13E−05 | 0.6276 | 0.6276 | 0.4538 | 0 |
| rs4736802 | Imputed | G | DOMINANT | 7.12E−05 | 7.12E−05 | 1.6304 | 1.6304 | 0.9501 | 0 |
| rs4760785 | Imputed | A | ADDITIVE | 0.0004633 | 0.0004633 | 0.7392 | 0.7392 | 0.7118 | 0 |
| rs4760785 | Imputed | A | DOMINANT | 0.0002642 | 0.0002642 | 0.6285 | 0.6285 | 0.7714 | 0 |
| rs4760785 | Imputed | A | GENOTYPIC | 0.001515 | 0.001515 | 0.574 | 0.574 | 0.5208 | 0 |
| rs4760894 | Imputed | T | ADDITIVE | 0.0004633 | 0.0004633 | 0.7392 | 0.7392 | 0.7118 | 0 |
| rs4760894 | Imputed | T | DOMINANT | 0.0002642 | 0.0002642 | 0.6285 | 0.6285 | 0.7714 | 0 |
| rs4760894 | Imputed | T | GENOTYPIC | 0.001515 | 0.001515 | 0.574 | 0.574 | 0.5208 | 0 |
| rs4760895 | Imputed | A | ADDITIVE | 0.0004633 | 0.0004633 | 0.7392 | 0.7392 | 0.7118 | 0 |
| rs4760895 | Imputed | A | DOMINANT | 0.0002642 | 0.0002642 | 0.6285 | 0.6285 | 0.7714 | 0 |
| rs4760895 | Imputed | A | GENOTYPIC | 0.001515 | 0.001515 | 0.574 | 0.574 | 0.5208 | 0 |
| rs4764738 | Imputed | A | ADDITIVE | 5.30E−05 | 5.30E−05 | 1.4051 | 1.4051 | 0.3785 | 0 |
| rs4764738 | Imputed | A | GENOTYPIC | 5.29E−05 | 5.29E−05 | 1.9728 | 1.9728 | 0.3836 | 0 |
| rs4764974 | Imputed | T | ADDITIVE | 9.56E−05 | 9.56E−05 | 1.3855 | 1.3855 | 0.4436 | 0 |
| rs4764974 | Imputed | T | GENOTYPIC | 9.35E−05 | 9.35E−05 | 1.9196 | 1.9196 | 0.4483 | 0 |
| rs4798366 | Imputed | G | RECESSIVE | 0.001711 | 0.001711 | 1.8332 | 1.8332 | 0.3582 | 0 |
| rs483159 | Imputed | T | DOMINANT | 0.004772 | 0.004772 | 1.4202 | 1.4202 | 0.9716 | 0 |
| rs4836502 | Imputed | T | DOMINANT | 0.000699 | 0.000699 | 0.6712 | 0.6712 | 0.8706 | 0 |
| rs4836507 | Imputed | C | DOMINANT | 0.0009994 | 0.0009994 | 0.6775 | 0.6775 | 0.9204 | 0 |
| rs4836744 | Imputed | A | ADDITIVE | 0.0006425 | 0.0006425 | 0.7345 | 0.7345 | 0.7018 | 0 |
| rs4836744 | Imputed | A | DOMINANT | 0.001186 | 0.001186 | 0.6854 | 0.6854 | 0.8412 | 0 |
| rs4848944 | Genotyped | C | RECESSIVE | 0.0002524 | 0.003005 | 0.5945 | 0.5819 | 0.2143 | 35.17 |
| rs4851529 | Imputed | A | DOMINANT | 0.0003125 | 0.0003125 | 0.6476 | 0.6476 | 0.4109 | 0 |
| rs4851531 | Imputed | T | DOMINANT | 0.000688 | 0.0011 | 0.6621 | 0.6602 | 0.2981 | 7.64 |
| rs4858046 | Genotyped | T | GENOTYPIC | 7.90E−05 | 7.90E−05 | 2.0533 | 2.0533 | 0.925 | 0 |
| rs4878214 | Imputed | A | ADDITIVE | 9.56E−05 | 9.56E−05 | 0.6477 | 0.6477 | 0.3504 | 0 |
| rs4880803 | Imputed | A | ADDITIVE | 0.003664 | 0.003664 | 0.7694 | 0.7694 | 0.9093 | 0 |
| rs489441 | Imputed | G | ADDITIVE | 3.10E−05 | 3.10E−05 | 1.4992 | 1.4992 | 0.6179 | 0 |
| rs489441 | Imputed | G | DOMINANT | 8.27E−05 | 8.27E−05 | 1.6072 | 1.6072 | 0.8697 | 0 |
| rs4896568 | Imputed | T | DOMINANT | 8.36E−05 | 8.36E−05 | 0.6231 | 0.6231 | 0.3985 | 0 |
| rs4938851 | Imputed | T | DOMINANT | 0.001901 | 0.001901 | 1.4515 | 1.4515 | 0.4953 | 0 |
| rs4964416 | Imputed | C | DOMINANT | 0.0004167 | 0.0004167 | 0.6251 | 0.6251 | 0.6468 | 0 |
| rs5756669 | Imputed | C | DOMINANT | 9.41E−05 | 9.41E−05 | 1.6531 | 1.6531 | 0.6731 | 0 |
| rs6033138 | Imputed | C | ADDITIVE | 0.000116 | 0.000116 | 1.3837 | 1.3837 | 0.8829 | 0 |
| rs6033138 | Imputed | C | GENOTYPIC | 0.0001829 | 0.0001829 | 1.9484 | 1.9484 | 0.7574 | 0 |
| rs6033138 | Imputed | C | RECESSIVE | 0.001659 | 0.001659 | 1.6769 | 1.6769 | 0.4494 | 0 |
| rs6040619 | Imputed | C | ADDITIVE | 0.0001132 | 0.0001132 | 1.3881 | 1.3881 | 0.5479 | 0 |
| rs6040619 | Imputed | C | GENOTYPIC | 9.53E−05 | 9.53E−05 | 2.0334 | 2.0334 | 0.8541 | 0 |
| rs6040619 | Imputed | C | RECESSIVE | 0.0005843 | 0.0005843 | 1.7879 | 1.7879 | 0.803 | 0 |
| rs6040625 | Imputed | T | ADDITIVE | 0.0001123 | 0.0001123 | 1.3888 | 1.3888 | 0.589 | 0 |
| rs6040625 | Imputed | T | GENOTYPIC | 0.0001128 | 0.0001128 | 2.0214 | 2.0214 | 0.9212 | 0 |
| rs6040625 | Imputed | T | RECESSIVE | 0.0007645 | 0.0007645 | 1.7684 | 1.7684 | 0.7342 | 0 |
| rs6040630 | Imputed | A | ADDITIVE | 0.0001671 | 0.0001671 | 1.3767 | 1.3767 | 0.7848 | 0 |
| rs6040630 | Imputed | A | GENOTYPIC | 0.0001796 | 0.0001796 | 1.9741 | 1.9741 | 0.807 | 0 |
| rs6040630 | Imputed | A | RECESSIVE | 0.001227 | 0.001227 | 1.7241 | 1.7241 | 0.4626 | 0 |
| rs6040633 | Imputed | A | ADDITIVE | 0.000204 | 0.000204 | 1.3703 | 1.3703 | 0.8149 | 0 |
| rs6040633 | Imputed | A | GENOTYPIC | 0.0002355 | 0.0002355 | 1.9475 | 1.9475 | 0.7566 | 0 |
| rs6040633 | Imputed | A | RECESSIVE | 0.001596 | 0.001596 | 1.6999 | 1.6999 | 0.4082 | 0 |
| rs6040634 | Imputed | T | ADDITIVE | 0.0001909 | 0.0001909 | 1.3722 | 1.3722 | 0.8246 | 0 |
| rs6040634 | Imputed | T | GENOTYPIC | 0.0002206 | 0.0002206 | 1.9531 | 1.9531 | 0.7476 | 0 |
| rs6040634 | Imputed | T | RECESSIVE | 0.00156 | 0.00156 | 1.7021 | 1.7021 | 0.4049 | 0 |
| rs6040636 | Imputed | T | ADDITIVE | 0.0001672 | 0.0001672 | 1.3761 | 1.3761 | 0.8442 | 0 |
| rs6040636 | Imputed | T | GENOTYPIC | 0.0002085 | 0.0002085 | 1.9585 | 1.9585 | 0.7388 | 0 |
| rs6040636 | Imputed | T | RECESSIVE | 0.00156 | 0.00156 | 1.7021 | 1.7021 | 0.4049 | 0 |
| rs6040638 | Imputed | C | ADDITIVE | 0.0001909 | 0.0001909 | 1.3722 | 1.3722 | 0.8246 | 0 |
| rs6040638 | Imputed | C | GENOTYPIC | 0.0002206 | 0.0002206 | 1.9531 | 1.9531 | 0.7476 | 0 |
| rs6040638 | Imputed | C | RECESSIVE | 0.00156 | 0.00156 | 1.7021 | 1.7021 | 0.4049 | 0 |

TABLE 17-continued

| SNP rs # | SOURCE | ALLELE (A1) | MODEL | P | P(R) | OR | OR(R) | Q | I |
|---|---|---|---|---|---|---|---|---|---|
| rs6040644 | Imputed | A | ADDITIVE | 0.0001909 | 0.0001909 | 1.3722 | 1.3722 | 0.8246 | 0 |
| rs6040644 | Imputed | A | GENOTYPIC | 0.0002206 | 0.0002206 | 1.9531 | 1.9531 | 0.7476 | 0 |
| rs6040644 | Imputed | A | RECESSIVE | 0.00156 | 0.00156 | 1.7021 | 1.7021 | 0.4049 | 0 |
| rs6040667 | Imputed | T | ADDITIVE | 0.0002664 | 0.0002664 | 1.3662 | 1.3662 | 0.8727 | 0 |
| rs6040667 | Imputed | T | GENOTYPIC | 0.0003065 | 0.0003065 | 1.9386 | 1.9386 | 0.7287 | 0 |
| rs6040667 | Imputed | T | RECESSIVE | 0.002069 | 0.002069 | 1.6903 | 1.6903 | 0.423 | 0 |
| rs6040668 | Imputed | C | ADDITIVE | 0.0002909 | 0.0002909 | 1.3643 | 1.3643 | 0.8891 | 0 |
| rs6040668 | Imputed | C | GENOTYPIC | 0.0003326 | 0.0003326 | 1.9325 | 1.9325 | 0.7115 | 0 |
| rs6040668 | Imputed | C | RECESSIVE | 0.00224 | 0.00224 | 1.6839 | 1.6839 | 0.406 | 0 |
| rs6043066 | Genotyped | G | DOMINANT | 0.000733 | 0.01784 | 1.4888 | 1.4596 | 0.1886 | 42.14 |
| rs6048146 | Imputed | G | DOMINANT | 0.0005426 | 0.0005426 | 2.6562 | 2.6562 | 0.6095 | 0 |
| rs6082725 | Genotyped | T | DOMINANT | 0.0005426 | 0.0005426 | 2.6562 | 2.6562 | 0.6095 | 0 |
| rs6131206 | Imputed | C | ADDITIVE | 0.002048 | 0.002048 | 1.3126 | 1.3126 | 0.4818 | 0 |
| rs6131208 | Imputed | T | ADDITIVE | 0.0002137 | 0.0002137 | 1.3725 | 1.3725 | 0.8701 | 0 |
| rs6131208 | Imputed | T | GENOTYPIC | 0.0002553 | 0.0002553 | 1.9551 | 1.9551 | 0.7372 | 0 |
| rs6131208 | Imputed | T | RECESSIVE | 0.00182 | 0.00182 | 1.7011 | 1.7011 | 0.4342 | 0 |
| rs6134243 | Imputed | C | ADDITIVE | 0.0001909 | 0.0001909 | 1.3722 | 1.3722 | 0.8246 | 0 |
| rs6134243 | Imputed | C | GENOTYPIC | 0.0002206 | 0.0002206 | 1.9531 | 1.9531 | 0.7476 | 0 |
| rs6134243 | Imputed | C | RECESSIVE | 0.00156 | 0.00156 | 1.7021 | 1.7021 | 0.4049 | 0 |
| rs6136020 | Imputed | A | DOMINANT | 6.99E−05 | 7.15E−05 | 0.5953 | 0.5953 | 0.3168 | 0.19 |
| rs613799 | Imputed | C | DOMINANT | 0.0002827 | 0.0002827 | 1.5657 | 1.5657 | 0.629 | 0 |
| rs644041 | Imputed | G | ADDITIVE | 9.69E−05 | 9.69E−05 | 1.4631 | 1.4631 | 0.6439 | 0 |
| rs644041 | Imputed | G | DOMINANT | 0.0001835 | 0.0001835 | 1.5751 | 1.5751 | 0.8914 | 0 |
| rs647645 | Imputed | C | ADDITIVE | 2.08E−05 | 2.08E−05 | 0.7025 | 0.7025 | 0.8072 | 0 |
| rs647645 | Imputed | C | GENOTYPIC | 1.62E−05 | 1.62E−05 | 0.4822 | 0.4822 | 0.9069 | 0 |
| rs647645 | Imputed | C | RECESSIVE | 4.05E−05 | 4.05E−05 | 0.5474 | 0.5474 | 0.5771 | 0 |
| rs6495554 | Imputed | C | GENOTYPIC | 0.0001138 | 0.0001138 | 3.4509 | 3.4509 | 0.8527 | 0 |
| rs6495554 | Imputed | C | RECESSIVE | 0.0001586 | 0.0001586 | 3.317 | 3.317 | 0.9056 | 0 |
| rs6495555 | Imputed | C | GENOTYPIC | 0.0001138 | 0.0001138 | 3.4509 | 3.4509 | 0.8527 | 0 |
| rs6495555 | Imputed | C | RECESSIVE | 0.0001586 | 0.0001586 | 3.317 | 3.317 | 0.9056 | 0 |
| rs6544728 | Imputed | T | DOMINANT | 2.92E−05 | 2.92E−05 | 1.6406 | 1.6406 | 0.3945 | 0 |
| rs6550705 | Imputed | C | ADDITIVE | 8.91E−05 | 8.91E−05 | 1.3969 | 1.3969 | 0.7348 | 0 |
| rs6550705 | Imputed | C | GENOTYPIC | 5.30E−05 | 5.30E−05 | 2.0995 | 2.0995 | 0.9749 | 0 |
| rs6550707 | Imputed | T | GENOTYPIC | 7.67E−05 | 7.67E−05 | 2.0358 | 2.0358 | 0.8969 | 0 |
| rs658108 | Imputed | A | DOMINANT | 0.0002659 | 0.0002659 | 1.5304 | 1.5304 | 0.8231 | 0 |
| rs6593441 | Imputed | A | DOMINANT | 0.0002048 | 0.0002048 | 1.6724 | 1.6724 | 0.545 | 0 |
| rs668732 | Imputed | A | DOMINANT | 7.59E−05 | 7.59E−05 | 1.6958 | 1.6958 | 0.6376 | 0 |
| rs671041 | Imputed | A | DOMINANT | 0.0002098 | 0.0002098 | 1.5412 | 1.5412 | 0.8876 | 0 |
| rs6719700 | Imputed | A | ADDITIVE | 0.0005301 | 0.0005301 | 1.4892 | 1.4892 | 0.6569 | 0 |
| rs6719700 | Imputed | A | DOMINANT | 0.0009974 | 0.0009974 | 1.5282 | 1.5282 | 0.9621 | 0 |
| rs6722640 | Imputed | T | DOMINANT | 0.0001647 | 0.0001647 | 0.6343 | 0.6343 | 0.417 | 0 |
| rs6743092 | Imputed | T | ADDITIVE | 0.0002329 | 0.0002329 | 1.3618 | 1.3618 | 0.9832 | 0 |
| rs6743092 | Imputed | T | GENOTYPIC | 0.0002232 | 0.0002232 | 1.8571 | 1.8571 | 0.9791 | 0 |
| rs6743092 | Imputed | T | RECESSIVE | 0.001144 | 0.001144 | 1.5648 | 1.5648 | 0.9735 | 0 |
| rs6744759 | Imputed | G | RECESSIVE | 0.006086 | 0.006086 | 1.7637 | 1.7637 | 0.7956 | 0 |
| rs6746170 | Imputed | A | DOMINANT | 4.95E−05 | 4.95E−05 | 1.6166 | 1.6166 | 0.5054 | 0 |
| rs6759922 | Imputed | A | DOMINANT | 5.10E−05 | 5.10E−05 | 0.5892 | 0.5892 | 0.6074 | 0 |
| rs6769864 | Imputed | T | GENOTYPIC | 5.78E−05 | 5.78E−05 | 2.0921 | 2.0921 | 0.9627 | 0 |
| rs6773932 | Imputed | C | GENOTYPIC | 8.12E−05 | 8.12E−05 | 2.0503 | 2.0503 | 0.8139 | 0 |
| rs6774353 | Imputed | A | GENOTYPIC | 5.78E−05 | 5.78E−05 | 2.0921 | 2.0921 | 0.9627 | 0 |
| rs6781670 | Imputed | C | GENOTYPIC | 7.91E−05 | 7.91E−05 | 2.0683 | 2.0683 | 0.8608 | 0 |
| rs6786431 | Imputed | A | GENOTYPIC | 8.12E−05 | 8.12E−05 | 2.0503 | 2.0503 | 0.8139 | 0 |
| rs6789091 | Imputed | T | GENOTYPIC | 8.12E−05 | 8.12E−05 | 2.0503 | 2.0503 | 0.8139 | 0 |
| rs6791296 | Imputed | T | ADDITIVE | 0.0005376 | 0.0005376 | 0.6284 | 0.6284 | 0.9209 | 0 |
| rs6792662 | Imputed | G | DOMINANT | 0.0001499 | 0.0001499 | 1.7002 | 1.7002 | 0.4736 | 0 |
| rs6797574 | Imputed | G | GENOTYPIC | 8.12E−05 | 8.12E−05 | 2.0503 | 2.0503 | 0.8139 | 0 |
| rs6797882 | Imputed | G | GENOTYPIC | 7.58E−05 | 7.58E−05 | 2.0585 | 2.0585 | 0.8005 | 0 |
| rs6805139 | Imputed | G | DOMINANT | 0.0001083 | 0.0001083 | 1.6957 | 1.6957 | 0.5312 | 0 |
| rs6806043 | Imputed | C | ADDITIVE | 6.97E−05 | 6.97E−05 | 1.4041 | 1.4041 | 0.6772 | 0 |
| rs6806043 | Imputed | C | GENOTYPIC | 4.41E−05 | 4.41E−05 | 2.1162 | 2.1162 | 0.9314 | 0 |
| rs6850716 | Imputed | C | GENOTYPIC | 6.01E−05 | 6.01E−05 | 3.2642 | 3.2642 | 0.9641 | 0 |
| rs6867153 | Imputed | A | RECESSIVE | 3.66E−05 | 3.66E−05 | 0.5455 | 0.5455 | 0.7414 | 0 |
| rs687047 | Imputed | C | ADDITIVE | 0.001907 | 0.001907 | 0.6716 | 0.6716 | 0.7468 | 0 |
| rs6871041 | Imputed | G | DOMINANT | 0.0002601 | 0.0002601 | 0.6351 | 0.6351 | 0.5713 | 0 |
| rs688358 | Imputed | A | ADDITIVE | 0.001332 | 0.001332 | 0.6614 | 0.6614 | 0.8904 | 0 |
| rs6888012 | Imputed | A | RECESSIVE | 3.66E−05 | 3.66E−05 | 0.5455 | 0.5455 | 0.7414 | 0 |
| rs6908481 | Imputed | C | RECESSIVE | 8.53E−05 | 8.53E−05 | 1.8461 | 1.8461 | 0.6072 | 0 |
| rs7032231 | Imputed | A | ADDITIVE | 0.003089 | 0.004335 | 1.2986 | 1.3011 | 0.2989 | 7.33 |
| rs7067638 | Imputed | T | DOMINANT | 0.0002484 | 0.0002484 | 1.6722 | 1.6722 | 0.663 | 0 |
| rs7077799 | Imputed | A | DOMINANT | 0.0002066 | 0.0002066 | 1.5609 | 1.5609 | 0.6624 | 0 |
| rs7082163 | Imputed | A | ADDITIVE | 4.21E−05 | 4.21E−05 | 1.6619 | 1.6619 | 0.5882 | 0 |
| rs7082163 | Imputed | A | DOMINANT | 6.78E−05 | 6.78E−05 | 1.7473 | 1.7473 | 0.7157 | 0 |
| rs7089661 | Imputed | C | DOMINANT | 0.0001345 | 0.0001345 | 1.5612 | 1.5612 | 0.6665 | 0 |
| rs7101319 | Imputed | C | ADDITIVE | 5.11E−05 | 5.11E−05 | 1.6533 | 1.6533 | 0.5666 | 0 |
| rs7101319 | Imputed | C | DOMINANT | 8.45E−05 | 8.45E−05 | 1.7359 | 1.7359 | 0.6904 | 0 |
| rs710832 | Genotyped | A | GENOTYPIC | 0.0003218 | 0.0003218 | 0.3641 | 0.3641 | 0.5473 | 0 |
| rs710832 | Genotyped | A | RECESSIVE | 0.0001214 | 0.0001214 | 0.3456 | 0.3456 | 0.5387 | 0 |
| rs7134262 | Imputed | T | GENOTYPIC | 0.0005116 | 0.0005116 | 1.9228 | 1.9228 | 0.357 | 0 |

TABLE 17-continued

| SNP rs # | SOURCE | ALLELE (A1) | MODEL | P | P(R) | OR | OR(R) | Q | I |
|---|---|---|---|---|---|---|---|---|---|
| rs7134262 | Imputed | T | RECESSIVE | 1.88E−05 | 0.0002297 | 2.1112 | 2.0864 | 0.2602 | 21.12 |
| rs7134671 | Imputed | T | GENOTYPIC | 8.82E−05 | 8.82E−05 | 1.9952 | 1.9952 | 0.3861 | 0 |
| rs7138300 | Imputed | C | ADDITIVE | 0.0004633 | 0.0004633 | 0.7392 | 0.7392 | 0.7118 | 0 |
| rs7138300 | Imputed | C | DOMINANT | 0.0002642 | 0.0002642 | 0.6285 | 0.6285 | 0.7714 | 0 |
| rs7138300 | Imputed | C | GENOTYPIC | 0.001515 | 0.001515 | 0.574 | 0.574 | 0.5208 | 0 |
| rs7163931 | Imputed | G | GENOTYPIC | 0.0001138 | 0.0001138 | 3.4509 | 3.4509 | 0.8527 | 0 |
| rs7163931 | Imputed | G | RECESSIVE | 0.0001586 | 0.0001586 | 3.317 | 3.317 | 0.9056 | 0 |
| rs7171486 | Genotyped | G | DOMINANT | 0.002255 | 0.00726 | 0.6976 | 0.69 | 0.2524 | 23.66 |
| rs7172611 | Imputed | G | GENOTYPIC | 0.0001106 | 0.0001106 | 3.4591 | 3.4591 | 0.8474 | 0 |
| rs7172611 | Imputed | G | RECESSIVE | 0.0001586 | 0.0001586 | 3.317 | 3.317 | 0.9056 | 0 |
| rs7172689 | Imputed | T | GENOTYPIC | 0.0001106 | 0.0001106 | 3.4591 | 3.4591 | 0.8474 | 0 |
| rs7172689 | Imputed | T | RECESSIVE | 0.0001586 | 0.0001586 | 3.317 | 3.317 | 0.9056 | 0 |
| rs7175701 | Imputed | C | GENOTYPIC | 0.0002485 | 0.0002485 | 2.9103 | 2.9103 | 0.9903 | 0 |
| rs7180245 | Imputed | A | GENOTYPIC | 0.0001106 | 0.0001106 | 3.4591 | 3.4591 | 0.8474 | 0 |
| rs7180245 | Imputed | A | RECESSIVE | 0.0001586 | 0.0001586 | 3.317 | 3.317 | 0.9056 | 0 |
| rs7220603 | Genotyped | A | ADDITIVE | 6.15E−05 | 6.15E−05 | 0.6874 | 0.6874 | 0.5095 | 0 |
| rs7282518 | Imputed | T | ADDITIVE | 4.72E−05 | 4.72E−05 | 1.6157 | 1.6157 | 0.6576 | 0 |
| rs7283476 | Imputed | T | ADDITIVE | 0.001444 | 0.002668 | 0.4528 | 0.4555 | 0.2951 | 8.76 |
| rs7283476 | Imputed | T | DOMINANT | 0.001188 | 0.01352 | 0.4307 | 0.4432 | 0.213 | 35.52 |
| rs7295817 | Imputed | C | GENOTYPIC | 0.001617 | 0.007423 | 0.5763 | 0.5838 | 0.2587 | 21.63 |
| rs7298255 | Imputed | A | ADDITIVE | 0.0004959 | 0.0004959 | 0.7441 | 0.7441 | 0.8645 | 0 |
| rs7298255 | Imputed | A | DOMINANT | 0.0001567 | 0.0001567 | 0.6197 | 0.6197 | 0.8009 | 0 |
| rs7305832 | Imputed | C | GENOTYPIC | 0.0004601 | 0.0004601 | 1.9292 | 1.9292 | 0.3332 | 0 |
| rs7305832 | Imputed | C | RECESSIVE | 1.85E−05 | 0.0003707 | 2.1109 | 2.0804 | 0.2465 | 25.55 |
| rs7331467 | Imputed | A | GENOTYPIC | 8.27E−05 | 8.27E−05 | 2.0747 | 2.0747 | 0.9516 | 0 |
| rs7392620 | Imputed | C | ADDITIVE | 0.003409 | 0.003409 | 0.7677 | 0.7677 | 0.844 | 0 |
| rs742827 | Imputed | A | ADDITIVE | 0.0001374 | 0.0001374 | 1.3962 | 1.3962 | 0.8859 | 0 |
| rs742827 | Imputed | A | GENOTYPIC | 0.0002152 | 0.0002152 | 1.9872 | 1.9872 | 0.5834 | 0 |
| rs742827 | Imputed | A | RECESSIVE | 0.001964 | 0.001964 | 1.6988 | 1.6988 | 0.3688 | 0 |
| rs7446891 | Imputed | G | DOMINANT | 0.000699 | 0.000699 | 0.6712 | 0.6712 | 0.8706 | 0 |
| rs7448641 | Imputed | C | ADDITIVE | 1.27E−05 | 1.27E−05 | 0.2451 | 0.2451 | 0.6218 | 0 |
| rs7448641 | Imputed | C | DOMINANT | 2.81E−05 | 2.81E−05 | 0.2509 | 0.2509 | 0.6535 | 0 |
| rs7484728 | Imputed | T | GENOTYPIC | 8.08E−05 | 8.08E−05 | 2.0019 | 2.0019 | 0.395 | 0 |
| rs7499402 | Genotyped | A | ADDITIVE | 0.001818 | 0.001818 | 1.6071 | 1.6071 | 0.4709 | 0 |
| rs7529851 | Imputed | A | ADDITIVE | 0.0007167 | 0.0007351 | 0.7475 | 0.7475 | 0.3163 | 0.4 |
| rs7529851 | Imputed | A | GENOTYPIC | 0.0007339 | 0.0007339 | 0.5463 | 0.5463 | 0.4438 | 0 |
| rs7573951 | Imputed | G | ADDITIVE | 7.56E−05 | 7.56E−05 | 0.7086 | 0.7086 | 0.8496 | 0 |
| rs7599198 | Imputed | T | DOMINANT | 9.29E−05 | 9.29E−05 | 0.5939 | 0.5939 | 0.6564 | 0 |
| rs7600050 | Imputed | C | ADDITIVE | 0.000398 | 0.000398 | 1.3671 | 1.3671 | 0.401 | 0 |
| rs7607712 | Imputed | T | ADDITIVE | 0.0003189 | 0.0003189 | 1.452 | 1.452 | 0.6392 | 0 |
| rs7607712 | Imputed | T | DOMINANT | 0.0007082 | 0.0007082 | 1.5005 | 1.5005 | 0.8593 | 0 |
| rs7613492 | Imputed | G | GENOTYPIC | 5.46E−05 | 5.46E−05 | 2.1046 | 2.1046 | 0.983 | 0 |
| rs7621663 | Imputed | G | ADDITIVE | 5.19E−05 | 5.19E−05 | 1.4264 | 1.4264 | 0.8945 | 0 |
| rs7621663 | Imputed | G | GENOTYPIC | 1.68E−05 | 1.68E−05 | 2.2926 | 2.2926 | 0.7204 | 0 |
| rs7621663 | Imputed | G | RECESSIVE | 8.03E−05 | 8.03E−05 | 2.0424 | 2.0424 | 0.5218 | 0 |
| rs7626584 | Imputed | G | ADDITIVE | 0.000166 | 0.000166 | 0.5017 | 0.5017 | 0.6498 | 0 |
| rs7684899 | Imputed | C | ADDITIVE | 0.001935 | 0.001935 | 0.7236 | 0.7236 | 0.8673 | 0 |
| rs7684899 | Imputed | C | DOMINANT | 0.000396 | 0.000396 | 0.6536 | 0.6536 | 0.8664 | 0 |
| rs7701604 | Imputed | G | ADDITIVE | 1.27E−05 | 1.27E−05 | 0.2451 | 0.2451 | 0.6218 | 0 |
| rs7701604 | Imputed | G | DOMINANT | 2.81E−05 | 2.81E−05 | 0.2509 | 0.2509 | 0.6535 | 0 |
| rs7703676 | Imputed | C | ADDITIVE | 1.27E−05 | 1.27E−05 | 0.2451 | 0.2451 | 0.6218 | 0 |
| rs7703676 | Imputed | C | DOMINANT | 2.81E−05 | 2.81E−05 | 0.2509 | 0.2509 | 0.6535 | 0 |
| rs7708491 | Imputed | C | RECESSIVE | 6.44E−05 | 6.44E−05 | 0.5582 | 0.5582 | 0.823 | 0 |
| rs7711358 | Imputed | A | DOMINANT | 0.0005772 | 0.0005772 | 0.6679 | 0.6679 | 0.7414 | 0 |
| rs7719448 | Imputed | G | RECESSIVE | 3.03E−05 | 3.03E−05 | 0.5422 | 0.5422 | 0.7436 | 0 |
| rs7724761 | Imputed | T | RECESSIVE | 2.79E−05 | 2.79E−05 | 0.5376 | 0.5376 | 0.8521 | 0 |
| rs7742476 | Imputed | T | DOMINANT | 9.96E−05 | 9.96E−05 | 1.6177 | 1.6177 | 0.3946 | 0 |
| rs7762993 | Imputed | A | ADDITIVE | 9.68E−05 | 9.68E−05 | 1.5062 | 1.5062 | 0.5789 | 0 |
| rs7762993 | Imputed | A | DOMINANT | 1.55E−05 | 1.55E−05 | 1.6955 | 1.6955 | 0.475 | 0 |
| rs7767265 | Imputed | G | ADDITIVE | 1.02E−05 | 1.02E−05 | 1.5369 | 1.5369 | 0.4161 | 0 |
| rs7767265 | Imputed | G | DOMINANT | 1.30E−06 | 1.30E−06 | 1.786 | 1.786 | 0.4646 | 0 |
| rs7768128 | Imputed | G | RECESSIVE | 0.001331 | 0.001331 | 0.4131 | 0.4131 | 0.6812 | 0 |
| rs7771264 | Imputed | T | DOMINANT | 6.68E−05 | 6.68E−05 | 0.6186 | 0.6186 | 0.338 | 0 |
| rs7773151 | Genotyped | C | DOMINANT | 7.51E−05 | 7.51E−05 | 0.624 | 0.624 | 0.3194 | 0 |
| rs7773210 | Genotyped | A | DOMINANT | 6.11E−05 | 6.11E−05 | 0.6205 | 0.6205 | 0.3365 | 0 |
| rs7808536 | Imputed | G | DOMINANT | 0.0002477 | 0.003942 | 1.5602 | 1.593 | 0.1988 | 39.43 |
| rs7843510 | Genotyped | G | DOMINANT | 9.47E−05 | 9.47E−05 | 1.6156 | 1.6156 | 0.9612 | 0 |
| rs7894867 | Imputed | T | DOMINANT | 0.0002327 | 0.0002327 | 1.6763 | 1.6763 | 0.6457 | 0 |
| rs7921834 | Imputed | C | DOMINANT | 0.0001474 | 0.0001474 | 1.5574 | 1.5574 | 0.6777 | 0 |
| rs7939893 | Imputed | C | ADDITIVE | 0.001994 | 0.001994 | 0.7672 | 0.7672 | 0.4917 | 0 |
| rs7939893 | Imputed | C | DOMINANT | 0.00178 | 0.00178 | 0.6939 | 0.6939 | 0.7543 | 0 |
| rs7944513 | Imputed | T | GENOTYPIC | 3.70E−05 | 3.70E−05 | 3.1057 | 3.1057 | 0.4987 | 0 |
| rs7944513 | Imputed | T | RECESSIVE | 6.05E−05 | 6.05E−05 | 2.9509 | 2.9509 | 0.4009 | 0 |
| rs7949720 | Imputed | G | ADDITIVE | 6.02E−05 | 6.02E−05 | 0.5917 | 0.5917 | 0.6951 | 0 |
| rs7949720 | Imputed | G | DOMINANT | 4.34E−05 | 4.34E−05 | 0.5526 | 0.5526 | 0.5364 | 0 |
| rs7955901 | Imputed | C | ADDITIVE | 0.0005679 | 0.0005679 | 0.745 | 0.745 | 0.8856 | 0 |
| rs7955901 | Imputed | C | DOMINANT | 0.0002109 | 0.0002109 | 0.6246 | 0.6246 | 0.7241 | 0 |
| rs7956274 | Imputed | T | ADDITIVE | 0.000471 | 0.000471 | 0.7423 | 0.7423 | 0.7644 | 0 |

TABLE 17-continued

| SNP rs # | SOURCE | ALLELE (A1) | MODEL | P | P(R) | OR | OR(R) | Q | I |
|---|---|---|---|---|---|---|---|---|---|
| rs7956274 | Imputed | T | DOMINANT | 0.0001278 | 0.0001278 | 0.6144 | 0.6144 | 0.9458 | 0 |
| rs7956274 | Imputed | T | GENOTYPIC | 0.001643 | 0.001643 | 0.582 | 0.582 | 0.6004 | 0 |
| rs7957932 | Imputed | G | ADDITIVE | 0.001051 | 0.001051 | 0.7578 | 0.7578 | 0.8972 | 0 |
| rs7957932 | Imputed | G | DOMINANT | 0.0001397 | 0.0001397 | 0.6136 | 0.6136 | 0.8447 | 0 |
| rs7984504 | Imputed | C | GENOTYPIC | 9.33E−05 | 9.33E−05 | 2.1895 | 2.1895 | 0.8871 | 0 |
| rs7999518 | Imputed | A | RECESSIVE | 0.003293 | 0.003293 | 0.6449 | 0.6449 | 0.9164 | 0 |
| rs8026245 | Imputed | G | GENOTYPIC | 0.0001769 | 0.0001769 | 3.0849 | 3.0849 | 0.8542 | 0 |
| rs8026245 | Imputed | G | RECESSIVE | 0.0001739 | 0.0001739 | 3.0436 | 3.0436 | 0.9473 | 0 |
| rs8060725 | Genotyped | A | ADDITIVE | 0.001967 | 0.001967 | 0.7414 | 0.7414 | 0.74 | 0 |
| rs8103016 | Genotyped | A | ADDITIVE | 1.97E−05 | 1.97E−05 | 1.5542 | 1.5542 | 0.8792 | 0 |
| rs8103016 | Genotyped | A | DOMINANT | 5.37E−05 | 5.37E−05 | 1.6315 | 1.6315 | 0.8495 | 0 |
| rs8104182 | Imputed | G | ADDITIVE | 8.91E−05 | 8.91E−05 | 1.5032 | 1.5032 | 0.628 | 0 |
| rs8104182 | Imputed | G | DOMINANT | 0.000187 | 0.000187 | 1.5764 | 1.5764 | 0.6041 | 0 |
| rs8129461 | Imputed | G | ADDITIVE | 0.001444 | 0.002668 | 0.4528 | 0.4555 | 0.2951 | 8.76 |
| rs8129461 | Imputed | G | DOMINANT | 0.001188 | 0.01352 | 0.4307 | 0.4432 | 0.213 | 35.52 |
| rs8130021 | Imputed | G | ADDITIVE | 0.001444 | 0.002668 | 0.4528 | 0.4555 | 0.2951 | 8.76 |
| rs8130021 | Imputed | G | DOMINANT | 0.001188 | 0.01352 | 0.4307 | 0.4432 | 0.213 | 35.52 |
| rs879961 | Imputed | T | ADDITIVE | 2.33E−05 | 2.33E−05 | 0.6659 | 0.6659 | 0.4449 | 0 |
| rs879961 | Imputed | T | DOMINANT | 1.51E−05 | 1.51E−05 | 0.6005 | 0.6005 | 0.9844 | 0 |
| rs906353 | Imputed | A | DOMINANT | 9.95E−05 | 9.95E−05 | 0.6352 | 0.6352 | 0.8067 | 0 |
| rs915491 | Imputed | C | DOMINANT | 0.0002054 | 0.0002054 | 1.5426 | 1.5426 | 0.7028 | 0 |
| rs915493 | Imputed | T | DOMINANT | 0.0002054 | 0.0002054 | 1.5426 | 1.5426 | 0.7028 | 0 |
| rs915494 | Imputed | A | ADDITIVE | 0.001238 | 0.001238 | 1.3527 | 1.3527 | 0.6764 | 0 |
| rs915494 | Imputed | A | DOMINANT | 0.0002045 | 0.0002045 | 1.5574 | 1.5574 | 0.5538 | 0 |
| rs917295 | Imputed | G | DOMINANT | 0.0005579 | 0.0005579 | 0.6664 | 0.6664 | 0.9359 | 0 |
| rs9284851 | Imputed | A | GENOTYPIC | 6.86E−05 | 6.86E−05 | 2.0519 | 2.0519 | 0.9886 | 0 |
| rs9293464 | Imputed | T | RECESSIVE | 3.03E−05 | 3.03E−05 | 0.5422 | 0.5422 | 0.7436 | 0 |
| rs9295154 | Genotyped | G | DOMINANT | 0.0003436 | 0.0007175 | 1.5908 | 1.5981 | 0.2899 | 10.73 |
| rs9310221 | Imputed | A | DOMINANT | 6.72E−05 | 6.93E−05 | 1.6779 | 1.6777 | 0.3166 | 0.28 |
| rs9310699 | Genotyped | T | GENOTYPIC | 7.91E−05 | 7.91E−05 | 2.0683 | 2.0683 | 0.8608 | 0 |
| rs9310700 | Imputed | C | ADDITIVE | 8.64E−05 | 8.64E−05 | 1.4077 | 1.4077 | 0.7999 | 0 |
| rs9310700 | Imputed | C | GENOTYPIC | 3.31E−05 | 3.31E−05 | 2.2015 | 2.2015 | 0.8601 | 0 |
| rs9310701 | Imputed | G | GENOTYPIC | 7.67E−05 | 7.67E−05 | 2.0358 | 2.0358 | 0.8969 | 0 |
| rs9310704 | Imputed | G | GENOTYPIC | 4.87E−05 | 4.87E−05 | 2.1011 | 2.1011 | 0.908 | 0 |
| rs9319185 | Imputed | C | GENOTYPIC | 5.38E−05 | 5.38E−05 | 2.2836 | 2.2836 | 0.9842 | 0 |
| rs9319186 | Imputed | T | GENOTYPIC | 7.93E−05 | 7.93E−05 | 2.2431 | 2.2431 | 0.9603 | 0 |
| rs9327555 | Imputed | T | DOMINANT | 0.000699 | 0.000699 | 0.6712 | 0.6712 | 0.8706 | 0 |
| rs9403367 | Imputed | C | DOMINANT | 6.11E−05 | 6.11E−05 | 0.6205 | 0.6205 | 0.3365 | 0 |
| rs9419608 | Imputed | G | RECESSIVE | 4.08E−05 | 4.08E−05 | 1.7425 | 1.7425 | 0.608 | 0 |
| rs9426437 | Imputed | T | DOMINANT | 5.00E−05 | 5.00E−05 | 0.607 | 0.607 | 0.4632 | 0 |
| rs9454967 | Imputed | G | DOMINANT | 5.94E−05 | 5.94E−05 | 1.9576 | 1.9576 | 0.6125 | 0 |
| rs9635511 | Imputed | T | DOMINANT | 7.73E−05 | 7.73E−05 | 0.618 | 0.618 | 0.4399 | 0 |
| rs966583 | Imputed | A | ADDITIVE | 9.56E−05 | 9.56E−05 | 0.7127 | 0.7127 | 0.7413 | 0 |
| rs966583 | Imputed | A | DOMINANT | 4.65E−05 | 4.65E−05 | 0.6082 | 0.6082 | 0.9923 | 0 |
| rs980263 | Imputed | T | GENOTYPIC | 6.16E−05 | 6.16E−05 | 2.059 | 2.059 | 0.935 | 0 |
| rs980264 | Imputed | T | GENOTYPIC | 6.16E−05 | 6.16E−05 | 2.059 | 2.059 | 0.935 | 0 |
| rs9812206 | Imputed | G | ADDITIVE | 5.80E−06 | 5.80E−06 | 0.5122 | 0.5122 | 0.7976 | 0 |
| rs9812206 | Imputed | G | DOMINANT | 4.29E−06 | 4.29E−06 | 0.4876 | 0.4876 | 0.9796 | 0 |
| rs9813552 | Imputed | G | ADDITIVE | 4.13E−05 | 4.13E−05 | 0.5495 | 0.5495 | 0.7178 | 0 |
| rs9813552 | Imputed | G | DOMINANT | 3.19E−05 | 3.19E−05 | 0.5265 | 0.5265 | 0.9286 | 0 |
| rs9815037 | Imputed | T | ADDITIVE | 1.99E−05 | 1.99E−05 | 0.5261 | 0.5261 | 0.5342 | 0 |
| rs9815037 | Imputed | T | DOMINANT | 1.13E−05 | 1.13E−05 | 0.4982 | 0.4982 | 0.7438 | 0 |
| rs9819583 | Imputed | T | GENOTYPIC | 7.12E−05 | 7.12E−05 | 2.0778 | 2.0778 | 0.8761 | 0 |
| rs9825349 | Imputed | A | ADDITIVE | 1.98E−05 | 1.98E−05 | 0.5259 | 0.5259 | 0.5483 | 0 |
| rs9825349 | Imputed | A | DOMINANT | 1.13E−05 | 1.13E−05 | 0.4982 | 0.4982 | 0.7598 | 0 |
| rs9833118 | Imputed | G | ADDITIVE | 9.63E−05 | 9.63E−05 | 1.3977 | 1.3977 | 0.6136 | 0 |
| rs9833118 | Imputed | G | GENOTYPIC | 5.01E−05 | 5.01E−05 | 2.1101 | 2.1101 | 0.8729 | 0 |
| rs9834217 | Imputed | T | ADDITIVE | 2.21E−05 | 2.21E−05 | 0.5279 | 0.5279 | 0.5562 | 0 |
| rs9834217 | Imputed | T | DOMINANT | 1.26E−05 | 1.26E−05 | 0.5002 | 0.5002 | 0.7692 | 0 |
| rs9838563 | Imputed | C | GENOTYPIC | 7.67E−05 | 7.67E−05 | 2.0358 | 2.0358 | 0.8969 | 0 |
| rs9840460 | Imputed | T | ADDITIVE | 2.08E−05 | 2.08E−05 | 0.5268 | 0.5268 | 0.5431 | 0 |
| rs9840460 | Imputed | T | DOMINANT | 1.18E−05 | 1.18E−05 | 0.499 | 0.499 | 0.7541 | 0 |
| rs9840756 | Imputed | A | ADDITIVE | 2.08E−05 | 2.08E−05 | 0.5268 | 0.5268 | 0.5431 | 0 |
| rs9840756 | Imputed | A | DOMINANT | 1.18E−05 | 1.18E−05 | 0.499 | 0.499 | 0.7541 | 0 |
| rs9847999 | Imputed | C | GENOTYPIC | 9.15E−05 | 9.15E−05 | 2.0254 | 2.0254 | 0.9674 | 0 |
| rs9864769 | Imputed | C | GENOTYPIC | 7.67E−05 | 7.67E−05 | 2.0358 | 2.0358 | 0.8969 | 0 |
| rs9866421 | Genotyped | C | RECESSIVE | 0.0009027 | 0.0009027 | 0.6009 | 0.6009 | 0.4635 | 0 |
| rs987296 | Imputed | T | GENOTYPIC | 7.90E−05 | 7.90E−05 | 2.0683 | 2.0683 | 0.8607 | 0 |
| rs9881685 | Imputed | A | ADDITIVE | 5.80E−06 | 5.80E−06 | 0.5122 | 0.5122 | 0.7976 | 0 |
| rs9881685 | Imputed | A | DOMINANT | 4.29E−06 | 4.29E−06 | 0.4876 | 0.4876 | 0.9796 | 0 |
| rs992695 | Imputed | C | ADDITIVE | 2.92E−05 | 2.92E−05 | 0.6695 | 0.6695 | 0.4384 | 0 |
| rs992695 | Imputed | C | DOMINANT | 2.06E−05 | 2.06E−05 | 0.6059 | 0.6059 | 0.9952 | 0 |
| rs9936999 | Imputed | G | DOMINANT | 8.52E−05 | 8.52E−05 | 1.8486 | 1.8486 | 0.8612 | 0 |

TABLE 18

| SNP rs # | SOURCE | ALLELE (A1) | MODEL | P | P(R) | OR | OR(R) | Q | I |
|---|---|---|---|---|---|---|---|---|---|
| rs77638540 | Genotyped | T | DOMINANT | 8.53E-05 | 8.53E-05 | 0.4412 | 0.4412 | 0.4473 | 0 |
| rs72746987 | Genotyped | A | DOMINANT | 1.04E-03 | 0.07511 | 0.5034 | 0.4987 | 0.037 | 69.66 |
| rs10021016 | Genotyped | G | GENOTYPIC | 1.77E-05 | 1.77E-05 | 2.4195 | 2.4195 | 0.946 | 0 |
| rs10021016 | Genotyped | G | RECESSIVE | 3.95E-05 | 3.95E-05 | 2.2819 | 2.2819 | 0.9639 | 0 |
| rs10051148 | Imputed | C | DOMINANT | 4.37E-05 | 4.37E-05 | 0.663 | 0.663 | 0.936 | 0 |
| rs10054055 | Imputed | T | DOMINANT | 2.45E-05 | 2.45E-05 | 0.652 | 0.652 | 0.8092 | 0 |
| rs10067895 | Imputed | A | DOMINANT | 2.54E-05 | 2.54E-05 | 0.6504 | 0.6504 | 0.7871 | 0 |
| rs10100725 | Imputed | C | DOMINANT | 9.58E-04 | 0.1048 | 0.6943 | 0.7246 | 0.0468 | 67.33 |
| rs10128531 | Imputed | T | ADDITIVE | 6.93E-05 | 6.93E-05 | 1.5153 | 1.5153 | 0.8693 | 0 |
| rs10181743 | Imputed | G | ADDITIVE | 1.45E-04 | 7.58E-04 | 1.3254 | 1.3179 | 0.3011 | 16.69 |
| rs10199127 | Imputed | T | DOMINANT | 3.21E-04 | 0.02399 | 1.4423 | 1.433 | 0.098 | 56.95 |
| rs10270624 | Imputed | G | DOMINANT | 7.89E-05 | 7.89E-05 | 1.5242 | 1.5242 | 0.5064 | 0 |
| rs1030006 | Imputed | G | RECESSIVE | 2.14E-03 | 0.1294 | 1.4544 | 1.4242 | 0.0332 | 70.63 |
| rs1031811 | Imputed | A | RECESSIVE | 8.78E-05 | 8.78E-05 | 1.988 | 1.988 | 0.5276 | 0 |
| rs10430870 | Genotyped | G | GENOTYPIC | 6.56E-05 | 6.56E-05 | 2.3812 | 2.3812 | 0.4518 | 0 |
| rs10430870 | Genotyped | G | RECESSIVE | 9.42E-05 | 9.42E-05 | 2.2976 | 2.2976 | 0.5059 | 0 |
| rs10469597 | Imputed | A | GENOTYPIC | 2.56E-04 | 7.98E-03 | 2.0793 | 2.008 | 0.1981 | 38.23 |
| rs10469597 | Imputed | A | RECESSIVE | 1.31E-04 | 3.67E-04 | 2.1038 | 2.0871 | 0.3313 | 9.47 |
| rs10478919 | Imputed | G | DOMINANT | 1.88E-05 | 1.88E-05 | 0.6481 | 0.6481 | 0.8316 | 0 |
| rs10506623 | Imputed | C | ADDITIVE | 3.33E-05 | 3.33E-05 | 0.7343 | 0.7343 | 0.8201 | 0 |
| rs10506623 | Imputed | C | DOMINANT | 2.58E-05 | 2.58E-05 | 0.6418 | 0.6418 | 0.8101 | 0 |
| rs10506626 | Imputed | A | ADDITIVE | 1.01E-05 | 1.01E-05 | 0.7226 | 0.7226 | 0.6798 | 0 |
| rs10506626 | Imputed | A | DOMINANT | 1.59E-06 | 1.59E-06 | 0.608 | 0.608 | 0.7968 | 0 |
| rs10509477 | Imputed | T | DOMINANT | 2.98E-05 | 2.98E-05 | 1.5214 | 1.5214 | 0.7093 | 0 |
| rs10517918 | Imputed | G | RECESSIVE | 6.32E-04 | 0.04182 | 1.5595 | 1.5312 | 0.0872 | 59.01 |
| rs10517924 | Imputed | A | RECESSIVE | 3.69E-04 | 0.007266 | 1.5408 | 1.514 | 0.2104 | 35.84 |
| rs10519362 | Imputed | G | DOMINANT | 9.95E-05 | 9.95E-05 | 1.5338 | 1.5338 | 0.9176 | 0 |
| rs10520072 | Imputed | T | DOMINANT | 1.82E-05 | 1.82E-05 | 0.647 | 0.647 | 0.881 | 0 |
| rs10737390 | Imputed | T | DOMINANT | 1.26E-03 | 1.43E-01 | 0.7118 | 0.7485 | 0.0363 | 69.84 |
| rs10742851 | Imputed | T | RECESSIVE | 1.44E-02 | 3.23E-01 | 0.5988 | 0.593 | 0.0033 | 82.54 |
| rs10743685 | Imputed | G | GENOTYPIC | 4.32E-05 | 4.32E-05 | 1.8534 | 1.8534 | 0.6642 | 0 |
| rs10743685 | Imputed | G | RECESSIVE | 7.41E-05 | 7.41E-05 | 1.7214 | 1.7214 | 0.6436 | 0 |
| rs10749293 | Imputed | G | DOMINANT | 1.17E-05 | 1.17E-05 | 1.5526 | 1.5526 | 0.866 | 0 |
| rs10749294 | Imputed | A | DOMINANT | 6.69E-05 | 6.69E-05 | 1.4909 | 1.4909 | 0.8006 | 0 |
| rs10753760 | Imputed | T | ADDITIVE | 1.83E-03 | 1.26E-01 | 1.2546 | 1.2395 | 0.0287 | 71.84 |
| rs10753760 | Imputed | T | GENOTYPIC | 2.08E-03 | 1.35E-01 | 1.5862 | 1.5469 | 0.0269 | 72.33 |
| rs10772362 | Imputed | T | ADDITIVE | 2.16E-05 | 2.16E-05 | 0.691 | 0.691 | 0.4243 | 0 |
| rs10784891 | Imputed | C | ADDITIVE | 3.13E-05 | 3.13E-05 | 0.7354 | 0.7354 | 0.9449 | 0 |
| rs10784891 | Imputed | C | DOMINANT | 6.41E-05 | 6.41E-05 | 0.6454 | 0.6454 | 0.7393 | 0 |
| rs10784891 | Imputed | C | GENOTYPIC | 9.84E-05 | 9.84E-05 | 0.5575 | 0.5575 | 0.8437 | 0 |
| rs10787923 | Imputed | G | DOMINANT | 1.08E-05 | 1.08E-05 | 1.556 | 1.556 | 0.8555 | 0 |
| rs10787924 | Imputed | T | DOMINANT | 5.94E-05 | 5.94E-05 | 1.4953 | 1.4953 | 0.7873 | 0 |
| rs10787949 | Imputed | A | DOMINANT | 5.22E-05 | 5.22E-05 | 1.503 | 1.503 | 0.7135 | 0 |
| rs10787951 | Imputed | G | DOMINANT | 5.35E-05 | 5.35E-05 | 1.5021 | 1.5021 | 0.7092 | 0 |
| rs10787983 | Imputed | C | DOMINANT | 5.23E-05 | 5.23E-05 | 1.5007 | 1.5007 | 0.7558 | 0 |
| rs10794733 | Imputed | C | ADDITIVE | 7.05E-05 | 7.05E-05 | 0.7343 | 0.7343 | 0.7115 | 0 |
| rs10818280 | Imputed | C | DOMINANT | 9.18E-05 | 9.18E-05 | 0.6734 | 0.6734 | 0.8782 | 0 |
| rs10860586 | Imputed | A | ADDITIVE | 3.08E-05 | 0.1633 | 1.2361 | 1.2211 | 0.0224 | 73.69 |
| rs10860586 | Imputed | A | GENOTYPIC | 3.00E-03 | 1.63E-01 | 1.5291 | 1.4908 | 0.0225 | 73.63 |
| rs10870473 | Imputed | A | ADDITIVE | 3.61E-03 | 2.33E-01 | 0.6941 | 0.7378 | 0.0195 | 74.59 |
| rs10870473 | Imputed | A | DOMINANT | 5.37E-03 | 4.68E-01 | 0.6441 | 0.7381 | 0.0016 | 84.48 |
| rs10879240 | Imputed | C | ADDITIVE | 3.83E-05 | 3.83E-05 | 0.74 | 0.74 | 0.9636 | 0 |
| rs10879240 | Imputed | C | GENOTYPIC | 9.34E-05 | 9.34E-05 | 0.5585 | 0.5585 | 0.7993 | 0 |
| rs10879242 | Imputed | A | ADDITIVE | 4.26E-05 | 4.26E-05 | 0.7384 | 0.7384 | 0.8941 | 0 |
| rs10879242 | Imputed | A | DOMINANT | 2.29E-05 | 2.29E-05 | 0.6402 | 0.6402 | 0.8341 | 0 |
| rs10879245 | Imputed | G | ADDITIVE | 4.26E-05 | 4.26E-05 | 0.7384 | 0.7384 | 0.8941 | 0 |
| rs10879245 | Imputed | G | DOMINANT | 2.29E-05 | 2.29E-05 | 0.6402 | 0.6402 | 0.8341 | 0 |
| rs10879249 | Imputed | T | ADDITIVE | 2.01E-05 | 2.01E-05 | 0.7287 | 0.7287 | 0.7861 | 0 |
| rs10879249 | Imputed | T | DOMINANT | 1.30E-05 | 1.30E-05 | 0.6335 | 0.6335 | 0.7421 | 0 |
| rs10886429 | Imputed | A | DOMINANT | 6.44E-05 | 6.44E-05 | 1.4958 | 1.4958 | 0.6357 | 0 |
| rs10886449 | Imputed | G | DOMINANT | 8.67E-05 | 8.67E-05 | 1.4833 | 1.4833 | 0.761 | 0 |
| rs10886451 | Imputed | G | DOMINANT | 8.67E-05 | 8.67E-05 | 1.4833 | 1.4833 | 0.761 | 0 |
| rs10886452 | Imputed | A | DOMINANT | 4.28E-05 | 4.28E-05 | 1.5097 | 1.5097 | 0.7458 | 0 |
| rs10886456 | Imputed | G | DOMINANT | 8.67E-05 | 8.67E-05 | 1.4833 | 1.4833 | 0.761 | 0 |
| rs10886463 | Imputed | C | DOMINANT | 5.51E-05 | 5.51E-05 | 1.5014 | 1.5014 | 0.737 | 0 |
| rs10886465 | Imputed | A | DOMINANT | 3.16E-05 | 3.16E-05 | 1.5202 | 1.5202 | 0.6725 | 0 |
| rs10886526 | Imputed | C | DOMINANT | 4.73E-05 | 4.73E-05 | 1.5047 | 1.5047 | 0.7756 | 0 |
| rs10922903 | Imputed | C | RECESSIVE | 7.51E-04 | 0.04061 | 0.6326 | 0.6533 | 0.1055 | 55.53 |
| rs10941126 | Imputed | G | ADDITIVE | 2.88E-03 | 0.1046 | 0.5269 | 0.4225 | 0.0055 | 80.81 |
| rs10941126 | Imputed | G | DOMINANT | 5.93E-03 | 0.1502 | 0.5204 | 0.4449 | 0.0058 | 80.6 |
| rs10947980 | Imputed | G | ADDITIVE | 0.0007135 | 0.04303 | 0.7602 | 0.7647 | 0.0779 | 60.82 |
| rs11059376 | Imputed | T | ADDITIVE | 2.09E-04 | 2.16E-03 | 1.4335 | 1.4217 | 0.2602 | 25.72 |
| rs11072995 | Imputed | T | GENOTYPIC | 5.56E-05 | 5.56E-05 | 2.911 | 2.911 | 0.7416 | 0 |
| rs11072995 | Imputed | T | RECESSIVE | 8.05E-05 | 8.05E-05 | 2.8127 | 2.8127 | 0.7514 | 0 |
| rs11081202 | Genotyped | G | GENOTYPIC | 4.78E-05 | 4.78E-05 | 2.2039 | 2.2039 | 0.4315 | 0 |
| rs11081202 | Genotyped | G | RECESSIVE | 9.57E-06 | 9.57E-06 | 2.3008 | 2.3008 | 0.5359 | 0 |
| rs110965 | Imputed | C | GENOTYPIC | 5.25E-05 | 5.42E-05 | 2.0397 | 2.04 | 0.3665 | 0.36 |
| rs11124962 | Imputed | A | DOMINANT | 9.31E-05 | 9.31E-05 | 1.4868 | 1.4868 | 0.434 | 0 |

TABLE 18-continued

| SNP rs # | SOURCE | ALLELE (A1) | MODEL | P | P(R) | OR | OR(R) | Q | I |
|---|---|---|---|---|---|---|---|---|---|
| rs1116596 | Imputed | T | DOMINANT | 2.21E-05 | 2.21E-05 | 0.6501 | 0.6501 | 0.8309 | 0 |
| rs11178531 | Imputed | A | ADDITIVE | 8.31E-05 | 8.31E-05 | 0.753 | 0.753 | 0.9192 | 0 |
| rs11178531 | Imputed | A | DOMINANT | 4.55E-05 | 4.55E-05 | 0.64 | 0.64 | 0.9035 | 0 |
| rs11178583 | Imputed | A | ADDITIVE | 2.33E-05 | 2.33E-05 | 0.7308 | 0.7308 | 0.7646 | 0 |
| rs11178583 | Imputed | A | DOMINANT | 1.65E-05 | 1.65E-05 | 0.6373 | 0.6373 | 0.7197 | 0 |
| rs11178589 | Imputed | T | ADDITIVE | 1.62E-05 | 1.62E-05 | 0.7264 | 0.7264 | 0.7893 | 0 |
| rs11178589 | Imputed | T | DOMINANT | 1.26E-05 | 1.26E-05 | 0.6312 | 0.6312 | 0.7472 | 0 |
| rs11178594 | Imputed | C | ADDITIVE | 2.03E-05 | 2.03E-05 | 0.7297 | 0.7297 | 0.8443 | 0 |
| rs11178594 | Imputed | C | DOMINANT | 1.05E-05 | 1.05E-05 | 0.6313 | 0.6313 | 0.8109 | 0 |
| rs11178602 | Imputed | T | ADDITIVE | 1.67E-05 | 1.67E-05 | 0.7273 | 0.7273 | 0.8496 | 0 |
| rs11178602 | Imputed | T | DOMINANT | 7.52E-06 | 7.52E-06 | 0.6264 | 0.6264 | 0.7997 | 0 |
| rs11178648 | Imputed | T | ADDITIVE | 2.57E-05 | 2.57E-05 | 0.7339 | 0.7339 | 0.8706 | 0 |
| rs11178648 | Imputed | T | DOMINANT | 3.00E-06 | 3.00E-06 | 0.6155 | 0.6155 | 0.8521 | 0 |
| rs11198877 | Imputed | T | DOMINANT | 4.14E-05 | 4.14E-05 | 1.5107 | 1.5107 | 0.7435 | 0 |
| rs11198942 | Imputed | T | DOMINANT | 2.98E-05 | 2.98E-05 | 1.5214 | 1.5214 | 0.7093 | 0 |
| rs11221075 | Imputed | A | ADDITIVE | 4.53E-05 | 4.53E-05 | 0.6241 | 0.6241 | 0.5015 | 0 |
| rs11242020 | Imputed | T | DOMINANT | 1.95E-05 | 1.95E-05 | 0.6485 | 0.6485 | 0.8129 | 0 |
| rs11242021 | Imputed | T | DOMINANT | 2.31E-05 | 2.31E-05 | 0.6505 | 0.6505 | 0.8585 | 0 |
| rs11242022 | Imputed | T | DOMINANT | 2.55E-05 | 2.55E-05 | 0.6519 | 0.6519 | 0.8477 | 0 |
| rs11242023 | Imputed | T | DOMINANT | 3.12E-05 | 3.12E-05 | 0.6547 | 0.6547 | 0.8417 | 0 |
| rs1149349 | Imputed | T | DOMINANT | 0.0001762 | 0.0002852 | 1.5177 | 1.5147 | 0.3503 | 4.68 |
| rs1149350 | Imputed | A | ADDITIVE | 0.004059 | 0.341 | 1.2908 | 1.2455 | 0.0015 | 84.55 |
| rs1149350 | Imputed | A | DOMINANT | 2.56E-04 | 1.03E-01 | 1.4706 | 1.4199 | 0.0201 | 74.39 |
| rs11576627 | Imputed | T | ADDITIVE | 3.90E-05 | 3.90E-05 | 1.5393 | 1.5393 | 0.6597 | 0 |
| rs11576627 | Imputed | T | DOMINANT | 2.57E-05 | 2.57E-05 | 1.6368 | 1.6368 | 0.6902 | 0 |
| rs11630050 | Imputed | G | GENOTYPIC | 7.79E-05 | 7.79E-05 | 2.665 | 2.665 | 0.6771 | 0 |
| rs11630050 | Imputed | G | RECESSIVE | 8.54E-05 | 8.54E-05 | 2.6107 | 2.6107 | 0.6577 | 0 |
| rs11633024 | Imputed | C | GENOTYPIC | 7.79E-05 | 7.79E-05 | 2.665 | 2.665 | 0.6771 | 0 |
| rs11633024 | Imputed | C | RECESSIVE | 8.54E-05 | 8.54E-05 | 2.6107 | 2.6107 | 0.6577 | 0 |
| rs11636298 | Imputed | G | GENOTYPIC | 4.65E-05 | 4.65E-05 | 2.9093 | 2.9093 | 0.6341 | 0 |
| rs11636298 | Imputed | G | RECESSIVE | 7.67E-05 | 7.67E-05 | 2.7833 | 2.7833 | 0.6295 | 0 |
| rs11637363 | Imputed | C | GENOTYPIC | 4.03E-05 | 4.03E-05 | 2.7783 | 2.7783 | 0.6785 | 0 |
| rs11637363 | Imputed | C | RECESSIVE | 4.23E-05 | 4.23E-05 | 2.7253 | 2.7253 | 0.6672 | 0 |
| rs11637813 | Imputed | A | GENOTYPIC | 7.79E-05 | 7.79E-05 | 2.665 | 2.665 | 0.6771 | 0 |
| rs11637813 | Imputed | A | RECESSIVE | 8.54E-05 | 8.54E-05 | 2.6107 | 2.6107 | 0.6577 | 0 |
| rs11638043 | Imputed | C | GENOTYPIC | 6.02E-05 | 6.02E-05 | 2.6802 | 2.6802 | 0.7627 | 0 |
| rs11638043 | Imputed | C | RECESSIVE | 6.43E-05 | 6.43E-05 | 2.6274 | 2.6274 | 0.7406 | 0 |
| rs11638115 | Imputed | A | GENOTYPIC | 5.56E-05 | 5.56E-05 | 2.911 | 2.911 | 0.7416 | 0 |
| rs11638115 | Imputed | A | RECESSIVE | 8.05E-05 | 8.05E-05 | 2.8127 | 2.8127 | 0.7514 | 0 |
| rs11638444 | Imputed | C | GENOTYPIC | 8.18E-05 | 8.18E-05 | 2.781 | 2.781 | 0.5241 | 0 |
| rs11682946 | Imputed | A | ADDITIVE | 2.15E-05 | 2.15E-05 | 4.6724 | 4.6724 | 0.6013 | 0 |
| rs11682946 | Imputed | A | DOMINANT | 2.84E-05 | 2.84E-05 | 4.7413 | 4.7413 | 0.5763 | 0 |
| rs11717157 | Imputed | T | ADDITIVE | 3.66E-04 | 4.28E-03 | 1.3013 | 1.2939 | 0.2362 | 30.7 |
| rs11717157 | Imputed | T | GENOTYPIC | 4.70E-04 | 0.02682 | 1.7552 | 1.6884 | 0.1274 | 51.46 |
| rs11724055 | Imputed | A | DOMINANT | 5.58E-05 | 5.58E-05 | 0.6449 | 0.6449 | 0.4625 | 0 |
| rs11743355 | Imputed | C | ADDITIVE | 3.93E-03 | 1.07E-01 | 0.5325 | 0.414 | 0.005 | 81.12 |
| rs11743355 | Imputed | C | DOMINANT | 7.85E-03 | 1.52E-01 | 0.5256 | 0.4354 | 0.0052 | 80.99 |
| rs11746806 | Imputed | T | ADDITIVE | 2.88E-03 | 1.05E-01 | 0.5269 | 0.4225 | 0.0055 | 80.81 |
| rs11746806 | Imputed | T | DOMINANT | 5.93E-03 | 1.50E-01 | 0.5204 | 0.4449 | 0.0058 | 80.6 |
| rs11746959 | Imputed | T | ADDITIVE | 2.88E-03 | 0.1046 | 0.5269 | 0.4225 | 0.0055 | 80.81 |
| rs11746959 | Imputed | T | DOMINANT | 5.93E-03 | 1.50E-01 | 0.5204 | 0.4449 | 0.0058 | 80.6 |
| rs11749272 | Imputed | T | DOMINANT | 1.88E-05 | 1.88E-05 | 0.6481 | 0.6481 | 0.8316 | 0 |
| rs11839636 | Imputed | C | GENOTYPIC | 3.90E-03 | 2.09E-01 | 1.6569 | 1.5719 | 0.0165 | 75.65 |
| rs11839785 | Imputed | C | GENOTYPIC | 4.03E-03 | 2.10E-01 | 1.6541 | 1.57 | 0.0167 | 75.56 |
| rs11853619 | Imputed | C | GENOTYPIC | 5.35E-05 | 5.35E-05 | 2.8832 | 2.8832 | 0.6237 | 0 |
| rs11853619 | Imputed | C | RECESSIVE | 8.59E-05 | 8.59E-05 | 2.7639 | 2.7639 | 0.6266 | 0 |
| rs11856780 | Imputed | A | GENOTYPIC | 5.35E-05 | 5.35E-05 | 2.8832 | 2.8832 | 0.6237 | 0 |
| rs11856780 | Imputed | A | RECESSIVE | 8.59E-05 | 8.59E-05 | 2.7639 | 2.7639 | 0.6266 | 0 |
| rs11901899 | Imputed | A | DOMINANT | 5.52E-05 | 5.52E-05 | 1.5083 | 1.5083 | 0.5339 | 0 |
| rs11903290 | Imputed | C | RECESSIVE | 9.00E-05 | 9.00E-05 | 1.9859 | 1.9859 | 0.5245 | 0 |
| rs11909480 | Imputed | G | ADDITIVE | 9.50E-05 | 9.50E-05 | 0.4368 | 0.4368 | 0.6169 | 0 |
| rs11909480 | Imputed | G | DOMINANT | 7.23E-05 | 7.23E-05 | 0.418 | 0.418 | 0.5676 | 0 |
| rs11910289 | Imputed | T | ADDITIVE | 8.16E-05 | 8.16E-05 | 1.8423 | 1.8423 | 0.8017 | 0 |
| rs11910289 | Imputed | T | DOMINANT | 9.10E-05 | 9.10E-05 | 1.904 | 1.904 | 0.8708 | 0 |
| rs11920375 | Genotyped | C | GENOTYPIC | 7.95E-04 | 4.33E-02 | 1.703 | 1.6282 | 0.1117 | 54.37 |
| rs11926319 | Imputed | G | DOMINANT | 7.96E-04 | 0.02707 | 0.6352 | 0.6499 | 0.1381 | 49.5 |
| rs11933744 | Imputed | T | RECESSIVE | 3.12E-03 | 0.1216 | 1.7872 | 1.8072 | 0.0315 | 71.09 |
| rs11934919 | Imputed | C | RECESSIVE | 3.17E-03 | 0.1247 | 1.7868 | 1.804 | 0.0307 | 71.3 |
| rs11934957 | Imputed | C | RECESSIVE | 3.17E-03 | 0.1247 | 1.7868 | 1.804 | 0.0307 | 71.3 |
| rs11959206 | Imputed | A | RECESSIVE | 1.87E-03 | 0.191 | 0.678 | 0.7117 | 0.0177 | 75.21 |
| rs12038613 | Imputed | C | RECESSIVE | 3.47E-04 | 0.01168 | 0.613 | 0.6271 | 0.1717 | 43.24 |
| rs12151417 | Imputed | T | DOMINANT | 6.25E-05 | 6.25E-05 | 1.506 | 1.506 | 0.9573 | 0 |
| rs12153185 | Imputed | T | DOMINANT | 2.47E-05 | 2.47E-05 | 0.6504 | 0.6504 | 0.757 | 0 |
| rs12182651 | Imputed | T | DOMINANT | 8.64E-04 | 5.43E-02 | 1.5996 | 1.5843 | 0.071 | 62.2 |
| rs12235345 | Imputed | C | DOMINANT | 6.65E-05 | 6.65E-05 | 1.8285 | 1.8285 | 0.4602 | 0 |
| rs12324786 | Imputed | T | GENOTYPIC | 5.56E-05 | 5.56E-05 | 2.911 | 2.911 | 0.7416 | 0 |
| rs12324786 | Imputed | T | RECESSIVE | 8.05E-05 | 8.05E-05 | 2.8127 | 2.8127 | 0.7514 | 0 |
| rs12336958 | Imputed | G | DOMINANT | 4.62E-03 | 2.90E-01 | 1.3599 | 1.2903 | 0.009 | 78.77 |

TABLE 18-continued

| SNP rs # | SOURCE | ALLELE (A1) | MODEL | P | P(R) | OR | OR(R) | Q | I |
|---|---|---|---|---|---|---|---|---|---|
| rs12407412 | Imputed | C | ADDITIVE | 4.55E-05 | 4.55E-05 | 1.5333 | 1.5333 | 0.6371 | 0 |
| rs12407412 | Imputed | C | DOMINANT | 3.07E-05 | 3.07E-05 | 1.6289 | 1.6289 | 0.6561 | 0 |
| rs12418971 | Imputed | C | GENOTYPIC | 3.47E-05 | 3.47E-05 | 2.4809 | 2.4809 | 0.4834 | 0 |
| rs12418971 | Imputed | C | RECESSIVE | 6.71E-05 | 6.71E-05 | 2.3563 | 2.3563 | 0.5471 | 0 |
| rs1241967 | Imputed | T | RECESSIVE | 7.19E-05 | 7.19E-05 | 0.5103 | 0.5103 | 0.3812 | 0 |
| rs12420184 | Imputed | G | DOMINANT | 9.08E-03 | 4.26E-01 | 0.7449 | 0.7927 | 0.0017 | 84.33 |
| rs12433968 | Imputed | T | DOMINANT | 7.59E-04 | 1.18E-01 | 0.707 | 0.741 | 0.0375 | 69.54 |
| rs12445477 | Imputed | A | DOMINANT | 6.41E-05 | 8.38E-05 | 0.5585 | 0.5583 | 0.357 | 2.92 |
| rs12447191 | Genotyped | T | ADDITIVE | 8.95E-05 | 8.95E-05 | 0.6925 | 0.6925 | 0.818 | 0 |
| rs12447191 | Genotyped | T | DOMINANT | 5.17E-05 | 5.17E-05 | 0.6473 | 0.6473 | 0.3993 | 0 |
| rs12465349 | Imputed | A | RECESSIVE | 3.69E-05 | 3.69E-05 | 1.6009 | 1.6009 | 0.6932 | 0 |
| rs1247340 | Imputed | C | ADDITIVE | 7.69E-03 | 3.65E-01 | 1.2697 | 1.2218 | 0.0029 | 82.86 |
| rs1247340 | Imputed | C | DOMINANT | 0.0003633 | 0.0921 | 1.4554 | 1.406 | 0.0314 | 71.11 |
| rs1247341 | Imputed | C | ADDITIVE | 0.006355 | 0.3353 | 1.2777 | 1.2307 | 0.004 | 81.86 |
| rs1247341 | Imputed | C | DOMINANT | 3.13E-04 | 0.07821 | 1.4625 | 1.4174 | 0.0367 | 69.74 |
| rs1247343 | Imputed | C | DOMINANT | 3.36E-04 | 7.38E-03 | 1.4916 | 1.47 | 0.2058 | 36.74 |
| rs12509758 | Imputed | C | DOMINANT | 6.36E-05 | 6.36E-05 | 1.5131 | 1.5131 | 0.4849 | 0 |
| rs12515472 | Imputed | A | DOMINANT | 9.90E-05 | 9.90E-05 | 1.5106 | 1.5106 | 0.3966 | 0 |
| rs12548906 | Imputed | G | ADDITIVE | 4.27E-05 | 4.27E-05 | 1.4718 | 1.4718 | 0.4259 | 0 |
| rs12596240 | Imputed | G | DOMINANT | 1.60E-04 | 0.003727 | 0.6751 | 0.6862 | 0.2247 | 33.03 |
| rs12618781 | Imputed | A | DOMINANT | 1.01E-03 | 0.07896 | 0.6934 | 0.7084 | 0.0532 | 65.92 |
| rs12678600 | Imputed | A | DOMINANT | 5.24E-05 | 5.24E-05 | 0.665 | 0.665 | 0.5424 | 0 |
| rs12692229 | Imputed | T | ADDITIVE | 6.42E-05 | 6.42E-05 | 1.3491 | 1.3491 | 0.3777 | 0 |
| rs12713324 | Imputed | T | DOMINANT | 6.12E-05 | 6.12E-05 | 1.5047 | 1.5047 | 0.9505 | 0 |
| rs12719415 | Imputed | T | DOMINANT | 2.31E-05 | 2.31E-05 | 0.6505 | 0.6505 | 0.8585 | 0 |
| rs12820589 | Imputed | G | ADDITIVE | 1.70E-03 | 1.48E-01 | 1.3433 | 1.3243 | 0.0167 | 75.57 |
| rs12820589 | Imputed | G | DOMINANT | 1.50E-03 | 9.38E-02 | 1.4056 | 1.3931 | 0.0399 | 68.95 |
| rs12831292 | Imputed | G | ADDITIVE | 2.24E-05 | 2.24E-05 | 0.7299 | 0.7299 | 0.8379 | 0 |
| rs12831292 | Imputed | G | DOMINANT | 1.03E-05 | 1.03E-05 | 0.6291 | 0.6291 | 0.7999 | 0 |
| rs13012636 | Imputed | G | RECESSIVE | 7.97E-05 | 7.97E-05 | 1.996 | 1.996 | 0.5232 | 0 |
| rs13038146 | Imputed | C | ADDITIVE | 1.20E-05 | 1.20E-05 | 1.3766 | 1.3766 | 0.9732 | 0 |
| rs13038146 | Imputed | C | GENOTYPIC | 7.24E-06 | 7.24E-06 | 2.0174 | 2.0174 | 0.8918 | 0 |
| rs13038146 | Imputed | C | RECESSIVE | 6.47E-05 | 6.47E-05 | 1.7879 | 1.7879 | 0.5965 | 0 |
| rs13089860 | Imputed | A | DOMINANT | 8.44E-05 | 8.44E-05 | 0.6273 | 0.6273 | 0.9636 | 0 |
| rs13102419 | Imputed | T | RECESSIVE | 2.95E-04 | 0.003722 | 1.5536 | 1.5326 | 0.2434 | 29.22 |
| rs13194907 | Imputed | A | ADDITIVE | 4.90E-04 | 0.01486 | 1.6504 | 1.6306 | 0.1555 | 46.27 |
| rs13194907 | Imputed | A | DOMINANT | 0.0002179 | 0.004282 | 1.7592 | 1.7417 | 0.2106 | 35.82 |
| rs13195745 | Imputed | A | ADDITIVE | 5.08E-04 | 1.48E-02 | 1.6483 | 1.629 | 0.1573 | 45.94 |
| rs13195745 | Imputed | A | DOMINANT | 2.27E-04 | 4.24E-03 | 1.7567 | 1.7397 | 0.2126 | 35.41 |
| rs13265054 | Imputed | T | DOMINANT | 5.66E-05 | 5.66E-05 | 0.6647 | 0.6647 | 0.7133 | 0 |
| rs13273002 | Imputed | A | GENOTYPIC | 4.84E-04 | 1.49E-02 | 0.3723 | 0.3925 | 0.1872 | 40.32 |
| rs13282131 | Imputed | C | ADDITIVE | 3.71E-05 | 3.71E-05 | 1.3435 | 1.3435 | 0.8944 | 0 |
| rs13282131 | Imputed | C | GENOTYPIC | 1.60E-05 | 1.60E-05 | 1.8634 | 1.8634 | 0.9531 | 0 |
| rs13282131 | Imputed | C | RECESSIVE | 3.52E-05 | 3.52E-05 | 1.6677 | 1.6677 | 0.8497 | 0 |
| rs1330052 | Imputed | G | GENOTYPIC | 4.52E-03 | 2.69E-01 | 1.5788 | 1.4648 | 0.0124 | 77.22 |
| rs1335721 | Imputed | A | RECESSIVE | 3.43E-04 | 1.13E-02 | 0.6128 | 0.6267 | 0.1732 | 42.96 |
| rs1336382 | Imputed | T | DOMINANT | 3.16E-05 | 3.16E-05 | 1.5202 | 1.5202 | 0.7133 | 0 |
| rs1336383 | Imputed | T | DOMINANT | 2.98E-05 | 2.98E-05 | 1.5214 | 1.5214 | 0.7093 | 0 |
| rs1336407 | Imputed | T | DOMINANT | 4.97E-05 | 4.97E-05 | 1.5023 | 1.5023 | 0.7397 | 0 |
| rs1336409 | Imputed | T | DOMINANT | 4.97E-05 | 4.97E-05 | 1.5023 | 1.5023 | 0.7397 | 0 |
| rs1336596 | Imputed | A | DOMINANT | 0.0001018 | 0.03965 | 0.6696 | 0.6977 | 0.0654 | 63.33 |
| rs13387284 | Imputed | A | DOMINANT | 8.75E-05 | 0.08529 | 0.688 | 0.7034 | 0.044 | 67.99 |
| rs13401462 | Imputed | C | DOMINANT | 3.10E-04 | 1.15E-01 | 1.5296 | 1.4898 | 0.0127 | 77.09 |
| rs13409045 | Imputed | T | ADDITIVE | 1.07E-03 | 4.28E-02 | 0.786 | 0.7926 | 0.0962 | 57.29 |
| rs1349284 | Imputed | C | GENOTYPIC | 0.00058 | 0.0204 | 1.7388 | 1.6882 | 0.1518 | 46.96 |
| rs1355715 | Imputed | T | ADDITIVE | 9.33E-05 | 9.33E-05 | 0.5378 | 0.5378 | 0.685 | 0 |
| rs1357696 | Imputed | A | GENOTYPIC | 0.0009292 | 0.05615 | 1.6955 | 1.6136 | 0.0952 | 57.47 |
| rs1357698 | Imputed | A | GENOTYPIC | 8.00E-04 | 4.78E-02 | 1.7026 | 1.6275 | 0.1002 | 56.54 |
| rs1357699 | Imputed | T | GENOTYPIC | 0.0008002 | 0.04784 | 1.7026 | 1.6275 | 0.1002 | 56.54 |
| rs1363273 | Imputed | C | RECESSIVE | 5.45E-04 | 1.84E-02 | 0.6477 | 0.6596 | 0.1541 | 46.53 |
| rs1373601 | Imputed | A | DOMINANT | 2.77E-04 | 0.01048 | 0.6816 | 0.6853 | 0.1561 | 46.15 |
| rs1375829 | Imputed | C | GENOTYPIC | 5.80E-04 | 0.0204 | 1.7388 | 1.6882 | 0.1518 | 46.96 |
| rs1395748 | Imputed | G | DOMINANT | 4.33E-03 | 2.60E-01 | 0.7518 | 0.7852 | 0.0125 | 77.17 |
| rs1414865 | Imputed | T | DOMINANT | 5.22E-05 | 5.22E-05 | 1.503 | 1.503 | 0.7135 | 0 |
| rs1414873 | Imputed | A | DOMINANT | 4.97E-05 | 4.97E-05 | 1.5023 | 1.5023 | 0.7397 | 0 |
| rs1414876 | Imputed | C | DOMINANT | 4.97E-05 | 4.97E-05 | 1.5023 | 1.5023 | 0.7397 | 0 |
| rs1424643 | Imputed | G | ADDITIVE | 3.10E-05 | 3.10E-05 | 1.4271 | 1.4271 | 0.7865 | 0 |
| rs1424643 | Imputed | G | DOMINANT | 1.30E-05 | 1.30E-05 | 1.5651 | 1.5651 | 0.8673 | 0 |
| rs1424648 | Imputed | T | DOMINANT | 9.94E-05 | 9.94E-05 | 1.486 | 1.486 | 0.6958 | 0 |
| rs1429321 | Imputed | A | DOMINANT | 7.77E-05 | 7.77E-05 | 1.4953 | 1.4953 | 0.9675 | 0 |
| rs1429326 | Imputed | T | ADDITIVE | 9.21E-05 | 9.21E-05 | 1.399 | 1.399 | 0.8323 | 0 |
| rs1429326 | Imputed | T | DOMINANT | 3.60E-05 | 3.60E-05 | 1.5277 | 1.5277 | 0.9565 | 0 |
| rs1444741 | Imputed | A | DOMINANT | 2.75E-04 | 2.69E-02 | 0.6829 | 0.6887 | 0.0868 | 59.09 |
| rs1449916 | Imputed | C | DOMINANT | 1.95E-05 | 1.95E-05 | 0.5625 | 0.5625 | 0.3711 | 0 |
| rs1459523 | Imputed | A | ADDITIVE | 3.66E-04 | 4.28E-03 | 1.3013 | 1.2939 | 0.2362 | 30.7 |
| rs1459523 | Imputed | A | GENOTYPIC | 4.70E-04 | 0.02682 | 1.7552 | 1.6884 | 0.1274 | 51.46 |
| rs1466352 | Imputed | T | GENOTYPIC | 0.0005775 | 0.02214 | 1.7187 | 1.6652 | 0.1488 | 47.51 |
| rs1466353 | Imputed | G | GENOTYPIC | 0.0005742 | 0.02215 | 1.7191 | 1.6655 | 0.1486 | 47.55 |

TABLE 18-continued

| SNP rs # | SOURCE | ALLELE (A1) | MODEL | P | P(R) | OR | OR(R) | Q | I |
|---|---|---|---|---|---|---|---|---|---|
| rs1476714 | Imputed | A | DOMINANT | 2.39E−05 | 2.39E−05 | 0.6504 | 0.6504 | 0.8559 | 0 |
| rs1486723 | Imputed | C | RECESSIVE | 6.53E−05 | 6.53E−05 | 0.5173 | 0.5173 | 0.6824 | 0 |
| rs1495375 | Imputed | A | ADDITIVE | 4.26E−05 | 4.26E−05 | 0.7384 | 0.7384 | 0.8941 | 0 |
| rs1495375 | Imputed | A | DOMINANT | 2.29E−05 | 2.29E−05 | 0.6402 | 0.6402 | 0.8341 | 0 |
| rs1495381 | Imputed | T | GENOTYPIC | 6.50E−05 | 6.50E−05 | 1.8347 | 1.8347 | 0.5926 | 0 |
| rs1495381 | Imputed | T | RECESSIVE | 1.60E−05 | 1.60E−05 | 1.8065 | 1.8065 | 0.8326 | 0 |
| rs1498061 | Imputed | C | ADDITIVE | 3.02E−05 | 3.02E−05 | 0.5576 | 0.5576 | 0.7263 | 0 |
| rs1498992 | Imputed | G | DOMINANT | 3.76E−05 | 3.76E−05 | 0.6602 | 0.6602 | 0.6375 | 0 |
| rs1499001 | Imputed | T | DOMINANT | 2.63E−05 | 2.63E−05 | 0.6507 | 0.6507 | 0.4397 | 0 |
| rs1512988 | Imputed | A | ADDITIVE | 2.04E−05 | 2.04E−05 | 0.7286 | 0.7286 | 0.7895 | 0 |
| rs1512988 | Imputed | A | DOMINANT | 1.46E−05 | 1.46E−05 | 0.6349 | 0.6349 | 0.7791 | 0 |
| rs1512989 | Imputed | T | ADDITIVE | 2.04E−05 | 2.04E−05 | 0.7286 | 0.7286 | 0.7895 | 0 |
| rs1512989 | Imputed | T | DOMINANT | 1.46E−05 | 1.46E−05 | 0.6349 | 0.6349 | 0.7791 | 0 |
| rs1512991 | Imputed | T | ADDITIVE | 1.75E−05 | 1.75E−05 | 0.7317 | 0.7317 | 0.9424 | 0 |
| rs1512991 | Imputed | T | DOMINANT | 2.76E−05 | 2.76E−05 | 0.6327 | 0.6327 | 0.8654 | 0 |
| rs1512991 | Imputed | T | GENOTYPIC | 5.58E−05 | 5.58E−05 | 0.5525 | 0.5525 | 0.7914 | 0 |
| rs1524303 | Imputed | T | GENOTYPIC | 0.0005851 | 0.02098 | 1.7312 | 1.675 | 0.1554 | 46.29 |
| rs1524306 | Imputed | C | ADDITIVE | 0.000344 | 0.004662 | 1.3028 | 1.295 | 0.2276 | 32.44 |
| rs1524306 | Imputed | C | GENOTYPIC | 4.48E−04 | 2.71E−02 | 1.7589 | 1.6915 | 0.1248 | 51.94 |
| rs1524310 | Imputed | G | ADDITIVE | 2.72E−04 | 2.93E−03 | 1.3102 | 1.3039 | 0.2464 | 28.62 |
| rs1524310 | Imputed | G | GENOTYPIC | 0.0003497 | 0.01684 | 1.7827 | 1.724 | 0.1509 | 47.13 |
| rs1524321 | Imputed | C | GENOTYPIC | 3.30E−04 | 8.74E−03 | 1.772 | 1.7335 | 0.1931 | 39.2 |
| rs1527059 | Imputed | A | DOMINANT | 6.83E−05 | 6.83E−05 | 0.577 | 0.577 | 0.3905 | 0 |
| rs152707 | Imputed | A | ADDITIVE | 0.001601 | 0.1313 | 0.7957 | 0.8167 | 0.0376 | 69.53 |
| rs152707 | Imputed | A | GENOTYPIC | 1.86E−03 | 1.35E−01 | 0.6257 | 0.6605 | 0.0389 | 69.2 |
| rs152712 | Genotyped | C | ADDITIVE | 0.001213 | 0.1285 | 0.7908 | 0.812 | 0.0331 | 70.67 |
| rs152712 | Genotyped | C | GENOTYPIC | 0.001349 | 0.1341 | 0.6169 | 0.6528 | 0.0328 | 70.74 |
| rs1533994 | Imputed | T | GENOTYPIC | 0.0004988 | 0.02256 | 1.7311 | 1.674 | 0.142 | 48.77 |
| rs1535866 | Imputed | G | DOMINANT | 9.86E−05 | 9.86E−05 | 1.4938 | 1.4938 | 0.5229 | 0 |
| rs1563773 | Imputed | T | GENOTYPIC | 0.0006151 | 0.02321 | 1.7166 | 1.6611 | 0.1482 | 47.61 |
| rs1563774 | Imputed | T | GENOTYPIC | 0.0006165 | 0.02322 | 1.7172 | 1.6635 | 0.1469 | 47.87 |
| rs1567740 | Imputed | T | ADDITIVE | 1.99E−05 | 1.99E−05 | 0.7287 | 0.7287 | 0.7926 | 0 |
| rs1567740 | Imputed | T | DOMINANT | 1.35E−05 | 1.35E−05 | 0.634 | 0.634 | 0.765 | 0 |
| rs1572573 | Imputed | A | DOMINANT | 0.0004861 | 0.03203 | 1.4535 | 1.4085 | 0.1213 | 52.6 |
| rs1577497 | Imputed | C | RECESSIVE | 0.000359 | 0.01133 | 0.6139 | 0.6277 | 0.1749 | 42.64 |
| rs1581514 | Imputed | T | ADDITIVE | 0.0003311 | 0.003803 | 1.3057 | 1.2997 | 0.2373 | 30.49 |
| rs1581514 | Imputed | T | GENOTYPIC | 0.0004261 | 0.02325 | 1.7652 | 1.7041 | 0.1328 | 50.48 |
| rs1582321 | Imputed | T | DOMINANT | 0.0001513 | 0.003601 | 0.6742 | 0.6852 | 0.2244 | 33.07 |
| rs1582322 | Imputed | A | DOMINANT | 0.0001591 | 0.0008772 | 0.674 | 0.6797 | 0.3001 | 16.91 |
| rs1582323 | Imputed | A | DOMINANT | 0.0001659 | 0.001455 | 0.6747 | 0.6823 | 0.2779 | 21.9 |
| rs1592485 | Imputed | C | DOMINANT | 0.000161 | 0.001019 | 0.6729 | 0.6792 | 0.294 | 18.31 |
| rs1600954 | Imputed | T | ADDITIVE | 4.63E−05 | 4.63E−05 | 1.3445 | 1.3445 | 0.5721 | 0 |
| rs1600954 | Imputed | T | GENOTYPIC | 4.57E−05 | 4.57E−05 | 1.8147 | 1.8147 | 0.542 | 0 |
| rs16938626 | Imputed | G | DOMINANT | 3.76E−05 | 3.76E−05 | 0.659 | 0.659 | 0.6465 | 0 |
| rs16964300 | Imputed | G | ADDITIVE | 6.56E−05 | 6.56E−05 | 0.6892 | 0.6892 | 0.8019 | 0 |
| rs16964300 | Imputed | G | DOMINANT | 3.18E−05 | 3.18E−05 | 0.6401 | 0.6401 | 0.4292 | 0 |
| rs16986282 | Imputed | G | DOMINANT | 4.72E−05 | 4.72E−05 | 0.4011 | 0.4011 | 0.3857 | 0 |
| rs17007620 | Imputed | G | ADDITIVE | 0.00042 | 0.01992 | 1.3669 | 1.3587 | 0.1192 | 52.98 |
| rs17007620 | Imputed | G | DOMINANT | 0.0001365 | 0.003601 | 1.5086 | 1.5037 | 0.1945 | 38.93 |
| rs17014326 | Imputed | G | DOMINANT | 0.00215 | 0.2476 | 0.7351 | 0.7739 | 0.0097 | 78.44 |
| rs17047957 | Imputed | C | DOMINANT | 3.23E−05 | 3.23E−05 | 1.5756 | 1.5756 | 0.7413 | 0 |
| rs1705261 | Imputed | A | RECESSIVE | 2.52E−05 | 2.52E−05 | 1.7737 | 1.7737 | 0.834 | 0 |
| rs17073341 | Imputed | A | ADDITIVE | 9.48E−05 | 9.48E−05 | 2.0844 | 2.0844 | 0.3839 | 0 |
| rs17073341 | Imputed | A | DOMINANT | 7.90E−05 | 7.90E−05 | 2.1417 | 2.1417 | 0.3765 | 0 |
| rs17138702 | Imputed | G | ADDITIVE | 0.004 | 0.216 | 0.7417 | 0.7591 | 0.0117 | 77.5 |
| rs17189710 | Imputed | T | ADDITIVE | 1.26E−05 | 1.26E−05 | 1.3776 | 1.3776 | 0.9806 | 0 |
| rs17189710 | Imputed | T | GENOTYPIC | 7.08E−06 | 7.08E−06 | 2.0265 | 2.0265 | 0.8812 | 0 |
| rs17189710 | Imputed | T | RECESSIVE | 5.89E−05 | 5.89E−05 | 1.7991 | 1.7991 | 0.569 | 0 |
| rs17310176 | Imputed | T | ADDITIVE | 6.02E−05 | 6.02E−05 | 0.6787 | 0.6787 | 0.5641 | 0 |
| rs17310176 | Imputed | T | DOMINANT | 4.51E−05 | 4.51E−05 | 0.6409 | 0.6409 | 0.4149 | 0 |
| rs17358860 | Imputed | A | DOMINANT | 5.45E−05 | 5.45E−05 | 0.6457 | 0.6457 | 0.4986 | 0 |
| rs17370541 | Imputed | T | GENOTYPIC | 0.0003366 | 0.01452 | 1.7812 | 1.7046 | 0.176 | 42.44 |
| rs17370541 | Imputed | T | RECESSIVE | 0.0002644 | 0.004097 | 1.7173 | 1.6801 | 0.2409 | 29.74 |
| rs17526574 | Imputed | G | GENOTYPIC | 0.002555 | 0.1386 | 1.6824 | 1.6185 | 0.0319 | 70.98 |
| rs17530747 | Imputed | T | DOMINANT | 0.0007294 | 0.06795 | 0.7034 | 0.7357 | 0.0872 | 59.01 |
| rs17649114 | Imputed | C | DOMINANT | 5.86E−05 | 5.86E−05 | 1.5179 | 1.5179 | 0.5026 | 0 |
| rs17766172 | Imputed | A | RECESSIVE | 4.67E−05 | 4.67E−05 | 0.4975 | 0.4975 | 0.483 | 0 |
| rs1818885 | Imputed | G | GENOTYPIC | 0.0004892 | 0.02726 | 1.756 | 1.6897 | 0.1265 | 51.64 |
| rs1832222 | Imputed | G | DOMINANT | 5.68E−05 | 5.68E−05 | 1.4978 | 1.4978 | 0.7483 | 0 |
| rs1861327 | Imputed | G | DOMINANT | 0.0001308 | 0.002055 | 0.67 | 0.6796 | 0.2521 | 27.42 |
| rs1868581 | Imputed | G | ADDITIVE | 0.0003858 | 0.009401 | 1.3009 | 1.2907 | 0.1844 | 40.85 |
| rs1868581 | Imputed | G | GENOTYPIC | 0.0004728 | 0.03115 | 1.7583 | 1.6889 | 0.1157 | 53.63 |
| rs1874313 | Imputed | A | ADDITIVE | 3.53E−05 | 3.53E−05 | 0.7362 | 0.7362 | 0.736 | 0 |
| rs1874313 | Imputed | A | DOMINANT | 2.05E−05 | 2.05E−05 | 0.6403 | 0.6403 | 0.7327 | 0 |
| rs1876409 | Imputed | C | DOMINANT | 0.003381 | 0.227 | 0.746 | 0.7766 | 0.0157 | 75.94 |
| rs1913201 | Imputed | G | ADDITIVE | 2.15E−05 | 2.15E−05 | 0.7321 | 0.7321 | 0.9128 | 0 |
| rs1913201 | Imputed | G | DOMINANT | 6.73E−05 | 6.73E−05 | 0.6474 | 0.6474 | 0.8659 | 0 |
| rs1913201 | Imputed | G | GENOTYPIC | 6.26E−05 | 6.26E−05 | 0.5503 | 0.5503 | 0.7315 | 0 |

TABLE 18-continued

| SNP rs # | SOURCE | ALLELE (A1) | MODEL | P | P(R) | OR | OR(R) | Q | I |
|---|---|---|---|---|---|---|---|---|---|
| rs1916922 | Imputed | T | GENOTYPIC | 0.0006243 | 0.02368 | 1.7596 | 1.7018 | 0.1488 | 47.52 |
| rs1936871 | Genotyped | G | DOMINANT | 8.55E-05 | 8.55E-05 | 0.6616 | 0.6616 | 0.3925 | 0 |
| rs1961157 | Imputed | T | RECESSIVE | 0.002404 | 0.1282 | 0.68 | 0.6899 | 0.0283 | 71.94 |
| rs1987179 | Imputed | T | ADDITIVE | 9.76E-05 | 9.76E-05 | 0.6985 | 0.6985 | 0.7616 | 0 |
| rs1987179 | Imputed | T | DOMINANT | 6.37E-06 | 6.37E-06 | 0.6204 | 0.6204 | 0.6462 | 0 |
| rs1990023 | Imputed | T | DOMINANT | 1.72E-05 | 1.72E-05 | 0.6468 | 0.6468 | 0.8317 | 0 |
| rs1995025 | Imputed | C | DOMINANT | 7.87E-05 | 7.87E-05 | 1.5633 | 1.5633 | 0.7042 | 0 |
| rs2016194 | Imputed | G | DOMINANT | 2.38E-05 | 2.38E-05 | 0.651 | 0.651 | 0.8576 | 0 |
| rs2023651 | Imputed | T | ADDITIVE | 0.002541 | 0.2484 | 0.7624 | 0.7886 | 0.0082 | 79.2 |
| rs2024902 | Imputed | A | ADDITIVE | 0.0005049 | 0.01577 | 1.6486 | 1.6285 | 0.152 | 46.92 |
| rs2024902 | Imputed | A | DOMINANT | 0.0002252 | 0.004699 | 1.7569 | 1.739 | 0.2058 | 36.74 |
| rs2025107 | Imputed | A | DOMINANT | 0.0008183 | 0.05061 | 1.6029 | 1.5881 | 0.0749 | 61.42 |
| rs2025108 | Imputed | T | DOMINANT | 0.001038 | 0.04754 | 1.5831 | 1.5581 | 0.0932 | 57.86 |
| rs2031987 | Imputed | T | GENOTYPIC | 0.002645 | 0.1394 | 1.6843 | 1.6228 | 0.0311 | 71.19 |
| rs2052428 | Imputed | C | DOMINANT | 6.07E-05 | 6.07E-05 | 0.6359 | 0.6359 | 0.7925 | 0 |
| rs2053230 | Imputed | C | ADDITIVE | 0.0001481 | 0.003644 | 0.6297 | 0.6429 | 0.2766 | 22.2 |
| rs2062448 | Imputed | T | DOMINANT | 0.0003871 | 0.004058 | 0.6188 | 0.6264 | 0.2457 | 28.76 |
| rs2063420 | Imputed | C | RECESSIVE | 0.001837 | 0.1146 | 1.4963 | 1.443 | 0.0468 | 67.35 |
| rs2063591 | Imputed | C | ADDITIVE | 7.27E-05 | 7.27E-05 | 0.7518 | 0.7518 | 0.9305 | 0 |
| rs2063591 | Imputed | C | DOMINANT | 4.26E-05 | 4.26E-05 | 0.6381 | 0.6381 | 0.8973 | 0 |
| rs208026 | Genotyped | A | DOMINANT | 6.33E-05 | 6.33E-05 | 1.4986 | 1.4986 | 0.9606 | 0 |
| rs208029 | Imputed | T | DOMINANT | 3.75E-05 | 3.75E-05 | 1.5349 | 1.5349 | 0.4541 | 0 |
| rs208757 | Imputed | G | DOMINANT | 3.01E-05 | 3.01E-05 | 1.5343 | 1.5343 | 0.5566 | 0 |
| rs2095586 | Imputed | A | DOMINANT | 3.68E-05 | 3.68E-05 | 1.5163 | 1.5163 | 0.6839 | 0 |
| rs2095606 | Imputed | A | DOMINANT | 5.61E-05 | 0.01913 | 0.6593 | 0.6816 | 0.0926 | 57.97 |
| rs2102374 | Imputed | A | ADDITIVE | 0.001363 | 0.2021 | 0.7686 | 0.7983 | 0.0117 | 77.54 |
| rs2102374 | Imputed | A | DOMINANT | 0.001202 | 0.1846 | 0.7215 | 0.7489 | 0.0116 | 77.55 |
| rs2108426 | Imputed | C | DOMINANT | 2.38E-05 | 2.38E-05 | 0.651 | 0.651 | 0.8576 | 0 |
| rs2110664 | Imputed | A | DOMINANT | 3.76E-05 | 3.76E-05 | 1.532 | 1.532 | 0.6276 | 0 |
| rs2132242 | Imputed | A | ADDITIVE | 1.93E-05 | 1.93E-05 | 0.7293 | 0.7293 | 0.8549 | 0 |
| rs2132242 | Imputed | A | DOMINANT | 1.23E-05 | 1.23E-05 | 0.6323 | 0.6323 | 0.8457 | 0 |
| rs2158958 | Imputed | A | DOMINANT | 2.31E-05 | 2.31E-05 | 0.6505 | 0.6505 | 0.8585 | 0 |
| rs2158961 | Imputed | G | DOMINANT | 4.37E-05 | 4.37E-05 | 0.663 | 0.663 | 0.936 | 0 |
| rs2163046 | Imputed | A | DOMINANT | 7.62E-05 | 7.62E-05 | 1.4981 | 1.4981 | 0.988 | 0 |
| rs2180286 | Imputed | G | DOMINANT | 6.63E-05 | 6.63E-05 | 0.6345 | 0.6345 | 0.8013 | 0 |
| rs2180684 | Imputed | A | DOMINANT | 2.68E-05 | 2.68E-05 | 1.7201 | 1.7201 | 0.9033 | 0 |
| rs2188079 | Imputed | C | ADDITIVE | 0.0004508 | 0.01972 | 1.2881 | 1.2834 | 0.1244 | 52.01 |
| rs2188079 | Imputed | C | GENOTYPIC | 0.0002443 | 0.007437 | 1.7178 | 1.7019 | 0.1776 | 42.15 |
| rs2190598 | Imputed | T | DOMINANT | 2.31E-05 | 2.31E-05 | 0.6505 | 0.6505 | 0.8585 | 0 |
| rs2190600 | Imputed | A | DOMINANT | 2.54E-05 | 2.54E-05 | 0.6504 | 0.6504 | 0.7871 | 0 |
| rs2224184 | Genotyped | T | DOMINANT | 8.75E-05 | 8.75E-05 | 0.6414 | 0.6414 | 0.8155 | 0 |
| rs2247066 | Imputed | A | DOMINANT | 0.004329 | 0.2604 | 0.7518 | 0.7852 | 0.0125 | 77.17 |
| rs2248236 | Imputed | C | ADDITIVE | 2.90E-05 | 2.90E-05 | 0.676 | 0.676 | 0.7802 | 0 |
| rs2248236 | Imputed | C | DOMINANT | 1.58E-06 | 1.58E-06 | 0.596 | 0.596 | 0.8313 | 0 |
| rs2265733 | Imputed | C | ADDITIVE | 0.001363 | 0.2021 | 0.7686 | 0.7983 | 0.0117 | 77.54 |
| rs2265733 | Imputed | C | DOMINANT | 0.001202 | 0.1846 | 0.7215 | 0.7489 | 0.0116 | 77.55 |
| rs2270584 | Imputed | A | ADDITIVE | 2.02E-05 | 2.02E-05 | 0.7312 | 0.7312 | 0.8826 | 0 |
| rs2270584 | Imputed | A | DOMINANT | 2.32E-06 | 2.32E-06 | 0.6123 | 0.6123 | 0.8509 | 0 |
| rs2270586 | Imputed | A | ADDITIVE | 2.39E-05 | 2.39E-05 | 0.7334 | 0.7334 | 0.8691 | 0 |
| rs2270586 | Imputed | A | DOMINANT | 3.16E-06 | 3.16E-06 | 0.6167 | 0.6167 | 0.8138 | 0 |
| rs229775 | Imputed | A | RECESSIVE | 7.19E-05 | 7.19E-05 | 0.5103 | 0.5103 | 0.3812 | 0 |
| rs229815 | Imputed | T | RECESSIVE | 9.48E-05 | 9.48E-05 | 0.5099 | 0.5099 | 0.5285 | 0 |
| rs229829 | Imputed | C | RECESSIVE | 9.98E-05 | 9.98E-05 | 0.5548 | 0.5548 | 0.8369 | 0 |
| rs229831 | Imputed | A | RECESSIVE | 8.91E-05 | 8.91E-05 | 0.5096 | 0.5096 | 0.3946 | 0 |
| rs2317057 | Imputed | T | ADDITIVE | 6.41E-05 | 6.41E-05 | 0.6839 | 0.6839 | 0.7046 | 0 |
| rs2322100 | Genotyped | T | RECESSIVE | 4.07E-05 | 4.07E-05 | 2.2062 | 2.2062 | 0.5484 | 0 |
| rs2322101 | Imputed | A | RECESSIVE | 3.66E-05 | 3.66E-05 | 2.218 | 2.218 | 0.5273 | 0 |
| rs2327929 | Imputed | G | RECESSIVE | 3.43E-05 | 3.43E-05 | 1.6873 | 1.6873 | 0.4473 | 0 |
| rs2332844 | Imputed | A | ADDITIVE | 3.09E-05 | 3.09E-05 | 1.6598 | 1.6598 | 0.5134 | 0 |
| rs2332844 | Imputed | A | RECESSIVE | 6.54E-05 | 6.54E-05 | 1.7248 | 1.7248 | 0.7183 | 0 |
| rs2349170 | Imputed | G | DOMINANT | 9.67E-05 | 9.67E-05 | 1.4926 | 1.4926 | 0.6711 | 0 |
| rs2356722 | Imputed | G | DOMINANT | 0.002651 | 0.2845 | 0.7401 | 0.7804 | 0.0062 | 80.31 |
| rs2364956 | Imputed | T | ADDITIVE | 0.000127 | 0.0002252 | 1.4305 | 1.4298 | 0.3433 | 6.47 |
| rs2373793 | Imputed | G | ADDITIVE | 4.62E-05 | 4.62E-05 | 1.4791 | 1.4791 | 0.7939 | 0 |
| rs2373793 | Imputed | G | DOMINANT | 2.34E-05 | 2.34E-05 | 1.5985 | 1.5985 | 0.6098 | 0 |
| rs238252 | Imputed | G | ADDITIVE | 8.76E-05 | 0.0001795 | 1.4845 | 1.4806 | 0.3424 | 6.69 |
| rs238252 | Imputed | G | DOMINANT | 6.01E-05 | 0.0004281 | 1.5806 | 1.5679 | 0.292 | 18.76 |
| rs2383903 | Imputed | G | DOMINANT | 4.71E-05 | 4.71E-05 | 0.6638 | 0.6638 | 0.7307 | 0 |
| rs2387945 | Imputed | G | DOMINANT | 7.60E-05 | 7.60E-05 | 1.5615 | 1.5615 | 0.6844 | 0 |
| rs2389863 | Imputed | A | DOMINANT | 1.22E-05 | 1.22E-05 | 0.6334 | 0.6334 | 0.7957 | 0 |
| rs2389866 | Imputed | C | DOMINANT | 4.66E-06 | 4.66E-06 | 0.6225 | 0.6225 | 0.7145 | 0 |
| rs2389869 | Imputed | C | DOMINANT | 4.66E-06 | 4.66E-06 | 0.6225 | 0.6225 | 0.7145 | 0 |
| rs2389870 | Genotyped | C | DOMINANT | 6.46E-05 | 6.46E-05 | 0.6493 | 0.6493 | 0.3855 | 0 |
| rs2418494 | Imputed | G | ADDITIVE | 9.79E-05 | 9.79E-05 | 0.7569 | 0.7569 | 0.5664 | 0 |
| rs2418494 | Imputed | G | GENOTYPIC | 9.28E-05 | 9.28E-05 | 0.5712 | 0.5712 | 0.5491 | 0 |
| rs2418541 | Imputed | A | DOMINANT | 1.72E-05 | 1.72E-05 | 0.6468 | 0.6468 | 0.8317 | 0 |
| rs2418542 | Imputed | A | DOMINANT | 1.88E-05 | 1.88E-05 | 0.6481 | 0.6481 | 0.8316 | 0 |
| rs2423556 | Imputed | C | DOMINANT | 7.99E-05 | 7.99E-05 | 0.635 | 0.635 | 0.8112 | 0 |

TABLE 18-continued

| SNP rs # | SOURCE | ALLELE (A1) | MODEL | P | P(R) | OR | OR(R) | Q | I |
|---|---|---|---|---|---|---|---|---|---|
| rs2437688 | Imputed | C | ADDITIVE | 7.95E−05 | 7.95E−05 | 1.591 | 1.591 | 0.4782 | 0 |
| rs2456809 | Imputed | G | DOMINANT | 0.002716 | 0.1918 | 0.7406 | 0.7699 | 0.0226 | 73.61 |
| rs2456811 | Imputed | T | ADDITIVE | 0.001617 | 0.2162 | 0.7717 | 0.802 | 0.0106 | 77.99 |
| rs2456811 | Imputed | T | DOMINANT | 0.001438 | 0.1994 | 0.7251 | 0.7532 | 0.0104 | 78.1 |
| rs2476976 | Imputed | C | DOMINANT | 6.91E−05 | 6.91E−05 | 1.4908 | 1.4908 | 0.8073 | 0 |
| rs2484911 | Imputed | A | DOMINANT | 9.19E−05 | 9.19E−05 | 1.4801 | 1.4801 | 0.8339 | 0 |
| rs2488557 | Imputed | C | DOMINANT | 0.000454 | 0.009593 | 0.6571 | 0.6684 | 0.1949 | 38.85 |
| rs250162 | Imputed | C | ADDITIVE | 7.89E−06 | 7.89E−06 | 0.6754 | 0.6754 | 0.5537 | 0 |
| rs250162 | Imputed | C | DOMINANT | 3.91E−06 | 3.91E−06 | 0.6207 | 0.6207 | 0.4842 | 0 |
| rs2560708 | Imputed | T | ADDITIVE | 8.04E−05 | 8.04E−05 | 0.6746 | 0.6746 | 0.7071 | 0 |
| rs2617841 | Imputed | G | DOMINANT | 7.42E−05 | 7.42E−05 | 0.6584 | 0.6584 | 0.6003 | 0 |
| rs2622499 | Imputed | G | DOMINANT | 5.66E−06 | 5.66E−06 | 0.6251 | 0.6251 | 0.6966 | 0 |
| rs264129 | Imputed | T | DOMINANT | 4.75E−05 | 4.75E−05 | 0.6631 | 0.6631 | 0.9256 | 0 |
| rs2642936 | Imputed | T | ADDITIVE | 0.0008203 | 0.04658 | 1.3495 | 1.3354 | 0.0879 | 58.88 |
| rs2660633 | Imputed | A | DOMINANT | 0.003381 | 0.227 | 0.746 | 0.7766 | 0.0157 | 75.94 |
| rs2660634 | Imputed | C | DOMINANT | 0.003381 | 0.227 | 0.746 | 0.7766 | 0.0157 | 75.94 |
| rs2660648 | Imputed | A | ADDITIVE | 0.001363 | 0.2021 | 0.7686 | 0.7983 | 0.0117 | 77.54 |
| rs2660648 | Imputed | A | DOMINANT | 0.001202 | 0.1846 | 0.7215 | 0.7489 | 0.0116 | 77.55 |
| rs2681505 | Imputed | T | ADDITIVE | 2.69E−05 | 2.69E−05 | 0.6941 | 0.6941 | 0.3782 | 0 |
| rs277411 | Imputed | G | DOMINANT | 0.002587 | 0.1087 | 0.5246 | 0.4938 | 0.0195 | 74.6 |
| rs2832634 | Imputed | G | ADDITIVE | 9.75E−05 | 9.75E−05 | 1.8259 | 1.8259 | 0.7829 | 0 |
| rs2832637 | Imputed | T | ADDITIVE | 9.75E−05 | 9.75E−05 | 1.8259 | 1.8259 | 0.7829 | 0 |
| rs2843167 | Imputed | A | DOMINANT | 0.001237 | 0.1278 | 0.7224 | 0.7509 | 0.0362 | 69.86 |
| rs2876227 | Imputed | C | ADDITIVE | 2.82E−05 | 2.82E−05 | 1.362 | 1.362 | 0.97 | 0 |
| rs2876227 | Imputed | C | GENOTYPIC | 1.54E−05 | 1.54E−05 | 1.9854 | 1.9854 | 0.8563 | 0 |
| rs2882097 | Imputed | A | DOMINANT | 2.98E−05 | 2.98E−05 | 1.5214 | 1.5214 | 0.7093 | 0 |
| rs2909862 | Imputed | G | DOMINANT | 0.0004342 | 0.0219 | 1.5096 | 1.4698 | 0.1401 | 49.11 |
| rs3001945 | Imputed | T | DOMINANT | 7.34E−05 | 7.34E−05 | 1.5785 | 1.5785 | 0.8106 | 0 |
| rs3011020 | Imputed | C | DOMINANT | 7.27E−05 | 7.27E−05 | 1.5634 | 1.5634 | 0.6833 | 0 |
| rs36071725 | Genotyped | C | ADDITIVE | 0.0001148 | 0.05399 | 1.3419 | 1.3062 | 0.0432 | 68.17 |
| rs36071725 | Genotyped | C | GENOTYPIC | 0.0001469 | 0.1424 | 1.9245 | 1.7281 | 0.0116 | 77.56 |
| rs373983 | Imputed | G | DOMINANT | 2.26E−05 | 2.26E−05 | 1.5782 | 1.5782 | 0.441 | 0 |
| rs3743794 | Imputed | G | DOMINANT | 0.0002394 | 0.002286 | 0.6809 | 0.6895 | 0.2695 | 23.73 |
| rs3756154 | Imputed | C | ADDITIVE | 8.74E−05 | 8.74E−05 | 0.6973 | 0.6973 | 0.7453 | 0 |
| rs3756154 | Imputed | C | DOMINANT | 5.57E−06 | 5.57E−06 | 0.6194 | 0.6194 | 0.6345 | 0 |
| rs3775850 | Imputed | A | DOMINANT | 4.28E−05 | 4.28E−05 | 0.6406 | 0.6406 | 0.4572 | 0 |
| rs3775851 | Imputed | C | DOMINANT | 5.58E−05 | 5.58E−05 | 0.6449 | 0.6449 | 0.4625 | 0 |
| rs3793044 | Imputed | C | ADDITIVE | 0.0006211 | 0.01526 | 1.6363 | 1.6145 | 0.1659 | 44.33 |
| rs3793044 | Imputed | C | DOMINANT | 0.0002821 | 0.004123 | 1.7429 | 1.7248 | 0.2257 | 32.82 |
| rs3793053 | Imputed | C | DOMINANT | 0.0006344 | 0.04352 | 1.6268 | 1.6074 | 0.0815 | 60.12 |
| rs3796246 | Imputed | G | DOMINANT | 0.0006434 | 0.02777 | 0.6293 | 0.6362 | 0.1152 | 53.73 |
| rs3806003 | Imputed | A | ADDITIVE | 0.0006211 | 0.01526 | 1.6363 | 1.6145 | 0.1659 | 44.33 |
| rs3806003 | Imputed | A | DOMINANT | 0.0002821 | 0.004123 | 1.7429 | 1.7248 | 0.2257 | 32.82 |
| rs3806004 | Imputed | T | DOMINANT | 0.0008183 | 0.05061 | 1.6029 | 1.5881 | 0.0749 | 61.42 |
| rs3806010 | Imputed | T | DOMINANT | 0.0008183 | 0.05061 | 1.6029 | 1.5881 | 0.0749 | 61.42 |
| rs3806014 | Imputed | T | DOMINANT | 0.0006528 | 0.0397 | 1.6219 | 1.6045 | 0.0892 | 58.62 |
| rs3806015 | Imputed | A | DOMINANT | 0.0007014 | 0.04258 | 1.6162 | 1.5981 | 0.0866 | 59.13 |
| rs3806018 | Imputed | A | DOMINANT | 0.001012 | 0.05137 | 1.5918 | 1.5803 | 0.0785 | 60.71 |
| rs3806019 | Imputed | A | DOMINANT | 0.0009044 | 0.0577 | 1.5971 | 1.581 | 0.0678 | 62.83 |
| rs3806024 | Imputed | T | DOMINANT | 0.0006532 | 0.0428 | 1.619 | 1.6067 | 0.0793 | 60.54 |
| rs3915080 | Imputed | A | GENOTYPIC | 0.0006483 | 0.0458 | 1.7202 | 1.6467 | 0.095 | 57.52 |
| rs3942254 | Imputed | T | ADDITIVE | 2.13E−05 | 2.13E−05 | 0.7274 | 0.7274 | 0.9089 | 0 |
| rs3942254 | Imputed | T | DOMINANT | 9.53E−06 | 9.53E−06 | 0.6253 | 0.6253 | 0.9519 | 0 |
| rs3945085 | Imputed | A | DOMINANT | 3.27E−05 | 3.27E−05 | 1.519 | 1.519 | 0.687 | 0 |
| rs3976737 | Imputed | G | ADDITIVE | 0.003945 | 0.2806 | 0.7457 | 0.7798 | 0.0081 | 79.23 |
| rs399485 | Imputed | A | DOMINANT | 4.97E−05 | 4.97E−05 | 1.5032 | 1.5032 | 0.8617 | 0 |
| rs4029119 | Imputed | G | ADDITIVE | 0.004166 | 0.1177 | 0.5395 | 0.4424 | 0.0069 | 79.92 |
| rs4029119 | Imputed | G | DOMINANT | 0.008687 | 0.1677 | 0.5356 | 0.4664 | 0.0072 | 79.71 |
| rs4076201 | Imputed | G | GENOTYPIC | 5.99E−05 | 5.99E−05 | 2.6809 | 2.6809 | 0.7622 | 0 |
| rs4076201 | Imputed | G | RECESSIVE | 6.53E−05 | 6.53E−05 | 2.6253 | 2.6253 | 0.7419 | 0 |
| rs41395945 | Imputed | G | ADDITIVE | 7.48E−05 | 7.48E−05 | 1.8482 | 1.8482 | 0.7926 | 0 |
| rs41395945 | Imputed | G | DOMINANT | 8.37E−05 | 8.37E−05 | 1.9099 | 1.9099 | 0.8616 | 0 |
| rs4146972 | Genotyped | T | DOMINANT | 3.95E−05 | 3.95E−05 | 1.5614 | 1.5614 | 0.6547 | 0 |
| rs4238087 | Imputed | G | DOMINANT | 9.82E−05 | 9.82E−05 | 0.6268 | 0.6268 | 0.5018 | 0 |
| rs4251569 | Imputed | T | ADDITIVE | 9.93E−05 | 9.93E−05 | 0.6551 | 0.6551 | 0.6066 | 0 |
| rs4251569 | Imputed | T | DOMINANT | 8.05E−05 | 8.05E−05 | 0.6254 | 0.6254 | 0.4972 | 0 |
| rs4273613 | Imputed | T | ADDITIVE | 0.002876 | 0.1046 | 0.5269 | 0.4225 | 0.0055 | 80.81 |
| rs4273613 | Imputed | T | DOMINANT | 0.005931 | 0.1502 | 0.5204 | 0.4449 | 0.0058 | 80.6 |
| rs4291049 | Imputed | T | RECESSIVE | 0.002115 | 0.1545 | 0.6826 | 0.7124 | 0.0331 | 70.66 |
| rs4315598 | Imputed | T | ADDITIVE | 1.33E−05 | 1.33E−05 | 1.3742 | 1.3742 | 0.9673 | 0 |
| rs4315598 | Imputed | T | GENOTYPIC | 8.02E−06 | 8.02E−06 | 2.0108 | 2.0108 | 0.8929 | 0 |
| rs4315598 | Imputed | T | RECESSIVE | 6.81E−05 | 6.81E−05 | 1.7847 | 1.7847 | 0.5993 | 0 |
| rs4321395 | Imputed | A | DOMINANT | 0.0008748 | 0.08529 | 0.688 | 0.7034 | 0.044 | 67.99 |
| rs4321596 | Genotyped | T | RECESSIVE | 9.95E−05 | 9.95E−05 | 2.3838 | 2.3838 | 0.8271 | 0 |
| rs4324417 | Imputed | T | DOMINANT | 0.0004684 | 0.01009 | 1.4729 | 1.4477 | 0.1952 | 38.79 |
| rs4328619 | Genotyped | G | DOMINANT | 8.16E−05 | 8.16E−05 | 0.6393 | 0.6393 | 0.768 | 0 |
| rs4338909 | Imputed | T | ADDITIVE | 0.0009962 | 0.03681 | 1.2613 | 1.2511 | 0.1094 | 54.81 |
| rs4370878 | Imputed | G | DOMINANT | 5.08E−05 | 5.08E−05 | 1.5041 | 1.5041 | 0.6831 | 0 |

TABLE 18-continued

| SNP rs # | SOURCE | ALLELE (A1) | MODEL | P | P(R) | OR | OR(R) | Q | I |
|---|---|---|---|---|---|---|---|---|---|
| rs4379434 | Genotyped | T | DOMINANT | 0.0008974 | 0.03349 | 1.4182 | 1.3922 | 0.1216 | 52.53 |
| rs4416407 | Imputed | T | DOMINANT | 7.89E−05 | 7.89E−05 | 1.6055 | 1.6055 | 0.6011 | 0 |
| rs4417899 | Imputed | C | RECESSIVE | 7.35E−05 | 7.35E−05 | 0.6217 | 0.6217 | 0.5918 | 0 |
| rs4442732 | Imputed | A | ADDITIVE | 0.0002973 | 0.01275 | 0.7154 | 0.7312 | 0.1721 | 43.17 |
| rs4444612 | Imputed | G | ADDITIVE | 1.05E−05 | 1.05E−05 | 1.38 | 1.38 | 0.9803 | 0 |
| rs4444612 | Imputed | G | GENOTYPIC | 6.88E−06 | 6.88E−06 | 2.022 | 2.022 | 0.8907 | 0 |
| rs4444612 | Imputed | G | RECESSIVE | 6.51E−05 | 6.51E−05 | 1.7874 | 1.7874 | 0.5969 | 0 |
| rs4450660 | Imputed | C | DOMINANT | 6.12E−05 | 6.12E−05 | 1.5007 | 1.5007 | 0.4999 | 0 |
| rs4509702 | Imputed | C | DOMINANT | 5.08E−05 | 5.08E−05 | 1.5041 | 1.5041 | 0.6831 | 0 |
| rs4526920 | Imputed | G | GENOTYPIC | 0.002645 | 0.1394 | 1.6843 | 1.6228 | 0.0311 | 71.19 |
| rs4533145 | Imputed | T | DOMINANT | 0.06008 | 0.6325 | 0.7887 | 0.8292 | 0.0001 | 89.37 |
| rs4557006 | Imputed | A | DOMINANT | 0.001528 | 0.089 | 0.6986 | 0.7133 | 0.0548 | 65.56 |
| rs4570530 | Imputed | C | DOMINANT | 5.08E−05 | 5.08E−05 | 1.5041 | 1.5041 | 0.6831 | 0 |
| rs4615971 | Imputed | C | DOMINANT | 4.82E−05 | 4.82E−05 | 1.5038 | 1.5038 | 0.7548 | 0 |
| rs4628119 | Imputed | A | DOMINANT | 0.0009573 | 0.07481 | 0.7135 | 0.7203 | 0.0461 | 67.51 |
| rs4664443 | Imputed | G | ADDITIVE | 0.0009373 | 0.04269 | 0.7841 | 0.7912 | 0.0927 | 57.96 |
| rs4688259 | Imputed | T | DOMINANT | 7.88E−05 | 7.88E−05 | 1.6056 | 1.6056 | 0.5986 | 0 |
| rs4688632 | Imputed | G | RECESSIVE | 4.49E−05 | 4.49E−05 | 0.6188 | 0.6188 | 0.7162 | 0 |
| rs4695284 | Imputed | A | ADDITIVE | 6.68E−05 | 6.68E−05 | 1.8181 | 1.8181 | 0.5549 | 0 |
| rs4700302 | Imputed | A | ADDITIVE | 0.002913 | 0.1394 | 0.6642 | 0.6808 | 0.0345 | 70.31 |
| rs4702720 | Imputed | A | ADDITIVE | 4.29E−05 | 4.29E−05 | 0.6727 | 0.6727 | 0.6127 | 0 |
| rs4702720 | Imputed | A | DOMINANT | 2.14E−05 | 2.14E−05 | 0.6116 | 0.6116 | 0.5842 | 0 |
| rs4711091 | Genotyped | G | GENOTYPIC | 0.003111 | 0.235 | 1.5203 | 1.4091 | 0.02 | 74.42 |
| rs4714484 | Imputed | A | ADDITIVE | 6.43E−05 | 0.0001399 | 0.6741 | 0.6745 | 0.3377 | 7.89 |
| rs4736802 | Imputed | G | DOMINANT | 0.0007866 | 0.03886 | 1.4239 | 1.3953 | 0.1046 | 55.7 |
| rs4760785 | Imputed | A | ADDITIVE | 2.15E−05 | 2.15E−05 | 0.7321 | 0.7321 | 0.9128 | 0 |
| rs4760785 | Imputed | A | DOMINANT | 6.73E−05 | 6.73E−05 | 0.6474 | 0.6474 | 0.8659 | 0 |
| rs4760785 | Imputed | A | GENOTYPIC | 6.26E−05 | 6.26E−05 | 0.5503 | 0.5503 | 0.7315 | 0 |
| rs4760894 | Imputed | T | ADDITIVE | 2.15E−05 | 2.15E−05 | 0.7321 | 0.7321 | 0.9128 | 0 |
| rs4760894 | Imputed | T | DOMINANT | 6.73E−05 | 6.73E−05 | 0.6474 | 0.6474 | 0.8659 | 0 |
| rs4760894 | Imputed | T | GENOTYPIC | 6.26E−05 | 6.26E−05 | 0.5503 | 0.5503 | 0.7315 | 0 |
| rs4760895 | Imputed | A | ADDITIVE | 2.15E−05 | 2.15E−05 | 0.7321 | 0.7321 | 0.9128 | 0 |
| rs4760895 | Imputed | A | DOMINANT | 6.73E−05 | 6.73E−05 | 0.6474 | 0.6474 | 0.8659 | 0 |
| rs4760895 | Imputed | A | GENOTYPIC | 6.26E−05 | 6.26E−05 | 0.5503 | 0.5503 | 0.7315 | 0 |
| rs4764738 | Imputed | A | ADDITIVE | 0.0009266 | 0.07954 | 1.2709 | 1.2594 | 0.0439 | 68.01 |
| rs4764738 | Imputed | A | GENOTYPIC | 0.001005 | 0.08625 | 1.6088 | 1.5782 | 0.0404 | 68.83 |
| rs4764974 | Imputed | T | ADDITIVE | 0.003078 | 0.1633 | 1.2361 | 1.2211 | 0.0224 | 73.69 |
| rs4764974 | Imputed | T | GENOTYPIC | 0.003002 | 0.1626 | 1.5291 | 1.4908 | 0.0225 | 73.63 |
| rs4798366 | Imputed | G | RECESSIVE | 4.20E−05 | 4.20E−05 | 2.0082 | 2.0082 | 0.3989 | 0 |
| rs483159 | Imputed | T | DOMINANT | 7.40E−05 | 7.40E−05 | 1.5348 | 1.5348 | 0.4489 | 0 |
| rs4836502 | Imputed | T | DOMINANT | 2.31E−05 | 2.31E−05 | 0.6505 | 0.6505 | 0.8585 | 0 |
| rs4836507 | Imputed | C | DOMINANT | 2.65E−05 | 2.65E−05 | 0.6512 | 0.6512 | 0.7993 | 0 |
| rs4836744 | Imputed | A | ADDITIVE | 5.65E−05 | 5.65E−05 | 0.7302 | 0.7302 | 0.9215 | 0 |
| rs4836744 | Imputed | A | DOMINANT | 9.27E−05 | 9.27E−05 | 0.6763 | 0.6763 | 0.9561 | 0 |
| rs4848944 | Genotyped | C | RECESSIVE | 9.83E−05 | 9.83E−05 | 0.6206 | 0.6206 | 0.3871 | 0 |
| rs4851529 | Imputed | A | DOMINANT | 2.19E−05 | 2.19E−05 | 0.6441 | 0.6441 | 0.7104 | 0 |
| rs4851531 | Imputed | T | DOMINANT | 3.21E−05 | 3.21E−05 | 0.6474 | 0.6474 | 0.5448 | 0 |
| rs4858046 | Genotyped | T | GENOTYPIC | 0.0006163 | 0.0233 | 1.7237 | 1.6703 | 0.1446 | 48.29 |
| rs4878214 | Imputed | A | ADDITIVE | 3.88E−05 | 3.88E−05 | 0.6738 | 0.6738 | 0.5061 | 0 |
| rs4880803 | Imputed | A | ADDITIVE | 9.69E−05 | 9.69E−05 | 0.7391 | 0.7391 | 0.6783 | 0 |
| rs489441 | Imputed | G | ADDITIVE | 2.53E−05 | 2.53E−05 | 1.4225 | 1.4225 | 0.5025 | 0 |
| rs489441 | Imputed | G | DOMINANT | 2.68E−05 | 2.68E−05 | 1.5463 | 1.5463 | 0.8089 | 0 |
| rs4896568 | Imputed | T | DOMINANT | 0.001111 | 0.06921 | 0.7129 | 0.7224 | 0.06 | 64.45 |
| rs4938851 | Imputed | T | DOMINANT | 3.87E−05 | 3.87E−05 | 1.5301 | 1.5301 | 0.5447 | 0 |
| rs4964416 | Imputed | C | DOMINANT | 9.70E−05 | 9.70E−05 | 0.6422 | 0.6422 | 0.8344 | 0 |
| rs5756669 | Imputed | C | DOMINANT | 0.0004684 | 0.01009 | 1.4729 | 1.4477 | 0.1952 | 38.79 |
| rs6033138 | Imputed | C | ADDITIVE | 7.29E−06 | 7.29E−06 | 1.3851 | 1.3851 | 0.9889 | 0 |
| rs6033138 | Imputed | C | GENOTYPIC | 6.04E−06 | 6.04E−06 | 2.0122 | 2.0122 | 0.8928 | 0 |
| rs6033138 | Imputed | C | RECESSIVE | 7.08E−05 | 7.08E−05 | 1.7649 | 1.7649 | 0.6157 | 0 |
| rs6040619 | Imputed | C | ADDITIVE | 4.47E−06 | 4.47E−06 | 1.3986 | 1.3986 | 0.8222 | 0 |
| rs6040619 | Imputed | C | GENOTYPIC | 2.25E−06 | 2.25E−06 | 2.1003 | 2.1003 | 0.9241 | 0 |
| rs6040619 | Imputed | C | RECESSIVE | 2.09E−05 | 2.09E−05 | 1.861 | 1.861 | 0.8676 | 0 |
| rs6040625 | Imputed | T | ADDITIVE | 5.19E−06 | 5.19E−06 | 1.3953 | 1.3953 | 0.8592 | 0 |
| rs6040625 | Imputed | T | GENOTYPIC | 3.08E−06 | 3.08E−06 | 2.0812 | 2.0812 | 0.9469 | 0 |
| rs6040625 | Imputed | T | RECESSIVE | 3.05E−05 | 3.05E−05 | 1.8401 | 1.8401 | 0.8473 | 0 |
| rs6040630 | Imputed | A | ADDITIVE | 9.20E−06 | 9.20E−06 | 1.383 | 1.383 | 0.9581 | 0 |
| rs6040630 | Imputed | A | GENOTYPIC | 5.55E−06 | 5.55E−06 | 2.0375 | 2.0375 | 0.9148 | 0 |
| rs6040630 | Imputed | A | RECESSIVE | 5.12E−05 | 5.12E−05 | 1.8039 | 1.8039 | 0.6621 | 0 |
| rs6040633 | Imputed | A | ADDITIVE | 1.25E−05 | 1.25E−05 | 1.3756 | 1.3756 | 0.969 | 0 |
| rs6040633 | Imputed | A | GENOTYPIC | 7.70E−06 | 7.70E−06 | 2.0134 | 2.0134 | 0.8921 | 0 |
| rs6040633 | Imputed | A | RECESSIVE | 6.75E−05 | 6.75E−05 | 1.7849 | 1.7849 | 0.6011 | 0 |
| rs6040634 | Imputed | T | ADDITIVE | 1.00E−05 | 1.00E−05 | 1.3804 | 1.3804 | 0.9666 | 0 |
| rs6040634 | Imputed | T | GENOTYPIC | 6.55E−06 | 6.55E−06 | 2.0241 | 2.0241 | 0.8798 | 0 |
| rs6040634 | Imputed | T | RECESSIVE | 6.47E−05 | 6.47E−05 | 1.7879 | 1.7879 | 0.5965 | 0 |
| rs6040636 | Imputed | T | ADDITIVE | 1.31E−05 | 1.31E−05 | 1.3748 | 1.3748 | 0.9806 | 0 |
| rs6040636 | Imputed | T | GENOTYPIC | 7.73E−06 | 7.73E−06 | 2.0134 | 2.0134 | 0.9037 | 0 |
| rs6040636 | Imputed | T | RECESSIVE | 6.47E−05 | 6.47E−05 | 1.7879 | 1.7879 | 0.5965 | 0 |
| rs6040638 | Imputed | C | ADDITIVE | 1.20E−05 | 1.20E−05 | 1.3766 | 1.3766 | 0.9732 | 0 |

TABLE 18-continued

| SNP rs # | SOURCE | ALLELE (A1) | MODEL | P | P(R) | OR | OR(R) | Q | I |
|---|---|---|---|---|---|---|---|---|---|
| rs6040638 | Imputed | C | GENOTYPIC | 7.24E-06 | 7.24E-06 | 2.0174 | 2.0174 | 0.8918 | 0 |
| rs6040638 | Imputed | C | RECESSIVE | 6.47E-05 | 6.47E-05 | 1.7879 | 1.7879 | 0.5965 | 0 |
| rs6040644 | Imputed | A | ADDITIVE | 1.20E-05 | 1.20E-05 | 1.3766 | 1.3766 | 0.9732 | 0 |
| rs6040644 | Imputed | A | GENOTYPIC | 7.24E-06 | 7.24E-06 | 2.0174 | 2.0174 | 0.8918 | 0 |
| rs6040644 | Imputed | A | RECESSIVE | 6.47E-05 | 6.47E-05 | 1.7879 | 1.7879 | 0.5965 | 0 |
| rs6040667 | Imputed | T | ADDITIVE | 1.20E-05 | 1.20E-05 | 1.3804 | 1.3804 | 0.9597 | 0 |
| rs6040667 | Imputed | T | GENOTYPIC | 7.88E-06 | 7.88E-06 | 2.0249 | 2.0249 | 0.8444 | 0 |
| rs6040667 | Imputed | T | RECESSIVE | 7.44E-05 | 7.44E-05 | 1.7892 | 1.7892 | 0.5844 | 0 |
| rs6040668 | Imputed | C | ADDITIVE | 1.73E-05 | 1.73E-05 | 1.373 | 1.373 | 0.98 | 0 |
| rs6040668 | Imputed | C | GENOTYPIC | 1.05E-05 | 1.05E-05 | 2.0115 | 2.0115 | 0.8502 | 0 |
| rs6040668 | Imputed | C | RECESSIVE | 9.40E-05 | 9.40E-05 | 1.7793 | 1.7793 | 0.5751 | 0 |
| rs6043066 | Genotyped | G | DOMINANT | 9.84E-05 | 9.84E-05 | 1.4879 | 1.4879 | 0.4214 | 0 |
| rs6048146 | Imputed | G | DOMINANT | 5.02E-05 | 5.02E-05 | 2.6243 | 2.6243 | 0.8749 | 0 |
| rs6082725 | Genotyped | T | DOMINANT | 5.02E-05 | 5.02E-05 | 2.6243 | 2.6243 | 0.8749 | 0 |
| rs6131206 | Imputed | C | ADDITIVE | 7.67E-05 | 7.67E-05 | 1.3544 | 1.3544 | 0.6023 | 0 |
| rs6131208 | Imputed | T | ADDITIVE | 1.43E-05 | 1.43E-05 | 1.3763 | 1.3763 | 0.9848 | 0 |
| rs6131208 | Imputed | T | GENOTYPIC | 8.33E-06 | 8.33E-06 | 2.0252 | 2.0252 | 0.879 | 0 |
| rs6131208 | Imputed | T | RECESSIVE | 7.25E-05 | 7.25E-05 | 1.7953 | 1.7953 | 0.6033 | 0 |
| rs6134243 | Imputed | C | ADDITIVE | 1.20E-05 | 1.20E-05 | 1.3766 | 1.3766 | 0.9732 | 0 |
| rs6134243 | Imputed | C | GENOTYPIC | 7.24E-06 | 7.24E-06 | 2.0174 | 2.0174 | 0.8918 | 0 |
| rs6134243 | Imputed | C | RECESSIVE | 6.47E-05 | 6.47E-05 | 1.7879 | 1.7879 | 0.5965 | 0 |
| rs6136020 | Imputed | A | DOMINANT | 0.001161 | 0.126 | 0.6966 | 0.7316 | 0.042 | 68.46 |
| rs613799 | Imputed | C | DOMINANT | 7.75E-05 | 7.75E-05 | 1.5158 | 1.5158 | 0.7849 | 0 |
| rs644041 | Imputed | G | ADDITIVE | 8.78E-05 | 8.78E-05 | 1.391 | 1.391 | 0.5335 | 0 |
| rs644041 | Imputed | G | DOMINANT | 7.42E-05 | 7.42E-05 | 1.5143 | 1.5143 | 0.8073 | 0 |
| rs647645 | Imputed | C | ADDITIVE | 6.86E-05 | 0.001002 | 0.7509 | 0.7567 | 0.2638 | 24.95 |
| rs647645 | Imputed | C | GENOTYPIC | 9.70E-05 | 0.006546 | 0.5657 | 0.581 | 0.1711 | 43.36 |
| rs647645 | Imputed | C | RECESSIVE | 0.001082 | 0.1079 | 0.6612 | 0.6805 | 0.034 | 70.43 |
| rs6495554 | Imputed | C | GENOTYPIC | 4.76E-05 | 4.76E-05 | 2.9048 | 2.9048 | 0.6375 | 0 |
| rs6495554 | Imputed | C | RECESSIVE | 7.67E-05 | 7.67E-05 | 2.7833 | 2.7833 | 0.6295 | 0 |
| rs6495555 | Imputed | C | GENOTYPIC | 4.76E-05 | 4.76E-05 | 2.9048 | 2.9048 | 0.6375 | 0 |
| rs6495555 | Imputed | C | RECESSIVE | 7.67E-05 | 7.67E-05 | 2.7833 | 2.7833 | 0.6295 | 0 |
| rs6544728 | Imputed | T | DOMINANT | 1.47E-05 | 1.47E-05 | 1.5526 | 1.5526 | 0.4629 | 0 |
| rs6550705 | Imputed | C | ADDITIVE | 0.00038 | 0.004853 | 1.3004 | 1.2925 | 0.2297 | 32.02 |
| rs6550705 | Imputed | C | GENOTYPIC | 0.0004703 | 0.0268 | 1.7552 | 1.6884 | 0.1275 | 51.46 |
| rs6550707 | Imputed | T | GENOTYPIC | 0.0005925 | 0.02351 | 1.7169 | 1.6622 | 0.1452 | 48.18 |
| rs658108 | Imputed | A | DOMINANT | 9.19E-05 | 9.19E-05 | 1.4801 | 1.4801 | 0.8339 | 0 |
| rs6593441 | Imputed | A | DOMINANT | 8.32E-05 | 8.32E-05 | 1.5966 | 1.5966 | 0.6727 | 0 |
| rs668732 | Imputed | A | DOMINANT | 0.0007713 | 0.04322 | 1.4673 | 1.4272 | 0.1016 | 56.26 |
| rs671041 | Imputed | A | DOMINANT | 7.41E-05 | 7.41E-05 | 1.4878 | 1.4878 | 0.8316 | 0 |
| rs6719700 | Imputed | A | ADDITIVE | 9.48E-05 | 9.48E-05 | 1.4547 | 1.4547 | 0.8457 | 0 |
| rs6719700 | Imputed | A | DOMINANT | 9.05E-05 | 9.05E-05 | 1.5345 | 1.5345 | 0.997 | 0 |
| rs6722640 | Imputed | T | DOMINANT | 6.69E-06 | 6.69E-06 | 0.6251 | 0.6251 | 0.6987 | 0 |
| rs6743092 | Imputed | T | ADDITIVE | 8.16E-05 | 8.16E-05 | 1.3286 | 1.3286 | 0.8471 | 0 |
| rs6743092 | Imputed | T | GENOTYPIC | 7.98E-05 | 7.98E-05 | 1.7638 | 1.7638 | 0.836 | 0 |
| rs6743092 | Imputed | T | RECESSIVE | 2.27E-05 | 2.27E-05 | 1.6478 | 1.6478 | 0.7669 | 0 |
| rs6744759 | Imputed | G | RECESSIVE | 8.79E-05 | 8.79E-05 | 1.9877 | 1.9877 | 0.536 | 0 |
| rs6746170 | Imputed | A | DOMINANT | 2.07E-05 | 2.07E-05 | 1.5394 | 1.5394 | 0.5817 | 0 |
| rs6759922 | Imputed | A | DOMINANT | 0.001026 | 0.0855 | 0.6912 | 0.7071 | 0.0483 | 66.99 |
| rs6769864 | Imputed | T | GENOTYPIC | 0.0004564 | 0.02145 | 1.7578 | 1.6967 | 0.1428 | 48.63 |
| rs6773932 | Imputed | C | GENOTYPIC | 0.000867 | 0.04735 | 1.6964 | 1.6233 | 0.1035 | 55.91 |
| rs6774353 | Imputed | A | GENOTYPIC | 0.0005033 | 0.02669 | 1.7503 | 1.6851 | 0.1298 | 51.02 |
| rs6781670 | Imputed | C | GENOTYPIC | 0.00058 | 0.0204 | 1.7388 | 1.6882 | 0.1518 | 46.96 |
| rs6786431 | Imputed | A | GENOTYPIC | 0.000867 | 0.04735 | 1.6964 | 1.6233 | 0.1035 | 55.91 |
| rs6789091 | Imputed | T | GENOTYPIC | 0.000867 | 0.04735 | 1.6964 | 1.6233 | 0.1035 | 55.91 |
| rs6791296 | Imputed | T | ADDITIVE | 7.12E-05 | 7.12E-05 | 0.6329 | 0.6329 | 0.9898 | 0 |
| rs6792662 | Imputed | G | DOMINANT | 6.98E-05 | 6.98E-05 | 1.6112 | 1.6112 | 0.5862 | 0 |
| rs6797574 | Imputed | G | GENOTYPIC | 0.000867 | 0.04735 | 1.6964 | 1.6233 | 0.1035 | 55.91 |
| rs6797882 | Imputed | G | GENOTYPIC | 0.0008269 | 0.04785 | 1.7009 | 1.6266 | 0.1009 | 56.4 |
| rs6805139 | Imputed | G | DOMINANT | 3.85E-05 | 3.85E-05 | 1.6152 | 1.6152 | 0.6499 | 0 |
| rs6806043 | Imputed | C | ADDITIVE | 0.0003052 | 0.005086 | 1.306 | 1.2979 | 0.2161 | 34.72 |
| rs6806043 | Imputed | C | GENOTYPIC | 0.0004109 | 0.02711 | 1.7655 | 1.6976 | 0.1213 | 52.6 |
| rs6850716 | Imputed | C | GENOTYPIC | 0.003416 | 0.1872 | 2.0499 | 1.9631 | 0.0177 | 75.23 |
| rs6867153 | Imputed | A | RECESSIVE | 0.00187 | 0.191 | 0.678 | 0.7117 | 0.0177 | 75.21 |
| rs687047 | Imputed | C | ADDITIVE | 9.00E-05 | 9.00E-05 | 0.6446 | 0.6446 | 0.7637 | 0 |
| rs6871041 | Imputed | G | DOMINANT | 2.29E-05 | 2.29E-05 | 0.6393 | 0.6393 | 0.8477 | 0 |
| rs6883558 | Imputed | A | ADDITIVE | 7.44E-05 | 7.44E-05 | 0.6401 | 0.6401 | 0.8637 | 0 |
| rs6888012 | Imputed | A | RECESSIVE | 0.001885 | 0.1924 | 0.6781 | 0.7121 | 0.0175 | 75.29 |
| rs6908481 | Imputed | C | RECESSIVE | 5.99E-05 | 5.99E-05 | 1.7201 | 1.7201 | 0.5809 | 0 |
| rs7032231 | Imputed | A | ADDITIVE | 6.99E-05 | 6.99E-05 | 1.352 | 1.352 | 0.3922 | 0 |
| rs7067638 | Imputed | T | DOMINANT | 8.99E-05 | 8.99E-05 | 1.5963 | 1.5963 | 0.7456 | 0 |
| rs7077799 | Imputed | A | DOMINANT | 7.58E-05 | 7.58E-05 | 1.4996 | 1.4996 | 0.7406 | 0 |
| rs7082163 | Imputed | A | ADDITIVE | 5.34E-05 | 5.34E-05 | 1.5444 | 1.5444 | 0.4266 | 0 |
| rs7082163 | Imputed | A | DOMINANT | 3.46E-05 | 3.46E-05 | 1.641 | 1.641 | 0.6461 | 0 |
| rs7089661 | Imputed | C | DOMINANT | 4.97E-05 | 4.97E-05 | 1.5023 | 1.5023 | 0.7397 | 0 |
| rs7101319 | Imputed | C | ADDITIVE | 5.28E-05 | 5.28E-05 | 1.5457 | 1.5457 | 0.468 | 0 |
| rs7101319 | Imputed | C | DOMINANT | 3.22E-05 | 3.22E-05 | 1.6456 | 1.6456 | 0.7067 | 0 |
| rs710832 | Genotyped | A | GENOTYPIC | 6.03E-05 | 6.03E-05 | 0.3754 | 0.3754 | 0.8143 | 0 |

TABLE 18-continued

| SNP rs # | SOURCE | ALLELE (A1) | MODEL | P | P(R) | OR | OR(R) | Q | I |
|---|---|---|---|---|---|---|---|---|---|
| rs710832 | Genotyped | A | RECESSIVE | 3.36E-05 | 3.36E-05 | 0.3689 | 0.3689 | 0.7382 | 0 |
| rs7134262 | Imputed | T | GENOTYPIC | 2.96E-05 | 2.96E-05 | 1.9763 | 1.9763 | 0.627 | 0 |
| rs7134262 | Imputed | T | RECESSIVE | 1.46E-06 | 1.46E-06 | 2.0802 | 2.0802 | 0.5227 | 0 |
| rs7134671 | Imputed | T | GENOTYPIC | 0.0002855 | 0.005252 | 1.7315 | 1.725 | 0.1999 | 37.89 |
| rs7138300 | Imputed | C | ADDITIVE | 2.15E-05 | 2.15E-05 | 0.7321 | 0.7321 | 0.9128 | 0 |
| rs7138300 | Imputed | C | DOMINANT | 6.73E-05 | 6.73E-05 | 0.6474 | 0.6474 | 0.8659 | 0 |
| rs7138300 | Imputed | C | GENOTYPIC | 6.26E-05 | 6.26E-05 | 0.5503 | 0.5503 | 0.7315 | 0 |
| rs7163931 | Imputed | G | GENOTYPIC | 4.76E-05 | 4.76E-05 | 2.9048 | 2.9048 | 0.6375 | 0 |
| rs7163931 | Imputed | G | RECESSIVE | 7.67E-05 | 7.67E-05 | 2.7833 | 2.7833 | 0.6295 | 0 |
| rs7171486 | Genotyped | G | DOMINANT | 7.21E-05 | 7.21E-05 | 0.6684 | 0.6684 | 0.4022 | 0 |
| rs7172611 | Imputed | G | GENOTYPIC | 4.65E-05 | 4.65E-05 | 2.9093 | 2.9093 | 0.6341 | 0 |
| rs7172611 | Imputed | G | RECESSIVE | 7.67E-05 | 7.67E-05 | 2.7833 | 2.7833 | 0.6295 | 0 |
| rs7172689 | Imputed | T | GENOTYPIC | 4.65E-05 | 4.65E-05 | 2.9093 | 2.9093 | 0.6341 | 0 |
| rs7172689 | Imputed | T | RECESSIVE | 7.67E-05 | 7.67E-05 | 2.7833 | 2.7833 | 0.6295 | 0 |
| rs7175701 | Imputed | C | GENOTYPIC | 9.05E-05 | 9.05E-05 | 2.5914 | 2.5914 | 0.7706 | 0 |
| rs7180245 | Imputed | A | GENOTYPIC | 4.65E-05 | 4.65E-05 | 2.9093 | 2.9093 | 0.6341 | 0 |
| rs7180245 | Imputed | A | RECESSIVE | 7.67E-05 | 7.67E-05 | 2.7833 | 2.7833 | 0.6295 | 0 |
| rs7220603 | Genotyped | A | ADDITIVE | 0.02391 | 0.5255 | 0.8346 | 0.8604 | 0.0003 | 87.88 |
| rs7282518 | Imputed | T | ADDITIVE | 0.0002567 | 0.008981 | 1.453 | 1.4275 | 0.1773 | 42.19 |
| rs7283476 | Imputed | T | ADDITIVE | 7.31E-05 | 7.31E-05 | 0.4402 | 0.4402 | 0.566 | 0 |
| rs7283476 | Imputed | T | DOMINANT | 3.52E-05 | 3.52E-05 | 0.4064 | 0.4064 | 0.4235 | 0 |
| rs7295817 | Imputed | C | GENOTYPIC | 7.67E-05 | 7.67E-05 | 0.5483 | 0.5483 | 0.4481 | 0 |
| rs7298255 | Imputed | A | ADDITIVE | 3.91E-05 | 3.91E-05 | 0.7439 | 0.7439 | 0.9855 | 0 |
| rs7298255 | Imputed | A | DOMINANT | 6.89E-05 | 6.89E-05 | 0.65 | 0.65 | 0.7442 | 0 |
| rs7305832 | Imputed | C | GENOTYPIC | 2.48E-05 | 2.48E-05 | 1.9853 | 1.9853 | 0.5975 | 0 |
| rs7305832 | Imputed | C | RECESSIVE | 1.31E-06 | 1.31E-06 | 2.0856 | 2.0856 | 0.5058 | 0 |
| rs7331467 | Imputed | A | GENOTYPIC | 0.004523 | 0.2685 | 1.5788 | 1.4648 | 0.0124 | 77.22 |
| rs7392620 | Imputed | C | ADDITIVE | 8.20E-05 | 8.20E-05 | 0.7361 | 0.7361 | 0.6441 | 0 |
| rs742827 | Imputed | A | ADDITIVE | 8.46E-06 | 8.46E-06 | 1.3961 | 1.3961 | 0.9898 | 0 |
| rs742827 | Imputed | A | GENOTYPIC | 7.47E-06 | 7.47E-06 | 2.0465 | 2.0465 | 0.8196 | 0 |
| rs742827 | Imputed | A | RECESSIVE | 9.50E-05 | 9.50E-05 | 1.7817 | 1.7817 | 0.5729 | 0 |
| rs7446891 | Imputed | G | DOMINANT | 2.31E-05 | 2.31E-05 | 0.6505 | 0.6505 | 0.8585 | 0 |
| rs7448641 | Imputed | C | ADDITIVE | 0.002876 | 0.1046 | 0.5269 | 0.4225 | 0.0055 | 80.81 |
| rs7448641 | Imputed | C | DOMINANT | 0.005931 | 0.1502 | 0.5204 | 0.4449 | 0.0058 | 80.6 |
| rs7484728 | Imputed | T | GENOTYPIC | 0.000266 | 0.005086 | 1.736 | 1.7289 | 0.1995 | 37.97 |
| rs7499402 | Genotyped | A | ADDITIVE | 7.41E-05 | 7.41E-05 | 1.7018 | 1.7018 | 0.5603 | 0 |
| rs7529851 | Imputed | A | ADDITIVE | 7.64E-05 | 7.64E-05 | 0.7438 | 0.7438 | 0.6011 | 0 |
| rs7529851 | Imputed | A | GENOTYPIC | 8.65E-05 | 8.65E-05 | 0.5413 | 0.5413 | 0.7417 | 0 |
| rs7573951 | Imputed | G | ADDITIVE | 0.0009373 | 0.04269 | 0.7841 | 0.7912 | 0.0927 | 57.96 |
| rs7599198 | Imputed | T | DOMINANT | 0.0005956 | 0.01854 | 0.6706 | 0.6818 | 0.1584 | 45.74 |
| rs7600050 | Imputed | C | ADDITIVE | 6.57E-05 | 6.57E-05 | 1.3535 | 1.3535 | 0.6858 | 0 |
| rs7607712 | Imputed | T | ADDITIVE | 6.22E-05 | 6.22E-05 | 1.4258 | 1.4258 | 0.846 | 0 |
| rs7607712 | Imputed | T | DOMINANT | 8.77E-05 | 8.77E-05 | 1.4994 | 1.4994 | 0.9843 | 0 |
| rs7613492 | Imputed | G | GENOTYPIC | 0.0004892 | 0.02726 | 1.756 | 1.6897 | 0.1265 | 51.64 |
| rs7621663 | Imputed | G | ADDITIVE | 0.0002694 | 0.00593 | 1.3166 | 1.3062 | 0.1995 | 37.97 |
| rs7621663 | Imputed | G | GENOTYPIC | 0.0002328 | 0.03627 | 1.849 | 1.7635 | 0.0774 | 60.91 |
| rs7621663 | Imputed | G | RECESSIVE | 0.001212 | 0.0888 | 1.6632 | 1.577 | 0.0599 | 64.48 |
| rs7626584 | Imputed | G | ADDITIVE | 9.18E-05 | 9.18E-05 | 0.5375 | 0.5375 | 0.6785 | 0 |
| rs7684899 | Imputed | C | ADDITIVE | 9.76E-05 | 9.76E-05 | 0.6985 | 0.6985 | 0.7616 | 0 |
| rs7684899 | Imputed | C | DOMINANT | 6.37E-06 | 6.37E-06 | 0.6204 | 0.6204 | 0.6462 | 0 |
| rs7701604 | Imputed | G | ADDITIVE | 0.002876 | 0.1046 | 0.5269 | 0.4225 | 0.0055 | 80.81 |
| rs7701604 | Imputed | G | DOMINANT | 0.005931 | 0.1502 | 0.5204 | 0.4449 | 0.0058 | 80.6 |
| rs7703676 | Imputed | C | ADDITIVE | 0.002876 | 0.1046 | 0.5269 | 0.4225 | 0.0055 | 80.81 |
| rs7703676 | Imputed | C | DOMINANT | 0.005931 | 0.1502 | 0.5204 | 0.4449 | 0.0058 | 80.6 |
| rs7708491 | Imputed | C | RECESSIVE | 0.002355 | 0.1727 | 0.6852 | 0.7155 | 0.0267 | 72.41 |
| rs7711358 | Imputed | A | DOMINANT | 1.88E-05 | 1.88E-05 | 0.6481 | 0.6481 | 0.8316 | 0 |
| rs7719448 | Imputed | G | RECESSIVE | 0.002108 | 0.2193 | 0.6815 | 0.7163 | 0.012 | 77.4 |
| rs7724761 | Imputed | T | RECESSIVE | 0.001686 | 0.19 | 0.6737 | 0.7045 | 0.0154 | 76.06 |
| rs7742476 | Imputed | T | DOMINANT | 0.0001163 | 0.0001163 | 1.5074 | 1.5074 | 0.3696 | 0 |
| rs7762993 | Imputed | A | ADDITIVE | 0.0003347 | 0.004615 | 1.3933 | 1.3716 | 0.2531 | 27.21 |
| rs7762993 | Imputed | A | DOMINANT | 9.42E-05 | 0.01287 | 1.507 | 1.4653 | 0.1301 | 50.97 |
| rs7767265 | Imputed | G | ADDITIVE | 1.59E-05 | 0.000172 | 1.4422 | 1.4296 | 0.296 | 17.87 |
| rs7767265 | Imputed | G | DOMINANT | 6.30E-06 | 0.003597 | 1.5886 | 1.5475 | 0.1294 | 51.09 |
| rs7768128 | Imputed | G | RECESSIVE | 9.37E-05 | 9.37E-05 | 0.3867 | 0.3867 | 0.8076 | 0 |
| rs7771264 | Imputed | T | DOMINANT | 0.00106 | 0.07475 | 0.7141 | 0.7193 | 0.046 | 67.53 |
| rs7773151 | Genotyped | C | DOMINANT | 0.000959 | 0.06482 | 0.7135 | 0.7189 | 0.055 | 65.52 |
| rs7773210 | Genotyped | A | DOMINANT | 0.0008239 | 0.06306 | 0.7105 | 0.7165 | 0.0539 | 65.76 |
| rs7808536 | Imputed | G | DOMINANT | 8.84E-05 | 8.84E-05 | 1.5126 | 1.5126 | 0.3832 | 0 |
| rs7843510 | Genotyped | G | DOMINANT | 0.0008947 | 0.03339 | 1.418 | 1.392 | 0.1219 | 52.48 |
| rs7894867 | Imputed | T | DOMINANT | 7.78E-05 | 7.78E-05 | 1.6032 | 1.6032 | 0.7494 | 0 |
| rs7921834 | Imputed | C | DOMINANT | 5.41E-05 | 5.41E-05 | 1.4996 | 1.4996 | 0.7497 | 0 |
| rs7939893 | Imputed | C | ADDITIVE | 8.65E-05 | 8.65E-05 | 0.7474 | 0.7474 | 0.6566 | 0 |
| rs7939893 | Imputed | C | DOMINANT | 9.08E-06 | 9.08E-06 | 0.6395 | 0.6395 | 0.3716 | 0 |
| rs7944513 | Imputed | T | GENOTYPIC | 1.13E-05 | 1.13E-05 | 2.6894 | 2.6894 | 0.5228 | 0 |
| rs7944513 | Imputed | T | RECESSIVE | 3.32E-05 | 3.32E-05 | 2.5007 | 2.5007 | 0.3973 | 0 |
| rs7949720 | Imputed | G | ADDITIVE | 0.01083 | 0.46 | 0.7505 | 0.8044 | 0.0015 | 84.54 |
| rs7949720 | Imputed | G | DOMINANT | 0.009467 | 0.4625 | 0.7247 | 0.7836 | 0.0012 | 85.09 |
| rs7955901 | Imputed | C | ADDITIVE | 3.31E-05 | 3.31E-05 | 0.7403 | 0.7403 | 0.9802 | 0 |

TABLE 18-continued

| SNP rs # | SOURCE | ALLELE (A1) | MODEL | P | P(R) | OR | OR(R) | Q | I |
|---|---|---|---|---|---|---|---|---|---|
| rs7955901 | Imputed | C | DOMINANT | 6.34E-05 | 6.34E-05 | 0.6473 | 0.6473 | 0.8105 | 0 |
| rs7956274 | Imputed | T | ADDITIVE | 2.32E-05 | 2.32E-05 | 0.7349 | 0.7349 | 0.9325 | 0 |
| rs7956274 | Imputed | T | DOMINANT | 3.52E-05 | 3.52E-05 | 0.6366 | 0.6366 | 0.8605 | 0 |
| rs7956274 | Imputed | T | GENOTYPIC | 7.30E-05 | 7.30E-05 | 0.5575 | 0.5575 | 0.7749 | 0 |
| rs7957932 | Imputed | G | ADDITIVE | 5.54E-05 | 5.54E-05 | 0.7481 | 0.7481 | 0.9512 | 0 |
| rs7957932 | Imputed | G | DOMINANT | 3.06E-05 | 3.06E-05 | 0.6329 | 0.6329 | 0.8798 | 0 |
| rs7984504 | Imputed | C | GENOTYPIC | 0.002726 | 0.1381 | 1.6689 | 1.6043 | 0.0349 | 70.18 |
| rs7999518 | Imputed | A | RECESSIVE | 2.72E-05 | 2.72E-05 | 0.5848 | 0.5848 | 0.4425 | 0 |
| rs8026245 | Imputed | G | GENOTYPIC | 7.79E-05 | 7.79E-05 | 2.665 | 2.665 | 0.6771 | 0 |
| rs8026245 | Imputed | G | RECESSIVE | 8.54E-05 | 8.54E-05 | 2.6107 | 2.6107 | 0.6577 | 0 |
| rs8060725 | Genotyped | A | ADDITIVE | 9.99E-05 | 9.99E-05 | 0.7239 | 0.7239 | 0.8435 | 0 |
| rs8103016 | Genotyped | A | ADDITIVE | 1.98E-05 | 1.98E-05 | 1.4503 | 1.4503 | 0.4547 | 0 |
| rs8103016 | Genotyped | A | DOMINANT | 2.45E-05 | 2.45E-05 | 1.5482 | 1.5482 | 0.694 | 0 |
| rs8104182 | Imputed | G | ADDITIVE | 3.24E-05 | 3.24E-05 | 1.4421 | 1.4421 | 0.671 | 0 |
| rs8104182 | Imputed | G | DOMINANT | 4.77E-05 | 4.77E-05 | 1.5265 | 1.5265 | 0.7687 | 0 |
| rs8129461 | Imputed | G | ADDITIVE | 3.70E-05 | 3.70E-05 | 0.4263 | 0.4263 | 0.5257 | 0 |
| rs8129461 | Imputed | G | DOMINANT | 1.72E-05 | 1.72E-05 | 0.3933 | 0.3933 | 0.3761 | 0 |
| rs8130021 | Imputed | G | ADDITIVE | 7.55E-05 | 7.55E-05 | 0.4409 | 0.4409 | 0.5674 | 0 |
| rs8130021 | Imputed | G | DOMINANT | 3.64E-05 | 3.64E-05 | 0.4071 | 0.4071 | 0.4256 | 0 |
| rs879961 | Imputed | T | ADDITIVE | 0.002059 | 0.2563 | 0.7763 | 0.8081 | 0.0066 | 80.11 |
| rs879961 | Imputed | T | DOMINANT | 0.001811 | 0.2398 | 0.7301 | 0.7595 | 0.0059 | 80.5 |
| rs906353 | Imputed | A | DOMINANT | 0.004624 | 0.2465 | 0.7527 | 0.7852 | 0.0165 | 75.63 |
| rs915491 | Imputed | C | DOMINANT | 8.48E-05 | 8.48E-05 | 1.4838 | 1.4838 | 0.752 | 0 |
| rs915493 | Imputed | T | DOMINANT | 8.48E-05 | 8.48E-05 | 1.4838 | 1.4838 | 0.752 | 0 |
| rs915494 | Imputed | A | ADDITIVE | 7.86E-05 | 7.86E-05 | 1.3658 | 1.3658 | 0.8997 | 0 |
| rs915494 | Imputed | A | DOMINANT | 2.62E-05 | 2.62E-05 | 1.5383 | 1.5383 | 0.8223 | 0 |
| rs917295 | Imputed | G | DOMINANT | 1.82E-05 | 1.82E-05 | 0.647 | 0.647 | 0.881 | 0 |
| rs9284851 | Imputed | A | GENOTYPIC | 0.0007416 | 0.04371 | 1.7018 | 1.6321 | 0.1049 | 55.65 |
| rs9293464 | Imputed | T | RECESSIVE | 0.00171 | 0.194 | 0.6758 | 0.7101 | 0.0158 | 75.88 |
| rs9295154 | Genotyped | G | DOMINANT | 7.58E-05 | 7.58E-05 | 1.5572 | 1.5572 | 0.5416 | 0 |
| rs9310221 | Imputed | A | DOMINANT | 0.001363 | 0.158 | 1.4328 | 1.353 | 0.0322 | 70.9 |
| rs9310699 | Genotyped | T | GENOTYPIC | 0.00058 | 0.0204 | 1.7388 | 1.6882 | 0.1518 | 46.96 |
| rs9310700 | Imputed | C | ADDITIVE | 0.0003931 | 0.005395 | 1.3049 | 1.2966 | 0.2216 | 33.63 |
| rs9310700 | Imputed | C | GENOTYPIC | 0.0003693 | 0.03198 | 1.8013 | 1.7265 | 0.1006 | 56.46 |
| rs9310701 | Imputed | G | GENOTYPIC | 0.0005775 | 0.02214 | 1.7187 | 1.6652 | 0.1488 | 47.51 |
| rs9310704 | Imputed | G | GENOTYPIC | 0.000597 | 0.04612 | 1.7265 | 1.6511 | 0.0921 | 58.07 |
| rs9319185 | Imputed | C | GENOTYPIC | 0.003084 | 0.2063 | 1.6765 | 1.5851 | 0.0147 | 76.3 |
| rs9319186 | Imputed | T | GENOTYPIC | 0.002645 | 0.1394 | 1.6843 | 1.6228 | 0.0311 | 71.19 |
| rs9327555 | Imputed | T | DOMINANT | 2.31E-05 | 2.31E-05 | 0.6505 | 0.6505 | 0.8585 | 0 |
| rs9403367 | Imputed | C | DOMINANT | 0.0008239 | 0.06306 | 0.7105 | 0.7165 | 0.0539 | 65.76 |
| rs9419608 | Imputed | G | RECESSIVE | 0.007479 | 0.5441 | 1.3778 | 1.2224 | 0.0008 | 85.89 |
| rs9426437 | Imputed | T | DOMINANT | 0.0007324 | 0.08646 | 0.6967 | 0.7283 | 0.0587 | 64.74 |
| rs9454967 | Imputed | G | DOMINANT | 0.0008641 | 0.05434 | 1.5996 | 1.5843 | 0.071 | 62.2 |
| rs9635511 | Imputed | T | DOMINANT | 0.0001778 | 0.001844 | 0.6752 | 0.6837 | 0.2682 | 24.02 |
| rs966583 | Imputed | A | ADDITIVE | 1.48E-05 | 1.48E-05 | 0.725 | 0.725 | 0.8807 | 0 |
| rs966583 | Imputed | A | DOMINANT | 7.60E-06 | 7.60E-06 | 0.626 | 0.626 | 0.8999 | 0 |
| rs980263 | Imputed | T | GENOTYPIC | 0.000492 | 0.02264 | 1.7325 | 1.6751 | 0.1412 | 48.92 |
| rs980264 | Imputed | T | GENOTYPIC | 0.000492 | 0.02264 | 1.7325 | 1.6751 | 0.1412 | 48.92 |
| rs9812206 | Imputed | G | ADDITIVE | 9.92E-05 | 0.03775 | 0.6049 | 0.6297 | 0.0642 | 63.57 |
| rs9812206 | Imputed | G | DOMINANT | 0.0001008 | 0.04527 | 0.592 | 0.6174 | 0.049 | 66.85 |
| rs9813552 | Imputed | G | ADDITIVE | 0.0004552 | 0.03885 | 0.6393 | 0.6583 | 0.0966 | 57.21 |
| rs9813552 | Imputed | G | DOMINANT | 0.0005252 | 0.05892 | 0.629 | 0.6531 | 0.0685 | 62.71 |
| rs9815037 | Imputed | T | ADDITIVE | 0.0003061 | 0.04794 | 0.6241 | 0.6399 | 0.0613 | 64.17 |
| rs9815037 | Imputed | T | DOMINANT | 0.0002862 | 0.06392 | 0.6094 | 0.6301 | 0.0425 | 68.34 |
| rs9819583 | Imputed | T | GENOTYPIC | 0.0005347 | 0.02047 | 1.7449 | 1.6926 | 0.1487 | 47.53 |
| rs9825349 | Imputed | A | ADDITIVE | 0.0003046 | 0.04763 | 0.624 | 0.6401 | 0.062 | 64.03 |
| rs9825349 | Imputed | A | DOMINANT | 0.0002859 | 0.0639 | 0.6094 | 0.6304 | 0.0427 | 68.28 |
| rs9833118 | Imputed | G | ADDITIVE | 0.0004117 | 0.006196 | 1.3 | 1.293 | 0.2139 | 35.15 |
| rs9833118 | Imputed | G | GENOTYPIC | 0.0004555 | 0.02726 | 1.7602 | 1.6961 | 0.123 | 52.28 |
| rs9834217 | Imputed | T | ADDITIVE | 0.0002698 | 0.03497 | 0.6218 | 0.6356 | 0.0789 | 60.62 |
| rs9834217 | Imputed | T | DOMINANT | 0.0002509 | 0.0487 | 0.607 | 0.6256 | 0.0556 | 65.39 |
| rs9838563 | Imputed | C | GENOTYPIC | 0.0004051 | 0.008482 | 1.7473 | 1.7073 | 0.2054 | 36.83 |
| rs9840460 | Imputed | T | ADDITIVE | 0.0002575 | 0.03523 | 0.6208 | 0.6345 | 0.0768 | 61.03 |
| rs9840460 | Imputed | T | DOMINANT | 0.0002389 | 0.04871 | 0.6059 | 0.6244 | 0.0543 | 65.67 |
| rs9840756 | Imputed | A | ADDITIVE | 0.0002251 | 0.02861 | 0.618 | 0.6307 | 0.0873 | 58.99 |
| rs9840756 | Imputed | A | DOMINANT | 0.0002087 | 0.04085 | 0.603 | 0.6206 | 0.0622 | 63.99 |
| rs9847999 | Imputed | C | GENOTYPIC | 0.0009186 | 0.04314 | 1.6854 | 1.6208 | 0.1128 | 54.17 |
| rs9864769 | Imputed | C | GENOTYPIC | 0.0005775 | 0.02214 | 1.7187 | 1.6652 | 0.1488 | 47.51 |
| rs9866421 | Genotyped | C | RECESSIVE | 8.99E-05 | 8.99E-05 | 0.5978 | 0.5978 | 0.7628 | 0 |
| rs987296 | Imputed | T | GENOTYPIC | 0.0006125 | 0.02328 | 1.7346 | 1.6817 | 0.1438 | 48.43 |
| rs9881685 | Imputed | A | ADDITIVE | 9.85E-05 | 0.03734 | 0.6048 | 0.6295 | 0.0647 | 63.48 |
| rs9881685 | Imputed | A | DOMINANT | 0.0001 | 0.04485 | 0.5918 | 0.6172 | 0.0494 | 66.76 |
| rs992695 | Imputed | C | ADDITIVE | 0.002041 | 0.2367 | 0.7764 | 0.8067 | 0.0089 | 78.81 |
| rs992695 | Imputed | C | DOMINANT | 0.001822 | 0.2163 | 0.7308 | 0.7583 | 0.009 | 78.78 |
| rs9936999 | Imputed | G | DOMINANT | 0.004771 | 0.2439 | 1.4561 | 1.3895 | 0.0142 | 76.48 |

TABLE 19

| SNP | allele A1 (non-ref) | allele A2 (ref) | P.R. | OR.R. | CARE | | | | | |
|---|---|---|---|---|---|---|---|---|---|---|
| | | | | | Prava Count | Placebo count | OR | OR L95 | OR U95 | P value |
| rs11556924 | A | G | 0.00196 | 1.33 | 42/141/117 | 43/157/182 | 1.26 | 1.01 | 1.58 | 0.0449 |

| | SNP | WOSCOPS | | | | | | | |
|---|---|---|---|---|---|---|---|---|---|
| | | Prava Count | Placebo Count | OR | OR L95 | OR U95 | P value | Endpoint | Model |
| | rs11556924 | 28/79/52 | 22/104/98 | 1.48 | 1.09 | 2.02 | 0.0123 | CHD | add |

TABLE 20

| SNP hCV # | SNP rs # | Chrom | mAF CEU | MODE | GENO_RESP | STATIN | EVENTS_RESP | TOTAL_RESP | HR_RESP | L95_RESP | U95_RESP | P_RESP | P_INT_RESP | GENO_PLACEBO | EVENTS_PLACEBO | TOTAL_PLACEBO | HR_PLACEBO |
|---|---|---|---|---|---|---|---|---|---|---|---|---|---|---|---|---|---|
| hCV11841860 | rs10757278 | 9p21 | 0.5 | GEN | GG | Pravastatin | 24 | 410 | 1.08 | 0.602 | 1.94 | 0.7931 | 0.1691 | GG | 21 | 390 | 1.06 |
| hCV11841860 | rs10757278 | 9p21 | 0.5 | GEN | GG | Placebo | 21 | 390 | ref | | | | 0.1691 | | | | |
| hCV11841860 | rs10757278 | 9p21 | 0.5 | GEN | GA | Pravastatin | 27 | 653 | 0.54 | 0.34 | 0.86 | 0.0096 | 0.1691 | GA | 52 | 689 | 1.47 |
| hCV11841860 | rs10757278 | 9p21 | 0.5 | GEN | GA | Placebo | 52 | 689 | ref | | | | 0.1691 | | | | ref |
| hCV11841860 | rs10757278 | 9p21 | 0.5 | GEN | AA | Pravastatin | 15 | 334 | 0.9 | 0.438 | 1.84 | 0.7666 | 0.1691 | AA | 15 | 289 | 1.32 |
| hCV11841860 | rs10757278 | 9p21 | 0.5 | GEN | AA | Placebo | 15 | 289 | ref | | | | 0.1691 | | | | |
| hCV11841860 | rs10757278 | 9p21 | 0.5 | DOM | GA + GG | Pravastatin | 51 | 1063 | 0.7 | 0.491 | 1.01 | 0.0533 | 0.6037 | GA + GG | 73 | 1079 | |
| hCV11841860 | rs10757278 | 9p21 | 0.5 | DOM | GA + GG | Placebo | 73 | 1079 | ref | | | | 0.6037 | | | | |
| hCV11841860 | rs10757278 | 9p21 | 0.5 | REC | GA + AA | Pravastatin | 42 | 987 | 0.62 | 0.42 | 0.91 | 0.0146 | 0.118 | GG | 21 | 390 | 0.8 |
| hCV11841860 | rs10757278 | 9p21 | 0.5 | REC | GA + AA | Placebo | 67 | 978 | ref | | | | 0.118 | | | | |
| hCV1754666 | rs1333049 | 9p21 | 0.492 | GEN | GG | Pravastatin | 16 | 335 | 0.96 | 0.474 | 1.94 | 0.9086 | 0.1288 | GG | 15 | 291 | 0.95 |
| hCV1754666 | rs1333049 | 9p21 | 0.492 | GEN | GG | Placebo | 15 | 291 | ref | | | | 0.1288 | | | | |
| hCV1754666 | rs1333049 | 9p21 | 0.492 | GEN | GC | Pravastatin | 27 | 659 | 0.54 | 0.336 | 0.85 | 0.0085 | 0.1288 | GC | 52 | 689 | 1.4 |
| hCV1754666 | rs1333049 | 9p21 | 0.492 | GEN | GC | Placebo | 52 | 689 | ref | | | | 0.1288 | | | | |
| hCV1754666 | rs1333049 | 9p21 | 0.492 | GEN | CC | Pravastatin | 24 | 405 | 1.11 | 0.616 | 1.99 | 0.7346 | 0.1288 | CC | 21 | 393 | ref |
| hCV1754666 | rs1333049 | 9p21 | 0.492 | GEN | CC | Placebo | 21 | 393 | ref | | | | 0.1288 | | | | |
| hCV1754666 | rs1333049 | 9p21 | 0.492 | DOM | GC + GG | Pravastatin | 43 | 994 | 0.63 | 0.429 | 0.92 | 0.018 | 0.1139 | GC + GG | 67 | 980 | 1.26 |
| hCV1754666 | rs1333049 | 9p21 | 0.492 | DOM | GC + GG | Placebo | 67 | 980 | ref | | | | 0.1139 | | | | |
| hCV1754666 | rs1333049 | 9p21 | 0.492 | REC | GC + CC | Pravastatin | 51 | 1064 | 0.7 | 0.493 | 1.01 | 0.0549 | 0.4877 | GG | 15 | 291 | 0.75 |
| hCV1754666 | rs1333049 | 9p21 | 0.492 | REC | GC + CC | Placebo | 73 | 1082 | ref | | | | 0.4877 | | | | |
| hCV12094896 | rs12425791 | 12p13 | 0.175 | GEN | AA | Pravastatin | 2 | 60 | 0.28 | 0.058 | 1.35 | 0.1119 | 0.1255 | AA | 7 | 60 | 2.18 |
| hCV12094896 | rs12425791 | 12p13 | 0.175 | GEN | AA | Placebo | 7 | 60 | ref | | | | 0.1255 | | | | |
| hCV12094896 | rs12425791 | 12p13 | 0.175 | GEN | AG | Pravastatin | 22 | 485 | 0.56 | 0.331 | 0.96 | 0.0353 | 0.1255 | AG | 35 | 442 | 1.51 |
| hCV12094896 | rs12425791 | 12p13 | 0.175 | GEN | AG | Placebo | 35 | 442 | ref | | | | 0.1255 | | | | |
| hCV12094896 | rs12425791 | 12p13 | 0.175 | GEN | GG | Pravastatin | 43 | 852 | 0.95 | 0.628 | 1.44 | 0.8138 | 0.1255 | GG | 46 | 867 | ref |
| hCV12094896 | rs12425791 | 12p13 | 0.175 | GEN | GG | Placebo | 46 | 867 | ref | | | | 0.1255 | | | | |
| hCV12094896 | rs12425791 | 12p13 | 0.175 | DOM | AG + AA | Pravastatin | 24 | 545 | 0.52 | 0.314 | 0.86 | 0.0101 | 0.0653 | AG + AA | 42 | 502 | 1.59 |
| hCV12094896 | rs12425791 | 12p13 | 0.175 | DOM | AG + AA | Placebo | 42 | 502 | ref | | | | 0.0653 | | | | |
| hCV12094896 | rs12425791 | 12p13 | 0.175 | REC | AG + GG | Pravastatin | 65 | 1337 | 0.78 | 0.565 | 1.09 | 0.1411 | 0.1736 | AA | 7 | 60 | 1.86 |
| hCV12094896 | rs12425791 | 12p13 | 0.175 | REC | AG + GG | Placebo | 81 | 1309 | 0.26 | 0.072 | 0.95 | 0.0417 | 0.1736 | | | | |
| hCV1665834 | rs11833579 | 12p13 | 0.225 | GEN | AA | Pravastatin | 3 | 99 | 0.26 | 0.072 | 0.95 | 0.0417 | 0.1885 | AA | 10 | 91 | 2 |
| hCV1665834 | rs11833579 | 12p13 | 0.225 | GEN | AA | Placebo | 10 | 91 | ref | | | | 0.1885 | | | | |
| hCV1665834 | rs11833579 | 12p13 | 0.225 | GEN | AG | Pravastatin | 29 | 566 | 0.75 | 0.46 | 1.22 | 0.2425 | 0.1885 | AG | 37 | 541 | 1.24 |
| hCV1665834 | rs11833579 | 12p13 | 0.225 | GEN | AG | Placebo | 37 | 541 | ref | | | | 0.1885 | | | | |
| hCV1665834 | rs11833579 | 12p13 | 0.225 | GEN | GG | Pravastatin | 35 | 730 | 0.86 | 0.55 | 1.36 | 0.5258 | 0.1885 | GG | 41 | 739 | ref |
| hCV1665834 | rs11833579 | 12p13 | 0.225 | GEN | GG | Placebo | 41 | 739 | ref | | | | 0.1885 | | | | |
| hCV1665834 | rs11833579 | 12p13 | 0.225 | DOM | AG + AA | Pravastatin | 32 | 665 | 0.64 | 0.409 | 1 | 0.0523 | 0.3522 | AG + AA | 47 | 632 | 1.35 |
| hCV1665834 | rs11833579 | 12p13 | 0.225 | DOM | AG + AA | Placebo | 47 | 632 | ref | | | | 0.3522 | | | | |
| hCV1665834 | rs11833579 | 12p13 | 0.225 | REC | AG + GG | Pravastatin | 64 | 1296 | 0.81 | 0.581 | 1.13 | 0.2091 | 0.0756 | AA | 10 | 91 | 1.81 |
| hCV1665834 | rs11833579 | 12p13 | 0.225 | REC | AG + GG | Placebo | 78 | 1280 | ref | | | | 0.0756 | | | | |

TABLE 20-continued

| SNP hCV # | SNP rs # | L95_PLACEBO | U95_PLACEBO | P_PLACEBO | P_DF2_PLACEBO | GENO_ALL | EVENTS_ALL | TOTAL_ALL | HR_ALL | L95_ALL | U95_ALL | P_ALL | P_DF2_ALL |
|---|---|---|---|---|---|---|---|---|---|---|---|---|---|
| hCV11841860 | rs10757278 | 0.545 | 2.052 | 0.8676 | 0.2663 | GG | 45 | 800 | 1.18 | 0.744 | 1.876 | 0.479 | 0.639 |
| hCV11841860 | rs10757278 | 0.826 | 2.607 | 0.1905 | 0.2663 | GA | 79 | 1342 | 1.22 | 0.803 | 1.862 | 0.3478 | 0.639 |
| hCV11841860 | rs10757278 | . | . | . | . | AA | 30 | 623 | ref | . | . | . | 0.639 |
| hCV11841860 | rs10757278 | 0.758 | 2.302 | 0.3269 | . | GA + GG | 124 | 2142 | 1.21 | 0.81 | 1.8 | 0.3537 | . |
| hCV11841860 | rs10757278 | 0.488 | 1.3 | 0.3624 | . | GG | 45 | 800 | 1.03 | 0.725 | 1.451 | 0.8868 | . |
| hCV1754666 | rs1333049 | 0.488 | 1.836 | 0.8702 | 0.2539 | GG | 31 | 626 | 0.87 | 0.549 | 1.371 | 0.5427 | 0.727 |
| hCV1754666 | rs1333049 | 0.842 | 2.319 | 0.1961 | 0.2539 | GC | 79 | 1348 | 1.03 | 0.711 | 1.478 | 0.8939 | 0.727 |
| hCV1754666 | rs1333049 | . | . | . | 0.2539 | CC | 45 | 798 | ref | . | . | . | 0.727 |
| hCV1754666 | rs1333049 | 0.773 | 2.061 | 0.3517 | . | GC + GG | 110 | 1974 | 0.98 | 0.689 | 1.379 | 0.8869 | . |
| hCV1754666 | rs1333049 | 0.433 | 1.316 | 0.3212 | . | GG | 31 | 626 | 0.85 | 0.576 | 1.266 | 0.4317 | . |
| hCV12094896 | rs12425791 | 0.984 | 4.831 | 0.0547 | 0.0584 | AA | 9 | 120 | 1.42 | 0.715 | 2.817 | 0.317 | 0.421 |
| hCV12094896 | rs12425791 | 0.971 | 2.339 | 0.0674 | 0.0584 | AG | 57 | 927 | 1.19 | 0.854 | 1.66 | 0.3045 | 0.421 |
| hCV12094896 | rs12425791 | . | . | . | 0.0584 | GG | 89 | 1719 | ref | . | . | . | 0.421 |
| hCV12094896 | rs12425791 | 1.046 | 2.414 | 0.0301 | . | AG + AA | 66 | 1047 | 1.22 | 0.885 | 1.673 | 0.2267 | . |
| hCV12094896 | rs12425791 | 0.861 | 4.034 | 0.1142 | . | AA | 9 | 120 | 1.33 | 0.679 | 2.609 | 0.4055 | . |
| hCV1665834 | rs11833579 | 1 | 3.985 | 0.05 | 0.1371 | AA | 13 | 190 | 1.3 | 0.721 | 2.339 | 0.3837 | 0.555 |
| hCV1665834 | rs11833579 | 0.795 | 1.933 | 0.344 | 0.1371 | AG | 66 | 1107 | 1.15 | 0.83 | 1.605 | 0.3942 | 0.555 |
| hCV1665834 | rs11833579 | . | . | . | 0.1371 | GG | 76 | 1469 | ref | . | . | . | 0.555 |
| hCV1665834 | rs11833579 | 0.887 | 2.049 | 0.1622 | . | AG + AA | 79 | 1297 | 1.18 | 0.858 | 1.612 | 0.3124 | . |
| hCV1665834 | rs11833579 | 0.939 | 3.503 | 0.0764 | . | AA | 13 | 190 | 1.22 | 0.69 | 2.15 | 0.4957 | . |

TABLE 21

| SNP hCV # | SNP rs # | MODE | GENO_RESP | STATIN | EVENTS_RESP | TOTAL_RESP | HR_RESP | L95_RESP | U95_RESP | P_RESP | P_INT_RESP | GENO_PLACEBO |
|---|---|---|---|---|---|---|---|---|---|---|---|---|
| hCV2652047 | rs873134 | GEN | CC | Pravastatin | 27 | 354 | 2.01 | 1.036 | 3.89 | 0.0391 | 0.00164 | CC |
| hCV2652047 | rs873134 | GEN | CC | Placebo | 13 | 338 | ref | . | . | . | 0.00164 | |
| hCV2652047 | rs873134 | GEN | CT | Pravastatin | 24 | 680 | 0.5 | 0.308 | 0.818 | 0.0057 | 0.00164 | CT |
| hCV2652047 | rs873134 | GEN | CT | Placebo | 49 | 697 | ref | . | . | . | 0.00164 | |
| hCV2652047 | rs873134 | GEN | TT | Pravastatin | 16 | 366 | 0.54 | 0.291 | 1.01 | 0.0538 | 0.00164 | TT |
| hCV2652047 | rs873134 | GEN | TT | Placebo | 26 | 336 | ref | . | . | . | 0.00164 | |
| hCV2652047 | rs873134 | DOM | CT + CC | Pravastatin | 51 | 1034 | 0.83 | 0.571 | 1.199 | 0.3163 | 0.25372 | CT + CC |
| hCV2652047 | rs873134 | DOM | CT + CC | Placebo | 62 | 1035 | ref | . | . | . | 0.25372 | |
| hCV2652047 | rs873134 | REC | CT + TT | Pravastatin | 40 | 1046 | 0.52 | 0.355 | 0.765 | 0.0009 | 0.00037 | CC |
| hCV2652047 | rs873134 | REC | CT + TT | Placebo | 75 | 1033 | ref | . | . | . | 0.00037 | |

| SNP hCV # | SNP rs # | EVENTS_PLACEBO | TOTAL_PLACEBO | HR_PLACEBO | L95_PLACEBO | U95_PLACEBO | P_PLACEBO | P_DF2_PLACEBO | GENO_ALL |
|---|---|---|---|---|---|---|---|---|---|
| hCV2652047 | rs873134 | 13 | 338 | 0.48 | 0.248 | 0.939 | 0.032 | 0.0851 | CC |
| hCV2652047 | rs873134 | . | . | . | . | . | . | . | |
| hCV2652047 | rs873134 | 49 | 697 | 0.89 | 0.551 | 1.428 | 0.6225 | 0.0851 | CT |
| hCV2652047 | rs873134 | . | . | . | . | . | . | . | |
| hCV2652047 | rs873134 | 26 | 336 | ref | . | . | . | 0.0851 | TT |
| hCV2652047 | rs873134 | . | . | . | . | . | . | . | |
| hCV2652047 | rs873134 | 62 | 1035 | 0.75 | 0.477 | 1.193 | 0.2284 | . | CT + CC |
| hCV2652047 | rs873134 | . | . | . | . | . | . | . | |
| hCV2652047 | rs873134 | 13 | 338 | 0.52 | 0.29 | 0.942 | 0.0308 | . | CC |
| hCV2652047 | rs873134 | . | . | . | . | . | . | . | |

| SNP hCV # | SNP rs # | EVENTS_ALL | TOTAL_ALL | HR_ALL | L95_ALL | U95_ALL | P_ALL | P_DF2_ALL | HW (ALL) pExact |
|---|---|---|---|---|---|---|---|---|---|
| hCV2652047 | rs873134 | 40 | 692 | 0.96 | 0.626 | 1.488 | 0.8714 | 0.8089 | 0.761 |
| hCV2652047 | rs873134 | . | . | . | . | . | . | . | 0.761 |
| hCV2652047 | rs873134 | 73 | 1377 | 0.89 | 0.607 | 1.298 | 0.539 | 0.8089 | 0.761 |
| hCV2652047 | rs873134 | . | . | . | . | . | . | . | 0.761 |
| hCV2652047 | rs873134 | 42 | 702 | ref | . | . | . | 0.8089 | 0.761 |
| hCV2652047 | rs873134 | . | . | . | . | . | . | . | 0.761 |
| hCV2652047 | rs873134 | 113 | 2069 | 0.91 | 0.641 | 1.302 | 0.6173 | . | 0.761 |
| hCV2652047 | rs873134 | . | . | . | . | . | . | . | 0.761 |
| hCV2652047 | rs873134 | 40 | 692 | 1.04 | 0.728 | 1.494 | 0.8199 | . | 0.761 |
| hCV2652047 | rs873134 | . | . | . | . | . | . | . | 0.761 |

TABLE 22

| SNP hCV # | SNP rs # | MODE | GENO_RESP | STATIN | EVENTS_RESP | TOTAL_RESP | HR_RESP | L95_RESP | U95_RESP | P_RESP | P_INT_RESP | GENO_PLACEBO |
|---|---|---|---|---|---|---|---|---|---|---|---|---|
| hCV2652047 | rs873134 | GEN | TT | Pravastatin | 25 | 364 | 0.57 | 0.339 | 0.952 | 0.0317 | 0.05825 | TT |
| hCV2652047 | rs873134 | GEN | TT | Placebo | 37 | 333 | ref | . | . | . | 0.05825 | |
| hCV2652047 | rs873134 | GEN | TC | Pravastatin | 63 | 676 | 1 | 0.705 | 1.405 | 0.9783 | 0.05825 | TC |
| hCV2652047 | rs873134 | GEN | TC | Placebo | 67 | 693 | ref | . | . | . | 0.05825 | |
| hCV2652047 | rs873134 | GEN | CC | Pravastatin | 23 | 352 | 0.48 | 0.29 | 0.809 | 0.0056 | 0.05825 | CC |
| hCV2652047 | rs873134 | GEN | CC | Placebo | 42 | 335 | ref | . | . | . | 0.05825 | |
| hCV2652047 | rs873134 | DOM | TC + TT | Pravastatin | 88 | 1040 | 0.85 | 0.64 | 1.133 | 0.2714 | 0.06887 | TC + TT |
| hCV2652047 | rs873134 | DOM | TC + TT | Placebo | 104 | 1026 | ref | . | . | . | 0.06887 | |

| SNP hCV # | SNP rs # | EVENTS_PLACEBO | TOTAL_PLACEBO | HR_PLACEBO | L95_PLACEBO | U95_PLACEBO | P_PLACEBO | P_DF2_PLACEBO | GENO_ALL |
|---|---|---|---|---|---|---|---|---|---|
| hCV2652047 | rs873134 | 37 | 333 | 0.87 | 0.555 | 1.349 | 0.5232 | 0.3415 | TT |
| hCV2652047 | rs873134 | . | . | . | . | . | . | . | |
| hCV2652047 | rs873134 | 67 | 693 | 0.75 | 0.509 | 1.105 | 0.1454 | 0.3415 | TC |
| hCV2652047 | rs873134 | . | . | . | . | . | . | . | |
| hCV2652047 | rs873134 | 42 | 335 | ref | . | . | . | 0.3415 | CC |
| hCV2652047 | rs873134 | . | . | . | . | . | . | . | |
| hCV2652047 | rs873134 | 104 | 1026 | 0.79 | 0.549 | 1.128 | 0.1924 | . | TC + TT |
| hCV2652047 | rs873134 | . | . | . | . | . | . | . | |

TABLE 22-continued

| SNP hCV # | SNP rs # | EVENTS_ ALL | TOTAL_ ALL | HR_ ALL | L95_ ALL | U95_ ALL | P_ ALL | P_ DF2_ ALL |
|---|---|---|---|---|---|---|---|---|
| hCV2652047 | rs873134 | 62 | 697 | 0.93 | 0.654 | 1.313 | 0.6696 | 0.8281 |
| hCV2652047 | rs873134 | . | . | . | . | . | . | . |
| hCV2652047 | rs873134 | 130 | 1369 | 1.02 | 0.756 | 1.372 | 0.9047 | 0.8281 |
| hCV2652047 | rs873134 | . | . | . | . | . | . | . |
| hCV2652047 | rs873134 | 65 | 687 | ref | . | . | . | 0.8281 |
| hCV2652047 | rs873134 | . | . | . | . | . | . | . |
| hCV2652047 | rs873134 | 192 | 2066 | 0.99 | 0.745 | 1.308 | 0.9269 | . |
| hCV2652047 | rs873134 | . | . | . | . | . | . | . |

SEQUENCE LISTING (3661 sequences)

SEQ ID NO: 1 - DNA, 2542 bp, Homo sapiens
agtgcaacccagagggcaggatttcctgctggactttgaaatccaacccggtcacctacccgcgcgactgtgtccacggatggcacgaaagccaagcgagtccccctgccgagctactcgcgtccgcctcctcccaagctgagctctgctccgcccacctgagtccttcgccagttaggaggaaacacagccgcttaatgaactgctgcatcgggctgggagagaaagctcgcgggtcccaccgggcctcctacccaagtctcagcgcgcttttcaccgaggcctcaattctgggatttggcagctttgctgtgaaagcccaatggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcactggaaagagtgccagtcagcagtcatgcacgctgat

SEQ ID NO: 2 - DNA, 2609 bp, Homo sapiens
ggctcggtccgactattgcccgcggtgggggagggggatggatcacgccacgcgccaaaggcgatcgcgactctccttctgcaggtagcctggaaggctctctctctttctctacgccacccttttcgtggcactgaaaagccccgtcctctcctcccagtcccgcctcctccgagcgttccccctactgcctggaatggtgcggtcccaggtcgcgggtcacgcggcggagggggcgtggcctgcccccggcccagccggctcttctttgcctctgctggagtccggggagtggcgttggctgctagagcgatgccgggccggagttgcgtcgccttagtcctcctggctgccgccgtcagctgtgccgtcgcgcagcacgcgccgccgtggacagaggactgcagaaaatcaacctatcctccttcaggaccaacgtacagaggtgcagttccatggtacaccataaatcttgacttaccaccctacaaaagatggcatgaattgatgcttgacaaggcaccaatgctaaaggttatagtgaattctctgaagaatatgataaatacattcgtgccaagtggaaaagttatgcaggtggtggatgaaaaattgcctggcctacttggcaactttcctggcccttttgaagaggaaatgaagggtattgccgctgttactgatatacctttaggagagattatttcattcaatattttttatgaattatttaccatttgtacttcaatagtagcagaagacaaaaaaggtcatctaatacatgggagaaacatggattttggagtatttcttgggtggaacataaataatgatacctgggtcataactgagcaactaaaacctttaacagtgaatttggatttccaaagaaacaacaaaactgtcttcaaggcttcaagctttgctggctatgtgggcatgttaacaggattcaaaccaggactgttcagtcttacactgaatgaacgtttcagtataaatggtggttatctgggtattctagaatggattctgggaaagaaagatgccatgtggatagggttcctcactagaacagttctggaaaatagcacaagttatgaagaagccaagaatttattgaccaagaccaagatattggccccagcctactttatcctgggaggcaaccagtctggggaaggttgtgtgattacacgagacagaaaggaatcattggatgtatatgaactcgatgctaagcagggtagatggtatgtggtacaaacaaattatgaccgttggaaacatcccttcttccttgatgatcgcagaacgcctgcaaagatgtgtctgaaccgcaccagccaagagaatatctcatttgaaaccatgtatgatgtcctgtcaacaaaacctgtcctcaacaagctgaccgtatacacaaccttgatagatgttaccaaaggtcaattcgaaacttacctgcgggactgccctgacccttgtataggttggtgagcacacgtctggcctacagaatgcggcctctgagacatgaagacaccatctccatgtgaccgaacactgcagctgtctgaccttccaaagactaagactcgcggcaggttctctttgagtcaatagcttgtcttcgtccatctgttgacaaatgacagatcttttttttttccccctatcagttgatttttcttatttacagataacttctttaggggaagtaaaacagtcatctagaattcactgagttttgtttcactttgacatttggggatctggtgggcagtcgaaccatggtgaactccacctccgtggaataaatggagattcagcgtgggtgttgaatccagcacgtctgtgtgagtaacgggacagtaaacactccacattcttcagtttttcacttctacctacatatttgtatgtttttctgtataacagccttttccttctggttctaactgctgttaaaattaatatatcattatctttgctgttattgacagcgatataattttattacatatgattagagggatgagacagacattcacctgtatatttcttttaatgggcacaaaatgggcccttgcctctaaatagcactttttggggttcaagaagtaatcagtatgcaaagcaatcttttatacaataattgaagtgttccctttttcataattactctacttcccagtaaccctaaggaagttgctaacttaaaaaactgcatcccacgttctgttaatttagtaaataaacaagtcaaagacttgtggaaaataggaagtgaacccatattttaaattctcataagtagcattcatgtaataaacaggtttttagtttgttcttcagattgatagggagttttaaagaaattttagtagttactaaaattatgttactgtatttttcagaaatcaaactgcttatgaaaagtactaatagaacttgttaacctttctaaccttcacgattaactgtgaaatgtacgtcatttgtgcaagaccgtttgtccacttcattttgtataatcacagttgtgttcctgacactcaataaacagtcactggaaagagtgccagtcagcagtcatgcacgctgat

SEQ ID NO: 3 - DNA, 2488 bp, Homo sapiens
ttttgtccgcctgccgccgccgtcccagatattaatcacggagttccagggagaaggaacttgtgaaatgggggagccggctggggttgccggcaccatggagtcaccttttagcccgggactctttcacaggctggatgaagattgggattctgctctctttgctgaactcggttatttcacagacactgatgagctgcaattggaagcagcaaatgagacgtatgaaaacaattttgataatcttgattttgatttggatttgatgccttgggagtcagacatttgggacatcaacaaccaaatctgtacagttaaagatattaaggcagaacctcagccactttctccagcctcctcaagttattcagtctcgtctcctcggtcagtggactcttattcttcaactcagcatgttcctgaggagttggatttgtcttctagttctcagatgtctcccctttccttatatggtgaaaactctaatagtctctcttcagcggagccactgaaggaagataagcctgtcactggtcctaggaacaagactgaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagagaaccagaggcttaaagtccctagtccaaagcgaagagttgtctgtgtgatgatagtattggcatttataatactgaactatggacctatgagcatgttggaacaggattccaggagaatgaaccctagtgtgagccctgcaaatcaaaggaggcaccttctaggattttctgctaaagaggcacaggacacatcagatggtattatccagaaaaacagctacagatatgatcattctgtttcaaatgacaaagccctgatggtgctaactgaagaaccattgctttacattcctccacctccttgtcagcccctaattaacacaacagagtctctcaggttaaatcatgaacttcgaggatgggttcatagacatgaagtagaaaggaccaagtcaagaagaatgacaaataatcaacagaaaacccgtattcttcagggtgctctggaacagggctcaaattctcagctgatggctgttcaatacacagaaaccactagtagtatcagcaggaactcagggagtgagctacaagtgtattatgcttcacccagaagttatcaagacttttttgaagccatccgcagaaggggagacacattttatgttgtgtcatttcgaagggatcacctgctgttaccagctaccacccataacaagaccacaagaccaaaaatgtcaattgtgttaccagcaataaacataaatgagaatgtgatcaatgggcaggactacgaagtgatgatgcagattgactgtcaggtgatggacaccaggatcctccatatcaaaagttcgtcagttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagcta

SEQ ID NO: 4 - DNA, 2096 bp, Homo sapiens
ctcctctgctcctcgaagaaggccagggcggggctgccgcaagttttgacattttcgcagcggagacgcgcgcgggcactctcgggccgacggctgcggcggcggccgaccctccagagccccttagtcgcgccccggccctcccgctgcccggagtccggcggccacgaggcccagccgcgtcctcccgcgcttgctcgcccggcggccgcagccatgtcccgggggcccgaggaggtgaaccggctcacggagagcacctaccggaatgttatggaacagttcaatcctgggctgcgaaatttaataaacctggggaaaaattatgagaaagctgtaaacgctatgatcctggcaggaaaagcctactacgatggagtggccaagatcggtgagattgccactgggtcccccgtgtcaactgaactgggacatgtcctcatagagatttcaagtacccacaagaaactcaacgagagtcttgatgaaaattttaaaaaattccacaaagagattatccatgagctggagaagaagatagaacttgacgtgaaatatatgaacgcaactctaaaaagataccaaacagaacacaagaataaattagagtctttggagaaatcccaagctgagttgaagaagatcagaaggaaaagccaaggaagccgaaacgcactcaaatatgaacacaaagaaattgagtatgtggagaccgttacttctcgtcagagtgaaatccagaaattcattgcagatggttgcaaagaggctctgcttgaagagaagaggcgcttctgctttctggttgataagcactgtggctttgcaaaccacatacattattatcacttacagtctgcagaactactgaattccaagctgcctcggtggcaggagacctgtgttgatgccatcaaagtgccagagaaaatcatgaatatgatcgaagaaataaagaccccagcctctacccccgtgtctggaactcctcaggcttcacccatgatcgagagaagcaatgtggttaggaaagattacgacaccctttctaaatgctcaccaaagatgccccccgctccttcaggcagagcatataccagtcccttgatcgatatgtttaataacccagccacggctgccccgaattcacaaagggtaaataattcaacaggtacttccgaagatcccagtttacagcgatcagtttcggttgcaacgggactgaacatgatgaagaagcagaaagtgaagaccatcttcccgcacactgcgggctccaacaagaccttactcagctttgcacagggagatgtcatcacgctgctcatccccgaggagaaggatggctggctctatggagaacacgacgtgtccaaggcgaggggttggttcccgtcgtcgtacacgaagttgctggaagaaaatgagacagaagcagtgaccgtgcccacgccaagccccacaccagtgagaagcatcagcaccgtgaacttgtctgagaatagcagtgttgtcatccccccacccgactacttggaatgcttgtccatgggggcagctgccgacaggagagcagattcggccaggacgacatccacctttaaggccccagcgtccaagcccgagaccgcggctcctaacgatgccaacgggactgcaaagccgccttttctcagcggagaaaacccctttgccactgtgaaactccgcccgactgtgacgaatgatcgctcggcacccatcattcgatgagaggacagccaaggactctcccgggcctctccggttctcccttgcggaatgatgggcgcatcctgtctgccacgtgctgacggtcgggaagcttcagtggagaggcctaactctaatgtcgcctgcttaagcaaatcatgcttctctgtttcacgtagttgggttgacaagtttctgcctttaagataaatgagtaatagtctaatgaccagctcagccatttaaaatattttcttcctattctgttcaagaaacagtaaacttggtttcaatctttaaaaaaaaaaaaaaaaaaaaaaaaaaaaaaaaaaaaaaaaaaaaaaaaaaaaaaaaaaaaaaaaaaa

SEQ ID NO: 5 - DNA, 3474 bp, Homo sapiens
cgacgtcaagtcgaggccgccgccgcggggcctggttatcgccggttcagcgcagcccggagtcgcccaggcctgaactcctacccagcctagactcaagtctgggtttcagctgccgccagccctattgctgctgttgctgttctctgtccttggcccaggggctggaggccttttcctgactgattactccacctgctcaccccgcaagctgagtcctttccgctcctttgccagcaccgagctcttccacttccatgttcctgaggacacattcctggctgtttggaacctcatcatcttcaaggagcaagggggaacttttggggaccactgcccagaccaaagtgtgactgtgtatttccggtccggggcaccccctgtcatcaatcccctgcatacacacttcccaggggacacagctgtgcctggggttttctcactgaccctcagctggacactgcccaaccgcacctcaggcatctttaacgtcagcagccccttacctggggactggttcttggctgcccaccttccccaggcccacggccacatctctgtcaagggtctccaggatgagtgtcagtacctccttcagccgcagctgattgtccggcgtttgctggacgtcgctgtgctggttcctggccggccctcagagcaaaccctctccccacacaatcgctcagccctgtacaaggtctttgtgcccagcttcacttacagggtttcagcacagctggtgtgtgtggggggccgtggggtatctgcctgccccctgtcactgcgtctgcgtcccaaagccccacccctgcacaactcaagctctgtggcctgtggaggtgcctcaggatgccagctggagctggcactgcccccctgggggcactgggtctacgtgcgtgtggaaacatcatcccggggccctggtaggaccatccgcttccagctgtgtgtgcggttgcaagagtgcccacagcccggcctgctccgagccctggtccctggagctgccatgaacatgccccagtccctgggcaaccagccactgcccccagaaccgccatcccttggaacccctgcggaggggcctgggaccacgtccccacccgagcactgctggccagtgcgcccgactctgcgcaacgagctggacaccttctctgtccacttctacatcttctttggcccaagtgtggcccttccccctgagcgcccagccgtgttcgccatgaggctgttgccagtgctggacagtggaggcgtcctcagcctggagctccagctcaatgcgagctccgtgcgccaggaaaacgtgacggtgtttggatgcttgactcacgaggtgcccttgagcctgggggatgcagcagtgacctgttccaaagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacgttctatcatgcctgtgaccagccaggcatcgtggttttctgcatcatggactacgatgtgctgcagttctgtgatttcctgggctccttaatgtccgtgtgggtcactgtcattgccatggctcgtttacagcccgtggtcaagcaggtgctgtatttgctgggagctatgctgctgtccatggctctgcagcttgaccgacatggactctggaacctgcttggacccagtctcttcgccctggggatcttggccacagcctggacagtacgcagcgtccgccgccggcactgctacccacccacgtggcgccgctggcttttctacttgtgccctggcagccttattgcaggcagtgccgtcctgctttatgcttttgtggagacccgggacaactacttctacattcacagcatttggcatatgctcattgcgggcagtgtgggcttcctgctgccccctcgtgccaagactgaccacggggtcccatctggagcccgggcccggggctgtggttaccagctatgcatcaacgagcaggaggagctgggcctcgtgggcccaggaggggccactgtcagcagcatctgtgccagctgagaggggctttgggcctggccctgaggggatatgaatgcttcctagagttctttctgggggtgtggagccctcttagaaggagacaggctgtatttcttgaggacatggagtctttctcaaggacacaaaactcttccagggacctggagcccttcccaggacatggagaacttcctgagggcctggagtccccctgcatcatggagtccttcttaaggactggagcctatgcaggcacagagtccctcaggaccaaggagtccctcctgcaggtgtggagcctttcctgggatgcagagccttcccaagacatggattccttcccagggagacaaagccctgtcaggagcacagcatctttccagaggaggtggagtctatcttggggaaaccaaatttccagattttcccagaggctcagcaactctggcctcaggcttccttcccagaggcagcgtctgggctgtgctgtgctgtggaggagggattgcaggatggatggagctgggactggggctgtctgggtggctggtatcctcgtttgatacaggtggagtctgtgtgtctccagtgattgattggttcagaatggttctgtgatgccttttttccccctggggtcaggggtgtggggaagtggggaaagagggcccctcagggaatcagcagggctgatgggagctactgccggaggcttttgtcacaccctgtacacagtctgatcccgctcatctgggccctgcattcatttctaaacagtttctaatgcctattccccaattcctattgagcccgatttgcagtatctgaggggtgtgtgtgtgtgtgtgtgtgtttatgtatgtatacgtatgctgagatgatttaaatcagtgagacagactttccttatgatgcccacacccaacacagaaggaagccgaggtcccaggaaattggaatagcaggtacacgtctcaggtgtgcaagaaatatcacaagaatgtaacttctgttttgagcccccaaaaaaaaaaaaaaaaaaaaaaaaaaaaaaaaaa

SEQ ID NO: 6 - DNA, 3747 bp, Homo sapiens
gccccgcttcccacatcggccccagcccctgcctgggtccccatccaggacccccttccagtctctgcccctggcctggcccccatcccggcctcggccctcgttccaccccctgtcacaaatcccagcccaggccctgtcccagccccattcccagtgtttgcttaaggccctggctcaaccccgtcccttgctgcagtccccatcacagcccttccttccatcccactccctgcccttgttcaagccccagtgtccagcccagcccaacccattatctcagcctttgccctcatctctgtgtttacccaagtctctccctctagtcccccctatctctcatactctgcccctctcccagcctagactcaagtctgggtttcagctgccgccagccctattgctgctgttgctgttctctgtccttggcccaggggctggaggccttttcctgactgattactccacctgctcaccccgcaagctgagtcctttccgctcctttgccagcaccgagctcttccacttccatgttcctgaggacacattcctggctgtttggaacctcatcatcttcaaggagcaagggggaacttttggggaccactgcccagaccaaagtgtgactgtgtatttccggtccggggcaccccctgtcatcaatcccctgcatacacacttcccaggggacacagctgtgcctggggttttctcactgaccctcagctggacactgcccaaccgcacctcaggcatctttaacgtcagcagccccttacctggggactggttcttggctgcccaccttccccaggcccacggccacatctctgtcaagggtctccaggatgagtgtcagtacctccttcagccgcagctgattgtccggcgtttgctggacgtcgctgtgctggttcctggccggccctcagagcaaaccctctccccacacaatcgctcagccctgtacaaggtctttgtgcccagcttcacttacagggtttcagcacagctggtgtgtgtggggggccgtggggtatctgcctgccccctgtcactgcgtctgcgtcccaaagccccacccctgcacaactcaagctctgtggcctgtggaggtgcctcaggatgccagctggagctggcactgcccccctgggggcactgggtctacgtgcgtgtggaaacatcatcccggggccctggtaggaccatccgcttccagctgtgtgtgcggttgcaagagtgcccacagcccggcctgctccgagccctggtccctggagctgccatgaacatgccccagtccctgggcaaccagccactgcccccagaaccgccatcccttggaacccctgcggaggggcctgggaccacgtccccacccgagcactgctggccagtgcgcccgactctgcgcaacgagctggacaccttctctgtccacttctacatcttctttggcccaagtgtggcccttccccctgagcgcccagccgtgttcgccatgaggctgttgccagtgctggacagtggaggcgtcctcagcctggagctccagctcaatgcgagctccgtgcgccaggaaaacgtgacggtgtttggatgcttgactcacgaggtgcccttgagcctgggggatgcagcagtgacctgttccaaagagtccctggccggcttcctcctctctgtcagtgccaccaccagggttgccaggctgcgaatcccattcccgcagacggggacctggttcctggccctccgctccctgtgcggggtggggcctcggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccgggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacgttctatcatgcctgtgaccagccaggcatcgtggttttctgcatcatggactacgatgtgctgcagttctgtgatttcctgggctccttaatgtccgtgtgggtcactgtcattgccatggctcgtttacagcccgtggtcaagcaggtgctgtatttgctgggagctatgctgctgtccatggctctgcagcttgaccgacatggactctggaacctgcttggacccagtctcttcgccctggggatcttggccacagcctggacagtacgcagcgtccgccgccggcactgctacccacccacgtggcgccgctggcttttctacttgtgccctggcagccttattgcaggcagtgccgtcctgctttatgcttttgtggagacccgggacaactacttctacattcacagcatttggcatatgctcattgcgggcagtgtgggcttcctgctgccccctcgtgccaagactgaccacggggtcccatctggagcccgggcccggggctgtggttaccagctatgcatcaacgagcaggaggagctgggcctcgtgggcccaggaggggccactgtcagcagcatctgtgccagctgagaggggctttgggcctggccctgaggggatatgaatgcttcctagagttctttctgggggtgtggagccctcttagaaggagacaggctgtatttcttgaggacatggagtctttctcaaggacacaaaactcttccagggacctggagcccttcccaggacatggagaacttcctgagggcctggagtccccctgcatcatggagtccttcttaaggactggagcctatgcaggcacagagtccctcaggaccaaggagtccctcctgcaggtgtggagcctttcctgggatgcagagccttcccaagacatggattccttcccagggagacaaagccctgtcaggagcacagcatctttccagaggaggtggagtctatcttggggaaaccaaatttccagattttcccagaggctcagcaactctggcctcaggcttccttcccagaggcagcgtctgggctgtgctgtgctgtggaggagggattgcaggatggatggagctgggactggggctgtctgggtggctggtatcctcgtttgatacaggtggagtctgtgtgtctccagtgattgattggttcagaatggttctgtgatgccttttttccccctggggtcaggggtgtggggaagtggggaaagagggcccctcagggaatcagcagggctgatgggagctactgccggaggcttttgtcacaccctgtacacagtctgatcccgctcatctgggccctgcattcatttctaaacagtttctaatgcctattccccaattcctattgagcccgatttgcagtatctgaggggtgtgtgtgtgtgtgtgtgtgtttatgtatgtatacgtatgctgagatgatttaaatcagtgagacagactttccttatgatgcccacacccaacacagaaggaagccgaggtcccaggaaattggaatagcaggtacacgtctcaggtgtgcaagaaatatcacaagaatgtaacttctgttttgagcccccaaaaaaaaaaaaaaaaaaaaaaaaaaaaaaaaaa

SEQ ID NO: 7 - DNA, 539 bp, Homo sapiens
ctgtctcccgccacccacaccagctgtcccactcaccatggagaagatcctgatcctcctgcttgtcgccctctctgtggcctatgcagctcctggcccccgggggatcattatcaacctggagaacggtgagctctgcatgaatagtgcccagtgtaagagcaattgctgccagcattcaagtgcgctgggcctggcccgctgcacatccatggccagcgagaacagcgagtgctctgtcaagacgctctatgggatttactacaagtgtccctgtgagcgtggcctgacctgtgagggagacaagaccatcgtgggctccatcaccaacaccaactttggcatctgccatgacgctggacgctccaagcagtgagactgcccacccactcccacacctagcccagaatgctgtaggccactaggcgcaggggcatctctcccctgctccagcgcatctcccgggctggccacctccttgaccagcatatctgttttctgattgcgctcttcacaattaaaggcctcctgcaaacctt

SEQ ID NO: 8 - DNA, 9601 bp, Homo sapiens
agacactgctgctccggggggctgacctggcggggagtggccgcgcagtctgctccggcgccgctttgtgcgcgcagccgctggcccctctactcccgggtctgccccccgggacacccctctgcctcgcccaagtcatgcagccctacctgcctctccactgtggacctttgggaaccgactcctcacctcgggggctcgggccttgactgtgctgggagccggtaggcgtcctccgcgacccgcccgcgcccctcgcgcccgccggggccccgggctccaaagttgtggggaccggcgcgagttggaaagtttgcccgagggctggtgcaggcttggagctgggggccgtgcgctgccctgggaatgtgacccggccagcgaccaaaaccttgtgtgactgagctgaagagcagtgcatccagattctcctcagaagtgagactttccaaaggaccaatgactctgtttcctgcgccctttcattttttcctactctgtagctatgtctcgatcccgccatgcaaggccttccagattagtcaggaaggaagatgtaaacaaaaaaaagaaaaacagccaactacgaaagacaaccaagggagccaacaaaaatgtggcatcagtcaagactttaagccctggaaaattaaagcaattaattcaagaaagagatgttaagaaaaaaacagaacctaaaccacccgtgccagtcagaagccttctgacaagagctggagcagcacgcatgaatttggataggactgaggttctttttcagaacccagagtccttaacctgcaatgggtttacaatggcgctacgaagcacctctcttagcaggcgactctcccaacccccactggtcgtagccaaatccaaaaaggttccactttctaagggtttagaaaagcaacatgattgtgattataagatactccctgctttgggagtaaagcactcagaaaatgattcggttccaatgcaagacacccaagtccttcctgatatagagactctaattggtgtacaaaatccctctttacttaaaggtaagagccaagagacaactcagttttggtcccaaagagttgaggattccaagatcaatatccctacccacagtggccctgcagctgagatccttcctgggccactggaagggacacgctgtggtgaaggactattctctgaagagacattgaatgataccagtggttccccaaaaatgtttgctcaggacacagtgtgtgctccttttccccaaagagcaacccccaaagttacctctcaaggaaaccccagcattcagttagaagagttgggttcacgagtagaatctcttaagttatctgattcttacctggatcccattaaaagtgaacatgattgctaccccacctccagtcttaataaggttatacctgacttgaaccttagaaactgcttggctcttggtgggtctacgtctcctacctctgtaataaaattcctcttggcaggctcaaaacaagcgacccttggtgctaaaccagatcatcaagaggccttcgaagctactgcaaatcaacaggaagtttctgataccacctctttcctaggacaggcctttggtgctatcccacatcaatgggaacttcctggtgctgacccagttcatggtgaggccctgggtgagaccccagatctaccagagattcctggtgctattccagtccaaggagaggtctttggtactattttagaccaacaagaaactcttggtatgagtgggagtgttgtcccagacttgcctgtcttccttcctgttcctccaaatccaattgctacctttaatgctccttccaaatggcctgagccccaaagcactgtctcatatggacttgcagtccagggtgctatacagattttgcctttgggctcaggacacactcctcaatcatcatcaaactcagagaaaaattcattacctccagtaatggctataagcaatgtagaaaatgagaagcaggttcatataagcttcctgccagctaacactcaggggttcccattagcccctgagagaggactcttccatgcttcactgggtatagcccaactctctcaggctggtcctagcaaatcagacagagggagctcccaggtcagtgtaaccagcacagttcatgttgtcaacaccacagtggtgactatgccagtgccaatggtcagtacctcctcttcttcctataccactttgctaccgactttggaaaagaagaaaagaaagcgatgtggggtctgtgaaccctgccagcagaagaccaactgtggtgaatgcacttactgcaagaacagaaagaacagccatcagatctgtaagaaaagaaaatgtgaggagctgaaaaagaaaccatctgttgttgtgcctctggaggttataaaggaaaacaagaggccccagagggaaaagaagcccaaagttttaaaggcagattttgacaacaaaccagtaaatggccccaagtcagaatccatggactacagtagatgtggtcatggggaagaacaaaaattggaattgaacccacatactgttgaaaatgtaactaaaaatgaagacagcatgacaggcatcgaggtggagaagtggacacaaaacaagaaatcacagttaactgatcacgtgaaaggagattttagtgctaatgtcccagaagctgaaaaatcgaaaaactctgaagttgacaagaaacgaaccaaatctccaaaattgtttgtacaaaccgtaagaaatggcattaaacatgtacactgtttaccagctgaaacaaatgtttcatttaaaaaattcaatattgaagaattcggcaagacattggaaaacaattcttataaattcctaaaagacactgcaaaccataaaaacgctatgagctctgttgctactgatatgagttgtgatcatctcaaggggagaagtaacgttttagtattccagcagcctggctttaactgcagttccattccacattcttcacactccatcataaatcatcatgctagtatacacaatgaaggtgatcaaccaaaaactcctgagaatataccaagtaaagaaccaaaagatggatctcccgttcaaccaagtctcttatcgttaatgaaagataggagattaacattggagcaagtggtagccatagaggccctgactcaactctcagaagccccatcagagaattcctccccatcaaagtcagagaaggatgaggaatcagagcagagaacagccagtttgcttaatagctgcaaagctatcctctacactgtaagaaaagacctccaagacccaaacttacagggagagccaccaaaacttaatcactgtccatctttggaaaaacaaagttcatgcaacacggtggttttcaatgggcaaactactaccctttccaactcacatatcaactcagctactaaccaagcatccacaaagtcacatgaatattcaaaagtcacaaattcattatctctttttataccaaaatcaaattcatccaagattgacaccaataaaagtattgctcaagggataattactcttgacaattgttccaatgatttgcatcagttgccaccaagaaataatgaagtggagtattgcaaccagttactggacagcagcaaaaaattggactcagatgatctatcatgtcaggatgcaacccatacccaaattgaggaagatgttgcaacacagttgacacaacttgcttcgataattaagatcaattatataaaaccagaggacaaaaaagttgaaagtacaccaacaagccttgtcacatgtaatgtacagcaaaaatacaatcaggagaagggcacaatacaacagaaaccaccttcaagtgtacacaataatcatggttcatcattaacaaaacaaaagaacccaacccagaaaaagacaaaatccaccccatcaagagatcggcggaaaaagaagcccacagttgtaagttatcaagaaaatgatcggcagaagtgggaaaagttgtcctatatgtatggcacaatatgcgacatttggatagcatcgaaatttcaaaattttgggcaattttgtccacatgattttcctactgtatttgggaaaatttcttcctcgaccaaaatatggaaaccactggctcaaacgaggtccattatgcaacccaaaacagtatttccaccactcactcagataaaattacagagatatcctgaatcagcagaggaaaaggtgaaggttgaaccattggattcactcagcttatttcatcttaaaacggaatccaacgggaaggcattcactgataaagcttataattctcaggtacagttaacggtgaatgccaatcagaaagcccatcctttgacccagccctcctctccacctaaccagtgtgctaacgtgatggcaggcgatgaccaaatacggtttcagcaggttgttaaggagcaactcatgcatcagagactgccaacattgcctggtatctctcatgaaacacccttaccggagtcagcactaactctcaggaatgtaaatgtagtgtgttcaggtggaattacagtggtttctaccaaaagtgaagaggaagtctgttcatccagttttggaacatcagaattttccacagtggacagtgcacagaaaaattttaatgattatgccatgaacttctttactaaccctacaaaaaacctagtgtctataactaaagattctgaactgcccacctgcagctgtcttgatcgagttatacaaaaagacaaaggcccatattatacacaccttggggcaggaccaagtgttgctgctgtcagggaaatcatggagaataggtatggtcaaaaaggaaacgcaataaggatagaaatagtagtgtacaccggtaaagaagggaaaagctctcatgggtgtccaattgctaagtgggttttaagaagaagcagtgatgaagaaaaagttctttgtttggtccggcagcgtacaggccaccactgtccaactgctgtgatggtggtgctcatcatggtgtgggatggcatccctcttccaatggccgaccggctatacacagagctcacagagaatctaaagtcatacaatgggcaccctaccgacagaagatgcaccctcaatgaaaatcgtacctgtacatgtcaaggaattgatccagagacttgtggagcttcattctcttttggctgttcatggagtatgtactttaatggctgtaagtttggtagaagcccaagccccagaagatttagaattgatccaagctctcccttacatgaaaaaaaccttgaagataacttacagagtttggctacacgattagctccaatttataagcagtatgctccagtagcttaccaaaatcaggtggaatatgaaaatgttgcccgagaatgtcggcttggcagcaaggaaggtcgtcccttctctggggtcactgcttgcctggacttctgtgctcatccccacagggacattcacaacatgaataatggaagcactgtggtttgtaccttaactcgagaagataaccgctctttgggtgttattcctcaagatgagcagctccatgtgctacctctttataagctttcagacacagatgagtttggctccaaggaaggaatggaagccaagatcaaatctggggccatcgaggtcctggcaccccgccgcaaaaaaagaacgtgtttcactcagcctgttccccgttctggaaagaagagggctgcgatgatgacagaggttcttgcacataagataagggcagtggaaaagaaacctattccccgaatcaagcggaagaataactcaacaacaacaaacaacagtaagccttcgtcactgccaaccttagggagtaacactgagaccgtgcaacctgaagtaaaaagtgaaaccgaaccccattttatcttaaaaagttcagacaacactaaaacttattcgctgatgccatccgctcctcacccagtgaaagaggcatctccaggcttctcctggtccccgaagactgcttcagccacaccagctccactgaagaatgacgcaacagcctcatgcgggttttcagaaagaagcagcactccccactgtacgatgccttcgggaagactcagtggtgccaatgcagctgctgctgatggccctggcatttcacagcttggcgaagtggctcctctccccaccctgtctgctcctgtgatggagcccctcattaattctgagccttccactggtgtgactgagccgctaacgcctcatcagccaaaccaccagccctccttcctcacctctcctcaagaccttgcctcttctccaatggaagaagatgagcagcattctgaagcagatgagcctccatcagacgaacccctatctgatgaccccctgtcacctgctgaggagaaattgccccacattgatgagtattggtcagacagtgagcacatctttttggatgcaaatattggtggggtggccatcgcacctgctcacggctcggttttgattgagtgtgcccggcgagagctgcacgctaccactcctgttgagcaccccaaccgtaatcatccaacccgcctctcccttgtcttttaccagcacaaaaacctaaataagccccaacatggttttgaactaaacaagattaagtttgaggctaaagaagctaagaataagaaaatgaaggcctcagagcaaaaagaccaggcagctaatgaaggtccagaacagtcctctgaagtaaatgaattgaaccaaattccttctcataaagcattaacattaacccatgacaatgttgtcaccgtgtccccttatgctctcacacacgttgcggggccctataaccattgggtctgaaggcttttctccccctcttaatgcctttgctagtgcagtgtattttttcaaggtgctgttaaaagaaagtcatgttgtcgtttactatcttcatctcacccatttcaagtctgaggtaaaaaaataataatgataacaaaacggggtgggtattcttaactgtgactatattttgacaattggtagaaggtgcacattttaagcaaaaataaaagttttatagttttaaatacataaagaaatgtttcagttaggcattaaccttgatagaatcactcagtttggtgctttaaattaagtctgtttactatgaaacaagagtcatttttagaggattttaacaggttcatgttctatgatgtaaaatcaagacacacagtgttaactctacacagcttctggtgcttaaccacatccacacagttaaaaataagctgaattattatttcatggtgccattgttccaacatcttccaatcattgctagaaaattggcatattcctttgaaataaacttatgaaatgttttctctcttaaaatatttctcctgtgtaaaataaatcattgttgttagtaatggttggaggctgttcataaattgtaaatatatattttaaaagcactttctatttttaaaagtaacttgaaataatatagtataagaatcctattgtctattgtttgtgcatatttgcatacaagagaaatcatttatccttgctgtgtagagttccatcttgttaactgcagtatgtattctaatcatgtatatggtttgtgttcttttactgtgtcctctcacattcaagtattagcaacttgcagtatataaaatagttagataatgagaagttgttaattatctctaaaattggaattaggaagcatatcaccaatactgattaacattctctttggaactaggtaagagtggtctcttcttattgaacaacctcaatttagtttcatcccacctttctcagtataatccatgagaggtgtttccaaaaggagatgagggaacaggataggtttcagaagagtcaaatgcttctaatgtctcaaggtgataaaatacaaaaactaagtagacagatatttgtactgaagtctgatacagaattagaaaaaaaaaattcttgttgaaatattttgaaaacaaattccctactatcatcacatgcctccccaaccccaagtcaaaaacaagaggaatggtactacaaacatggctttgtccattaagagctaattcatttgtttatcttagcatactagatttgggaaaatgataactcatcttttctgataattgcctatgttctaggtaacaggaaaacaggcattaagtttattttagtcttcccattttcttcctattactttattgactcattttattgcaaaacaaaaaggattacccaaacaacatgtttcgaacaaggagaattttcaatgaaatacttgattctgttaaaatgcagaggtgctataacattcaaagtgtcagattccttgggagtatggaaaacctaatggtgcttctcccttggaaatgccataggaagcccacaaccgctaacacttacaattttggtgcaaaagcaaacagttccagcaggctctctaaagaaaaactcattgtaacttattaaaataatatctggtgcaaagtatctgttttgagcttttgactaatccaagtaaaggaatatgaagggattgtaaaaaacaaaatgtccattgatagaccatcgtgtacaagtagatttctgcttgttgaatatgtaaaatagggtaattcattgacttgttttagtattttgtgtgccttagatttccgttttaagacatgtatatttttgtgagcctaaggtttcttatatacatataagtatataaataagtgattgtttattgcttcagctgcttcaacaagatatttactagtattagactatcaggaatacacccttgcgagattatgttttagattttaggccttagctcccactagaaattatttcttcaccagatttaatggataaagttttatggctctttatgcatccactcatctactcattcttcgagtctacacttattgaatgcctgcaaaatctaagtatcacttttatttttctttggatcaccacctatgacatagtaaacttgaagaataaaaactaccctcagaaatatttttaaaagaagtagcaaattatcttcagtataatccatggtaatgtatgcagtaattcaaattgatctctctctcaataggtttcttaacaatctaaacttgaaacatcaatgttaatttttggaactattgggatttgtgacgcttgttgcagtttaccaaaacaagtatttgaaaatatatagtatcaactgaaatgtttccattccgttgttgtagttaacatcatgaatggacttcttaagctgattaccccactgtgggaaccaaattggattcctactttgttggactctctttcctgattttaacaatttaccatcccattctctgccctgtgattttttttaaaagcttattcaatgttctgcagcattgtgattgtatgctggctacactgcttttagaatgctctttctcatgaagcaaggaaataaatttgtttgaaatgacattttctctcaaaaaaaaaaaaaaaaaa

SEQ ID NO: 9 - DNA, 2385 bp, Homo sapiens
ctcggctgcgccacgtcggcgcgcggcggccgcgcccccttaacggcagtggcactcacccggctcgcgcggccccggcgccccacgcgcgcgcgtcgttctcccgcccgctcgctccccggcgctcacacctgagctcactcgcgcacgcccgcccggcccgagaaccgcgccgccgcctcggccccgcggaagccccgccgcgtcatgtcttcgcctcccgaagggaaactagagactaaagctggacacccgcccgccgtgaaagctggtggaatgcgaattgtgcagaaacacccacatacaggagacaccaaagaagagaaagacaaggatgaccaggaatgggaaagccccagtccacctaaacccactgtgttcatctctggggtcatcgcccggggtgacaaagatttccccccggcggctgcgcaggtggctcaccagaagccgcatgcctccatggacaagcatccttccccaagaacccagcacatccagcagccacgcaagtgagcctggagtccaccagcctgccccatggccccggctctgctgcacttggtatttccctgacagagagaaccagcagtttcgcccaaatcctactctgctgggaaatctaaggcaaaaccaagtgctctgtcctttgccttacatttccatatttaaaactagaaacagctccagcccaaaccttgtttatggggagtctggttggatgtcatttgaggatcattgtgcccctagaggtgccattagcagaatttgccaagatccgagaaaaattttagctttagttctatttcagcagtcacctgacgtccttgtctatggtcttaaaaacaagaaggcacacatttgagaagatgagattaaggttaggagaaaacctcagtcattgcatgctttttagtatgggccaataaaatctcaacacctgtgggagagtaagaactaagggaatgagtttgggcggcccctcataaaggaccttagaggcagggaacagcaatgccaaatttccctctctcgtgagatgggggatcctgtgcaggctgatgaggcacccatgagaaaagccgaaaaagcatgcatcttagaaatagcccctcaattccaggagtcaacatgccaaagaatgaggctggagacaggtagctccgagggaggacttctggcatgagatctcggcacggcaagcccagcatcgcctcagcccagacaggctccaccaggagatcaagcaagggctgcctttcaggagtcacctcctgagccacttcagagttctggaagtgaccacggaccagggtggaggaatagacttctagttcattctgggacacttgagccagagagttgaaagcttggaaagaccagataagaaacctgccctttgtctccctagggacatgagacaccacattccatttgtgctagaaaaacctatccactgatgagtctaactgttccaaacgcctcccacctggtgtgcacagctgcctgggtccattgtcacttgggtgcatcaggttgtcctccgatttttagatgagtttcctgtctagagatgtcctagtctgctcactggctggtggcagtagggtaccctgcgtcctcgaaaagccagagggttcacctagtcagacgaaactccagaacagtgcttgtggagggcctgactgtcctgctcacccacagccgatctgctgcaggtcagcaactgtgtcgtgagcagctgccaaccaccagcctttctggtgctgttctccagttcacgtctgccagctggtgagggcagaggcagacctggtcagacccagcgcccctcctccctgagggagcatggcacagcctcacacttgaaagacggtgtttggtttcccatctaatcaacttaagggaagccggcatgtacccttcaaggccctgtcaccacctatttcctgatcagttggtataaactgagggtggcttttagagacccagacttggttggcagcgctgccatggaacaccccagcaagcacctcccagcctgcctttcggagcagcacccaggaggggatgccgcgctccagcaacaccaggtcaggcctgtgcagacccctgccctgccgctgcagaaatccagaagcatccttaatgcttctcagtcttcagccagagggagggctgttatttccagaggtgcgctttttatgtacttttagctagatgtggcatgcatctgtgagctttagatcattaaatccaaaatgtttgcctaaatgagtttatcagttgttaacttcaagaatattaaatgatttataataaagctcctgcatttctctccaaaaaaaaaaaaaaaaaaaaaaaaaaaaaaaaaaaaaaaaaaaa

SEQ ID NO: 10 - DNA, 5818 bp, Homo sapiens
gcagtgccgtagtagcgggccacggagatagacagctttggagctgctgaactccgagcacagggtgaagaccccggcgctaccaaccacagcctggcagcctggtctccgcggcacccactggggctgcatccccctcccccgagagggctgcgcaggcgggaagacgcccagaggccagcttcggtcccccttctgtctctcggttcctctttcctcccaagtaagggaataaaccgcgaagaaggagcgccccgggccaccgcgcaaccaagtgttgcctggtgaggaagagccaggacttctgaatttaccttgaatacagacaggaggatgttgcctaaggaatagcagagatcttgtctcatcttctgagaggtgcctgctgctgctgtatacacttgagtgctcccagaagtctcctgaaaggcttacatcgcaaacctgcaatgagccaggccctgggctgggcctccacttcagcctagtgaacaaaactccatcactgccctttagccactcacataaagtttaaaaatgggtgaagaacggtgggtctccctcactccagaagaatttgaccaactccagaaatattcagaatattcctccaagaagataaaagatgccttgactgaatttaatgagggtgggagcctcaaacaatatgacccacatgagccgattagctatgatgtcttcaagctgttcatgagggcgtacctggaggtggaccttccccagccactgagcactcacctcttcctggccttcagccagaagcccagacacgagacctctgaccacccgacggagggagccagcaacagtgaggccaacagcgcagatactaatatacagaatgcagataatgccaccaaagcagacgaggcctgtgcccctgatactgaatcaaatatggctgagaagcaagcaccagctgaagaccaagtggctgcgacccccctggaaccccccgtccctcggtcttcaagctcggaatccccagtggtatacctgaaggatgttgtgtgctacctgtccctgctggagacggggaggcctcaggataagctggagttcatgtttcgcctctatgattcagatgagaacggtctcctggaccaagcggagatggattgcattgtcaaccaaatgctgcatattgcccagtacctggagtgggatcccacagagctgaggcctatattgaaggagatgctgcaagggatggactacgaccgggacggctttgtgtctctacaggaatgggtccatggagggatgaccaccatcccattgctggtcctcctggggatggatgactctggctccaagggggatgggcggcacgcctggaccatgaagcacttcaagaaaccaacctactgcaacttctgccatatcatgctcatgggcgtccgcaagcaaggcctgtgctgcacttactgtaaatacactgtccacgaacgctgtgtgtccagaaacattcctggttgtgtcaaaacgtactcaaaagccaaaaggagtggtgaggtgatgcagcacgcatgggtggaagggaactcctccgtcaagtgtgaccggtgccacaaaagtatcaagtgctaccagagtgtcaccgcgcggcactgcgtgtggtgccggatgacgtttcaccgcaaatgtgaattatcaacgttgtgtgacggtggggaactcagagaccacatcttactgcccacctccatatgccccatcacccgggacaggccaggtgagaagtctgatggctgcgtgtccgccaagggcgaacttgtcatgcagtataagatcatccccaccccgggtacccaccccctgctggtcttggtgaaccccaagagtggagggagacaaggagaaagaattcttcggaaattccactatctgctcaaccccaaacaagttttcaacctggacaatggggggcctactccagggttgaactttttccgtgatactccagacttccgtgttttggcctgtggtggagatgggacagttggctggattttggattgcattgataaggccaactttgcaaagcatccaccagtggctgtcctgcctcttggaacaggaaatgaccttgcccgttgtctccgctggggaggaggttatgaagggggcagcttgacaaaaatcctgaaagacattgagcagagccccttggtgatgctggaccgctggcatctggaagtcatccccagagaggaagtggaaaacggggaccaggtcccatacagcatcatgaacaactatttctccattggtgtggacgcttccattgcacacagattccatgtgatgagagagaaacatcctgaaaaattcaacagcaggatgaagaacaagctgtggtactttgaatttggcacctcggagacttttgcagcgacctgcaagaaactccacgaccacattgagttggagtgtgatggggttggggtggacctgagcaacatcttcctggaaggcattgccattctcaacattcccagcatgtacggaggcaccaatctctggggagaaaacaagaagaaccgggctgtgatccgggaaagcaggaagggtgtcactgaccccaaagaactgaaattctgcgttcaagacctcagtgaccagctccttgaagtggtggggctagaaggagccatggagatggggcagatctacaccggcctgaagagtgcaggcaggaggctggcccagtgcgcctctgtcaccatcaggacaaacaagctgctgccaatgcaagtggatggagaaccctggatgcagccatgttgcacgattaaaattactcacaagaaccaagcgcccatgatgatggggcctccccagaagagcagcttcttctcgttgagaaggaagagccgttcaaaagactaaacagtgtgccaaacaccagctaaaccaagagagaaagcaagaaactataatgcacactcacacacaatttatgtgcacactcacacatgcacacacacacacacatacacactcttctctaaccagtggaagcaaagccacccttcgggaagaaaacgtcaccttgccatacattctgtttcaacagtgggtacacccctaacagagccagtgccaacaaaacattttgaatggacttagggcccatgaggttgtggctggcttaggcagcaacctccacattcccacaggccttgagcagaattttctgagactgaagggaaatccccctttctttctaccagccctgcaagtttcctcatggacgctcgcgaggagcaggctgcaggtttcctgcctatggtgagatcagatgtggccaagggaaggagctctggttccagagaatttgcacaaagttccctctgtacagagacaaaacggcctccggctctcagagcataatccttggcagggctcagcaggcgcacgttggtttcttggtcgtcctttgagtgacaacttctccgtgaacctgctgaagaggcagaaaggctgtggaaagctgtatttccattcttgggtttctgcgccgtcggtgggcacttgttattttccaggaaccttctcctggtgtctacatgtttgcttagaggcggctccaagagcccccagagctgcctgcatagcacaccttagatgtggtatttattttcttagttctgtgaacacctgggagggagagcggagaaactgggatttatttttcaaattggtgtcataatattgtgtaaaaagggaaggaaaaaaaaaaccacccccagcttctttctttttcaagccaaagcgtgtttcctgtttgagttccaagccctggtggcagactattcctgaaggcagaaaagatgggaaggaaggaactttgctggggaaaccaggagacggttccctcctgcttctttgcactcaccactcccagagtatgacctgaaggaccttctgatggtcttaacgtgtgtgcgcgcgtgtgtgtgtgtgtgtgcgtgtatatatatatatttagcctatatatttatatatatatatatataaatatttatttactgatggacttttcctcattggaaaaaaaaaacataggtagtatgagacagaaagtggtaaggaaaaagaaggttctcactcccccactccaccgtttcattgtcaggacgcatctccctgtggtgatcacaagggttaaggggaatgaaagtagctccctattatgaacgaagagaccgagaactcctattctggatcctcaaaacaagcatgaaagacctgctgggctggatttactctcccatttgtcagataagaaaattgagtctcagaaaagttcagagacttttccatggtgtcttggctaatgcagcttgagagtaggtgccgttacaaagatatttaatggagaaaagaacccacacatctcagagtagggtcatttctggtcactgaaaagtgagtccacttggatccaggttgccagggaggaacaaacgtacagcacatgcgtggatgggatatccccacacaagaaaacgagcgcctcatgctgcttcccagaggttctctctgacctgaatggaaaagaagttggtctgagatcgaaggtactaaacagatcatcagactgaactctccacatgtcacctcatcatggtcatcatagtctcttagtttggaaacaaccttggctgcagggatgacctcagtggagagtcacaagaaggactgaggcgtcttctgcaagatactgccagccaggacagaggggtctcagcagagctcagtgggcttcattcagcaagtgccagcattaccatcctttcccaagggcaaggccatgcagagcttcattgggcctccatccctctctgagatttatcagtggaaacttggacccacttgatatcgttccactgagctgcctctaatcttgcattggacaggagctttggacaaagaagggaatattaagattgtgtgtacaaatggcacttaactgtgaaggaccacctaggagcaagatcttggaccattctgctcaacctaacagtgcagaatgctaagtaaggggaaaaccaggccacctgaagaatatctttaatgatggtattcttggtgatgggaccaacaagctccagaattactacaggtactatcttggaagccacttgtttctgaaactgaggcaggttcaggtttggggtcactgattctaagacatttacagaagttcgtgcatgtgtttcagccatgatccccaagattgaggctattgagacatggcactatcaacaggtgaaattgattctcagagactcacaggtctcatgaaggggcagtgcagaaaatggcccttacctgctgcaccctagtgcacaggacttgcaatgttgcttgagagacatatcccaagtccttcttagaggcatggagtataacaacttcagtggaattgcacttccagtttggtaaccttagtaaatcttgtgttgttgtttaatcgtgccttgcaaatcatcctttaaacactatgactgtggtttcttgtggtggagtccctcatcatagtgaccctcatagcaacctctgaggttagcagagaaggtattattatctcgatctcaatgaggagaacaaggcttaatgaggtttagtgacttctcaaagccacatggttagtcaggggagaacctaatcccttatttcttatcttattctgattctggccatgctacaaacatgttctcacctgccccccatgcttctaccccaacagcaataaaaactgtaaagcaggaaaaaaaaaaaaaaaaaa

SEQ ID NO: 11 - DNA, 7003 bp, Homo sapiens
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgaaacaagtgtgaaggaaaatactatgaagtacatggaaacacttaagaataaactgtgcagctgcaagtgtccactgcttgggaaagtgtgggaagctgacttggaagcttgtcgattgcttatccagagcctacagctccaggaagccaggggaagcctgtctgtagaagatgagaggcagatggatgacttagagggagctgctcctcctattccccccaggctccactccgaggataaaaggaagacccctttgaaggaatcttacatcctttctgcagaacttggagaaaagtgtgaagacataggcaagaagctattgtacttggaagatcaacttcacacagcaatccacagtcatgatgaagatctcattcagtctctcaggagggagctccagatggtgaaggaaactctgcaggccatgatcctgcagctccagccagcaaaggaggcgggagaaagagaagctgcagcttcctgcatgacagctggtgtccacgaagcacaagcctgaggagtgacgggatgggggagggaggtgggccaccatgtttggacccggggggctgctcttccctcccccgccatagctaagatgcctgaatcaattacggagatacagagccttgaggtctttcagtggaaaggtggttcatgttcattctcatcagtgtgaaactgaggagtctgcaatttggaatatggagagagagactgatttgctgaatttccttctaaatgtcactcaaaaatttcttttccatgtcattcttgggaatgtcttccacaggatttgagaatagtttcatctcagcccccattagagagaagttggggtgaattctggaaaaatgtctctttttcctgtgccatttgccttctgctgcaacgaaaatatttcctgattcaagattctataaaaaggaaaccaagcataagactctgtcatcatacctgttacacgttcctacaggtgcacaatctaagagagctaattaacctcagagtctggagttaacagcttttcaccttacttctcctgtgatctaatattatcttagaaaaattaatatgcaatttccaaaagatattttggtaagacaacaacctcccagtgatatgccacctttcaattttccttttgtggcaatgattgcatctgaagaaaggatccctgagagtctctgtttcatcaggacattctgaaatttacccacagtgaggctgtggatggatcaggggacctgtataaaatgtttgagcctgttccattttcccgtggaacctgtttcactcaatgccaggcagtgcagcatttaggaaagcagtgcagtactcagtaaggcagtgcagtactcagtaacacaatacagtactcaggcagtgcagtactcagtaagacagtgcagtgctcagtaaggcagtgcaatactcagtaacagtgtagtactcagtaacagtgaagtactcagtaatacagtacagtattcagtaaggcagtgaagtactcagtaatacaatacagtactcagttaggcagtgcagtactcaggaatgcagcacagtactcaggcagtgcaatactcagtgcggtactcagtaacacagtgcagtactcagtaacagtgcagtactcagtaacagtgcagtactcagtaaggcagtgcagtactcagtaacacagtgcagtactcagtaatacagtacagtactcagtaaggcagtatggtactcagtaaagcaatgcaatgctcagtaacacagtgcagtgctcaataaggcagtgcagtgctcagtaaggcagtgaattgcttagtaacacagtgtagtgctcagtaggacagcatagtactcagtaacacagggcagctagtactcagtactataagtactgagtacttatataggcaatgtagtactcagtaaatcagtgcagtactcagtaatgcaagggcatttcaggctcctgctgggctgcttctttggcccagctgggactcctattgagacagctgcaaaacaggctgatttcaattaggcagcacttcccaaagtgcactgaggaaggtggccccaagagaagctctctaaacaaaggagtaccctctctggtcaagtacctttggtaaatacaccataccataatatctgcttggagaaccacaatgcacattagcatattagtctgagagagaacttatagtaaggaaactcacttgattttatctaacctcaaactttccaagtttaatggatcgtgaatttttttcatgtaactcctattcatatcccatagatctagtattgtacagcactgcattctctgaggaagtcccagtccaaactctgatttacatcactttagaaaccacactcacacttttgcagagtgttgagcttaataactacctgccacagattggtaaatttaatccagtggttgttctgtttgtgcttctgttctcatttatgtgtttagggatagtgaggttcctgccttcactaggatccacggatatgagaccatttttgtcatttcctgaagtcacactggcgtttccagaaggcatctggtgctttgctcagccttccatgctgtgcagcacttctgtcctcagtcaaggagatggccatgcttaagccagcaattggctggggtccaggaaacaaagcaaaagcacaatatgtgaatgtgctgattgtgttccctatggctttatctcgagcaaaatacactctacatattttaataataagtataattagcttgttcctggacttcattttcaatgatgaaccaaattcctgaattatttataattgtgtctaaagaaaattatgaactggtcacatggcacttggaatccttgagttaattccagtgaagcaaaacttgggaagagtcaggattggccacattgccaataacaaattcctacttcgacatatgtcttttcaaaaagcctcccagacacaagacatcttaaccgtcactagcccaagtgttttgtattactcagacaccatcatgaaataattctgtgaggtcatgatgtatttgaaaattctgcaagttaataactgccttgaattgtttgaacccgaaataagggttctttggtacctctagtagatagtgtgttcatttccctgctgcaaattttgaagtatttgggcaggtgagtcatgttttaaccacaagccataactcatctgttgtctttgcttggtcttagagtatcattcagaaagtccgctaagggccagcgtgcttcttctggctacacaaccttctcaggacaagcccactgtcttaagccactttgaccctgggagacacaggactgtgtatcctcaatcatactatacagcagtttttgtcaggggaacataaaaatatccaagagaggttagggcttagatttaaaagcatcaaaacaacaacaatggaaatttatgttggcgatagccaagaccacaagcaaaagcacatactggaaatgatgagttagaatctgatttgactgggatgttttatgagaatgtaagtgtgatattatactgtctgccttgctggaatgctggctttcaaatggtcacccatttttctttcactggcctgagttaggacatgctatcagtaatagtcccagttccatccaactttctgaaatttcatttttttttttgagatggagtctctctctgtcacccaagttggagtgcagtggccccgcaatctcggctcactgcaacctctacctcccaggttcaagctattctactgcctcagcctcccaagtagctggggttacaggcatttgccaccgggccctgatgatttttgtatttttagtagagacagggcttcaccatgttggctaggagggtctcaaactcctgacctcaggcgatccacccccacctcggcttcccaaagtgctgagattacaggtgtgagccaccgcacccggccaactttctgaaatttcaaaactgaattgatccttctccaaattagtatatactattggaaacttgtctttccctgcagtaaggctggtttccccaccccagaaacatgtaacggttggtaccatgctaagcccttgccatgctaagccctttacagtcatatcctataatccccatatcaaccttataaggaaggtgtttgtagatgatgcaactgagccttaagaggactaattccctttttctaaggcacagagctggtaaaatgtgaagtaatagtgaacctaacagtcagagacaggcagcatgctcttaactagtgctcttcctaaagttcctttaatgtccttttgagattttgagccatggaacttacttgttcacctggctaagaactcatggccactgtggaaatcttggttagggagtcaaagaaactgagcctggggcaaacgaggcttcccacactgccaggggagcctcactgtgaagtctaggctcagacaggcatcaacaaacctattcaccccaccatcatcctgatctaaccattccccagtcatcccaggaaaaccactcacagcctgacactgggctgactttcttgaagatcctcatccaattggtgtttttcagaagtgttccaatattatgaattctgtgttgtggagaaaagcaaccatgcatttactggtcaatgccttcttgtatatgtaattcaatacttttacttttaatatcctcaccttatctaatctttgaattttgtcatgtaatttattgcttcattaaggttactttttgttatacaaaataaaagctgatatccaaggcatggtgcatcttgatgattttttgtcctttgaagtatggatgatagaaaaatgtatcaggtttattcatctcatctttctgttacaggatgattaattgtacagttacatcacacgaaacatttataataaagtcatgctttagaaaaaaaaaaaa

SEQ ID NO: 12 - DNA, 2230 bp, Homo sapiens
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatggatataagtactgtgatgcagagtcctggacacagagaagtcagcaacttgcctgaggacagcctgcaggacacagcactgtgatttgaacccagagagtctgacttcagcccccagcgctcaactactattaattgaaagggcattgaagagacatgatgtcacaataaaaagaaaaaaagaaaaaaaaaaaaaa

SEQ ID NO: 13 - DNA, 7069 bp, Homo sapiens
ggaaggagcaggaggcagcccaggcggagcgggaggagctggcagcggggcgcatgccaggcgggggtcctcagggcgccccagccgccgccggcggcggcggcgtgagccaccgcgcaggcagccgggattgcttaccacctgcagcgtgctttcggaggcggcggctggcacggaggccgggctacatgagaagctcgacagggcctgggatcgggttcctttccccagcagtgggcacactgttccggttcccaggaggggtgtctggcgaggagtcccaccactcggagtccagggccagacagtgtggccttgactcgagaggcctcttggtccggagccctgtttccaagagtgcagcagcccctactgtgacctctgtgagaggaacctcggcgcactttgggattcagctcagaggtggcaccagattgcctgacaggcttagctggccgtgtggccctgggagtgctgggtggcagcaagagtttgcagccatggatagttctgagaccctggacgccagctgggaggcagcctgcagcgatggagcaaggcgtgtccgggcagcaggctctctgccatcagcagagttgagtagcaacagctgcagccctggctgtggccctgaggtccccccaacccctcctggctctcacagtgcctttacctcaagctttagctttattcggctctcgcttggctctgccggggaacgtggagaagcagaaggctgcccaccatccagagaggctgagtcccattgccagagcccccaggagatgggagccaaagctgccagcttggacgggcctcacgaggacccgcgatgtctctctcggcccttcagtctcttggctacacgggtctctgcagacttggcccaggccgcaaggaacagctccaggccagagcgtgacatgcattctttaccagacatggaccctggctcctccagttctctggatccctcactggctggctgtggtggtgatgggagcagcggctcaggggatgcccactcttgggacaccctgctcaggaaatgggagccagtgctgcgggactgcctgctgagaaaccggaggcagatggaggtaatatccttaagattaaaacttcagaaacttcaggaagatgcagttgagaatgatgattatgataaagctgagacgttacaacaaagattagaagacctggaacaagagaaaatcagcctgcactttcaacttccttcaaggcagccagctcttagcagtttcctgggtcacctggcagcacaagtccaggctgccttgcgccgtggggccactcagcaggccagcggagatgacacccacaccccactgagaatggagccgaggctgttggaacccactgctcaggacagcttgcacgtgtccatcacgagacgagactggcttcttcaggaaaagcagcagctacagaaagaaatcgaagctctccaagcaaggatgtttgtgctggaagccaaagatcaacagctgagaagggaaatagaggagcaagagcagcaactccagtggcagggctgcgacctgaccccactggtgggccagctgtccctgggtcagctgcaggaggtcagcaaggccttgcaggacaccctggcctcagccggtcagattcccttccatgcagagccaccggaaaccataaggagcctccaggaaagaataaaatccctcaacttgtcacttaaagaaatcactactaaggtgtgtatgagtgagaaattctgcagcaccctgaggaagaaagttaacgatattgaaacccaactaccagccttgcttgaagccaaaatgcatgccatatcaggaaaccatttctggacggctaaagacctcaccgaggagattagatcattaacatcagagagagaagggctggagggactcctcagcaagctgttggtgttgagttccaggaatgtcaaaaagctgggaagtgttaaagaagattacaacagactgagaagagaagtggagcaccaggagactgcctatgaaacaagtgtgaaggaaaatactatgaagtacatggaaacacttaagaataaactgtgcagctgcaagtgtccactgcttgggaaagtgtgggaagctgacttggaagcttgtcgattgcttatccagagcctacagctccaggaagccaggggaagcctgtctgtagaagatgagaggcagatggatgacttagagggagctgctcctcctattccccccaggctccactccgaggataaaaggaagacccctttgaaggtattggaagaatggaagactcacctcatcccctctctgcactgtgctggaggtgaacagaaagaggaatcttacatcctttctgcagaacttggagaaaagtgtgaagacataggcaagaagctattgtacttggaagatcaacttcacacagcaatccacagtcatgatgaagatctcattcagtctctcaggagggagctccagatggtgaaggaaactctgcaggccatgatcctgcagctccagccagcaaaggaggcgggagaaagagaagctgcagcttcctgcatgacagctggtgtccacgaagcacaagcctgaggagtgacgggatgggggagggaggtgggccaccatgtttggacccggggggctgctcttccctcccccgccatagctaagatgcctgaatcaattacggagatacagagccttgaggtctttcagtggaaaggtggttcatgttcattctcatcagtgtgaaactgaggagtctgcaatttggaatatggagagagagactgatttgctgaatttccttctaaatgtcactcaaaaatttcttttccatgtcattcttgggaatgtcttccacaggatttgagaatagtttcatctcagcccccattagagagaagttggggtgaattctggaaaaatgtctctttttcctgtgccatttgccttctgctgcaacgaaaatatttcctgattcaagattctataaaaaggaaaccaagcataagactctgtcatcatacctgttacacgttcctacaggtgcacaatctaagagagctaattaacctcagagtctggagttaacagcttttcaccttacttctcctgtgatctaatattatcttagaaaaattaatatgcaatttccaaaagatattttggtaagacaacaacctcccagtgatatgccacctttcaattttccttttgtggcaatgattgcatctgaagaaaggatccctgagagtctctgtttcatcaggacattctgaaatttacccacagtgaggctgtggatggatcaggggacctgtataaaatgtttgagcctgttccattttcccgtggaacctgtttcactcaatgccaggcagtgcagcatttaggaaagcagtgcagtactcagtaaggcagtgcagtactcagtaacacaatacagtactcaggcagtgcagtactcagtaagacagtgcagtgctcagtaaggcagtgcaatactcagtaacagtgtagtactcagtaacagtgaagtactcagtaatacagtacagtattcagtaaggcagtgaagtactcagtaatacaatacagtactcagttaggcagtgcagtactcaggaatgcagcacagtactcaggcagtgcaatactcagtgcggtactcagtaacacagtgcagtactcagtaacagtgcagtactcagtaacagtgcagtactcagtaaggcagtgcagtactcagtaacacagtgcagtactcagtaatacagtacagtactcagtaaggcagtatggtactcagtaaagcaatgcaatgctcagtaacacagtgcagtgctcaataaggcagtgcagtgctcagtaaggcagtgaattgcttagtaacacagtgtagtgctcagtaggacagcatagtactcagtaacacagggcagctagtactcagtactataagtactgagtacttatataggcaatgtagtactcagtaaatcagtgcagtactcagtaatgcaagggcatttcaggctcctgctgggctgcttctttggcccagctgggactcctattgagacagctgcaaaacaggctgatttcaattaggcagcacttcccaaagtgcactgaggaaggtggccccaagagaagctctctaaacaaaggagtaccctctctggtcaagtacctttggtaaatacaccataccataatatctgcttggagaaccacaatgcacattagcatattagtctgagagagaacttatagtaaggaaactcacttgattttatctaacctcaaactttccaagtttaatggatcgtgaatttttttcatgtaactcctattcatatcccatagatctagtattgtacagcactgcattctctgaggaagtcccagtccaaactctgatttacatcactttagaaaccacactcacacttttgcagagtgttgagcttaataactacctgccacagattggtaaatttaatccagtggttgttctgtttgtgcttctgttctcatttatgtgtttagggatagtgaggttcctgccttcactaggatccacggatatgagaccatttttgtcatttcctgaagtcacactggcgtttccagaaggcatctggtgctttgctcagccttccatgctgtgcagcacttctgtcctcagtcaaggagatggccatgcttaagccagcaattggctggggtccaggaaacaaagcaaaagcacaatatgtgaatgtgctgattgtgttccctatggctttatctcgagcaaaatacactctacatattttaataataagtataattagcttgttcctggacttcattttcaatgatgaaccaaattcctgaattatttataattgtgtctaaagaaaattatgaactggtcacatggcacttggaatccttgagttaattccagtgaagcaaaacttgggaagagtcaggattggccacattgccaataacaaattcctacttcgacatatgtcttttcaaaaagcctcccagacacaagacatcttaaccgtcactagcccaagtgttttgtattactcagacaccatcatgaaataattctgtgaggtcatgatgtatttgaaaattctgcaagttaataactgccttgaattgtttgaacccgaaataagggttctttggtacctctagtagatagtgtgttcatttccctgctgcaaattttgaagtatttgggcaggtgagtcatgttttaaccacaagccataactcatctgttgtctttgcttggtcttagagtatcattcagaaagtccgctaagggccagcgtgcttcttctggctacacaaccttctcaggacaagcccactgtcttaagccactttgaccctgggagacacaggactgtgtatcctcaatcatactatacagcagtttttgtcaggggaacataaaaatatccaagagaggttagggcttagatttaaaagcatcaaaacaacaacaatggaaatttatgttggcgatagccaagaccacaagcaaaagcacatactggaaatgatgagttagaatctgatttgactgggatgttttatgagaatgtaagtgtgatattatactgtctgccttgctggaatgctggctttcaaatggtcacccatttttctttcactggcctgagttaggacatgctatcagtaatagtcccagttccatccaactttctgaaatttcatttttttttttgagatggagtctctctctgtcacccaagttggagtgcagtggccccgcaatctcggctcactgcaacctctacctcccaggttcaagctattctactgcctcagcctcccaagtagctggggttacaggcatttgccaccgggccctgatgatttttgtatttttagtagagacagggcttcaccatgttggctaggagggtctcaaactcctgacctcaggcgatccacccccacctcggcttcccaaagtgctgagattacaggtgtgagccaccgcacccggccaactttctgaaatttcaaaactgaattgatccttctccaaattagtatatactattggaaacttgtctttccctgcagtaaggctggtttccccaccccagaaacatgtaacggttggtaccatgctaagcccttgccatgctaagccctttacagtcatatcctataatccccatatcaaccttataaggaaggtgtttgtagatgatgcaactgagccttaagaggactaattccctttttctaaggcacagagctggtaaaatgtgaagtaatagtgaacctaacagtcagagacaggcagcatgctcttaactagtgctcttcctaaagttcctttaatgtccttttgagattttgagccatggaacttacttgttcacctggctaagaactcatggccactgtggaaatcttggttagggagtcaaagaaactgagcctggggcaaacgaggcttcccacactgccaggggagcctcactgtgaagtctaggctcagacaggcatcaacaaacctattcaccccaccatcatcctgatctaaccattccccagtcatcccaggaaaaccactcacagcctgacactgggctgactttcttgaagatcctcatccaattggtgtttttcagaagtgttccaatattatgaattctgtgttgtggagaaaagcaaccatgcatttactggtcaatgccttcttgtatatgtaattcaatacttttacttttaatatcctcaccttatctaatctttgaattttgtcatgtaatttattgcttcattaaggttactttttgttatacaaaataaaagctgatatccaaggcatggtgcatcttgatgattttttgtcctttgaagtatggatgatagaaaaatgtatcaggtttattcatctcatctttctgttacaggatgattaattgtacagttacatcacacgaaacatttataataaagtcatgctttagaaaaaaaaaaaa

SEQ ID NO: 14 - DNA, 2565 bp, Homo sapiens
aacggctgcggcttcgggcggccgggtttctccggtctcccaacgccgaggagagcttgtaacaggcgctggagctggcccgccaccgccgcgtcagggacggcgctggagtcctccgttcccctcagcctctgagctgaggccccacaccagagtagggggcggcgcggcacccgtgccccggcatggcgacaccggacgcggggctccctggggctgagggcgtggagccggcgccctgggcgcagctggaggcccccgcccgcctcctgctgcaggcgctgcaggcggggcctgagggggcgcggcgcggcctgggggtgctccgggcgctgggcagccgcggctgggagcccttcgactggggtcgcttgctcgaggccctgtgccgggaggagccggtcgtgcaggggcctgacggccgtctggagctgaaaccactgttgctgcgattgccccggatatgccagaggaacctgatgtccctgctgatggccgttcggccatcgctgccggaaagtgggctcctctctgtgctgcagattgcccagcaggacctagcccctgacccagatgcctggctccgtgccctgggggaattgctgcgaagggatttgggggtggggacctccatggagggagcttctccactgtctgaaagatgccagagacagctccaaagtctatgtagggggctgggcctggggggcaggaggttgaaatccccccaggctccagaccctgaagaagaggagaacagggactcccagcagcctgggaaacgcagaaaggactcagaggaagaggctgccagtcctgaggggaagagggtccccaaaagattacggtgttgggaagaggaagaagatcatgagaaggagagacccgaacataagtcactggaatccctggcagatggaggaagtgcatctcctattaaggaccagcctgtcatggcagttaagactggcgaggacggttcgaatctggatgatgctaaaggtctggctgagagtttggagttgcccaaagctatccaggaccagcttcccaggctgcagcagctgctgaagaccttggaggaggggttagagggattggaggatgcccccccagttgagctacagcttcttcacgaatgtagtcccagccagatggacttgctgtgtgcccagctgcagctccctcagctctcagacctcggtctcctgcggctctgcacctggctgctggccctttcacctgatctcagcctcagcaatgctactgtgctgaccagaagcctctttcttggacggatcctctccttgacttcctcagcctcccgcctgcttacaactgccctgacctccttctgtgccaaatatacataccctgtctgcagcgccctccttgaccctgtgctccaggccccaggcacaggtcctgctcaaacagagttactgtgttgccttgtgaagatggagtccctggagccagatgcacaggttctaatgctgggacagatcttggagctgccctggaaggaggaaactttcttggtgttgcagtcactcctagagcggcaggtggagatgacccctgagaagttcagtgtcttaatggagaagctctgtaaaaaggggctggcagccaccacctccatggcctatgccaagctcatgctgacagtgatgaccaagtatcaggctaacatcactgagacccagaggctgggcctggctatggccctagaacctaacaccaccttcctgaggaagtccctgaaggccgccttgaaacatttgggcccctgaccatccaccaagggaccaccctcttggtgctccatcaccagcttcctgaagggcatttctttcttcaccaccttgtcttgagccctagcctgaggataaaggctgagcctggccatcccagattgcaactgcctccctgttacaggctgcatagggaatattggcttcccagccagcagggaggctcctgggctaagggagctcagctatattttctttttcatttcttttgtttttgagagaaggtattgctctgtcatccaggctggagtgcagtgatgcgattgatcatggctcactgtaacctctgcctcccaggctcgatcctcccatgtcagcctcccaagtagctgggactacatgcacatgacactatgcccagctaattttttattttgtagataatatgctggtcagggctggtcttgaactcctgagctcaagtgatcttcctgccttggcacccaaagtgttgagatttacaggtgtgagccaccacaccaggccagagctatatttccaaaggctgctggccccaggcacactcctcatcaattctcaggctgcagggacaaactttccgatagggctcagtaggatcaagccgacccagagtgggcatgggatgctccaggaggtctggggtaccagtgggctcagatgaagctcttgtgctcatgtatattatgaccttctgtgtttttgtttctgacttgaataatttatcaatggtgttgaataaaagcaagttcaataatgaaaaaaaaaa

SEQ ID NO: 15 - DNA, 5965 bp, Homo sapiens
gccgtccctgcggaccggacagtgcggccggcggccggcggccgggacggagcccccagcccgcgaggagggcgcggcgcaggcggcggcggcgcggcggggaggagcccgggccggaaccagggctgggccgggggcggggacgccggggtccgggagcccgggagccggagcgagctgacgagcgtcgcggaaggaccgggaaggaagagcggagccggagcgagccaagcagcccacaaagtgccatgccccggcggggttgaggcgcgcggcggtcggcccggcgcgctgggaggacgcccgggagctgcgcgacgcggggcggcgcggaagggcagccccggcgggcggcggcgggcccgggctgcgaccggagcgagccccatgccccgcgcgggctgacgggccggagcccgcacggagcggccgggcgggacaggtaccgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccactgaacccggtccccggctcctcctcattctccaaggtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccgggccctgtgtgtgtcaccgaggtgcgggaggggaggagcattaaagctgaaagatcgctctgctcggggagcctgggcagagcagcagcaacgtgagggtcgctgtggtggtggtttctgtgagtggatggaatgagcagccctgcaggggcgctgggcatgtgccctcactgtggacagggcccacccacctccggttcccctgtgcctcctgtcccttccacgcttaaacagggttctctgtcattttcctgttttcttccagagtcccaatcctttgccctagttctttcactagtttgaaatccaagttcttgccagagtgttggagcaaggcagctgatttgctgcagggatggagaggaccaccgccgcagggttcttttacctgtgccaccagctctggagacatccacacccattcccaggtgtccttccaggcccattgtccacgtcttcaagggggctgcctggataggcgtgtgtgtgtgtagtgcccaggtgtggtggtggcatcctgaagcagtaggaccattagtgtgcgtgcacacccacgtggcacactgtgtggtgaccatggtcatcatagtgggctcacggcggaaacgggatcattcaacctatacaaaggggaccctggataggctgcaaggaaagaggccaagggccaagctgctaagccaaagatggcccctgacacctcccccagccccagcacaccagcctgcacctcttatcccgtgttaagtcctggttccccacctgctgcccctcctcaacacagagcccctcccgccgcctcagacccctgtgcacatccccagggcctcagccgtctcattggtctttattttttattttttttaagatggagtttcgctcttattgcccagactggagtgcagtgatgctatctcggctcactgcaacctttgcctcccaggttcaagtgattctcctgcctcagcctcccaagtagctgggattacaggcgtgcaccaccacgccgggctaaatttttttgtatttttagtagagacggggtttctctatgttggtcaggctgatctcgaactcccgacctcaggtgatccgccagcctcagcctcccaaagtgctgggattacaggcgtgagccactgcacccggctctcactggtcttacgccaccttctggacactccctccttgagggcagaaaggagtcccaggcctgtccctagggacaaggcccagggaagagtgtatttggggagcaggggaggggagggtgttgagaaagctgaactggagtcaatcacccttcccacaaatcaccaaactgctggaactctccagccaaatgctgggagaaggacctggagggtgagtctttgctgacctctctctactctcaggcatgtcttttgtccttttcgtccatctatttctgtctgtcgctcactcgccccgctttctctgtctcaccttcatccactctgcaggcctgctccaccacagccctaatcctctggacgcttgtgtagggcctggggtgaattccctgtcccccatggtacctcgagaggggctggggagctcagcttggtctcagagtctccccaccagatactgtttaaaaaagtagcactgatgtgttttgtaatctgcccctcccagccctccgtggaggctgccagggccttgtacggtaaacctagctgcatgtaatctgtggacaatggcattctctacaatgcaataaaaacaattacccatgaaaaaaaaaaaaaaaaa

SEQ ID NO: 16 - DNA, 5959 bp, Homo sapiens
gccgtccctgcggaccggacagtgcggccggcggccggcggccgggacggagcccccagcccgcgaggagggcgcggcgcaggcggcggcggcgcggcggggaggagcccgggccggaaccagggctgggccgggggcggggacgccggggtccgggagcccgggagccggagcgagctgacgagcgtcgcggaaggaccgggaaggaagagcggagccggagcgagccaagcagcccacaaagtgccatgccccggcggggttgaggcgcgcggcggtcggcccggcgcgctgggaggacgcccgggagctgcgcgacgcggggcggcgcggaagggcagccccggcgggcggcggcgggcccgggctgcgaccggagcgagccccatgccccgcgcgggctgacgggccggagcccgcacggagcggccgggcgggacaggtaccgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagcagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccactgaacccggtccccggctcctcctcattctccaaggtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccgggccctgtgtgtgtcaccgaggtgcgggaggggaggagcattaaagctgaaagatcgctctgctcggggagcctgggcagagcagcagcaacgtgagggtcgctgtggtggtggtttctgtgagtggatggaatgagcagccctgcaggggcgctgggcatgtgccctcactgtggacagggcccacccacctccggttcccctgtgcctcctgtcccttccacgcttaaacagggttctctgtcattttcctgttttcttccagagtcccaatcctttgccctagttctttcactagtttgaaatccaagttcttgccagagtgttggagcaaggcagctgatttgctgcagggatggagaggaccaccgccgcagggttcttttacctgtgccaccagctctggagacatccacacccattcccaggtgtccttccaggcccattgtccacgtcttcaagggggctgcctggataggcgtgtgtgtgtgtagtgcccaggtgtggtggtggcatcctgaagcagtaggaccattagtgtgcgtgcacacccacgtggcacactgtgtggtgaccatggtcatcatagtgggctcacggcggaaacgggatcattcaacctatacaaaggggaccctggataggctgcaaggaaagaggccaagggccaagctgctaagccaaagatggcccctgacacctcccccagccccagcacaccagcctgcacctcttatcccgtgttaagtcctggttccccacctgctgcccctcctcaacacagagcccctcccgccgcctcagacccctgtgcacatccccagggcctcagccgtctcattggtctttattttttattttttttaagatggagtttcgctcttattgcccagactggagtgcagtgatgctatctcggctcactgcaacctttgcctcccaggttcaagtgattctcctgcctcagcctcccaagtagctgggattacaggcgtgcaccaccacgccgggctaaatttttttgtatttttagtagagacggggtttctctatgttggtcaggctgatctcgaactcccgacctcaggtgatccgccagcctcagcctcccaaagtgctgggattacaggcgtgagccactgcacccggctctcactggtcttacgccaccttctggacactccctccttgagggcagaaaggagtcccaggcctgtccctagggacaaggcccagggaagagtgtatttggggagcaggggaggggagggtgttgagaaagctgaactggagtcaatcacccttcccacaaatcaccaaactgctggaactctccagccaaatgctgggagaaggacctggagggtgagtctttgctgacctctctctactctcaggcatgtcttttgtccttttcgtccatctatttctgtctgtcgctcactcgccccgctttctctgtctcaccttcatccactctgcaggcctgctccaccacagccctaatcctctggacgcttgtgtagggcctggggtgaattccctgtcccccatggtacctcgagaggggctggggagctcagcttggtctcagagtctccccaccagatactgtttaaaaaagtagcactgatgtgttttgtaatctgcccctcccagccctccgtggaggctgccagggccttgtacggtaaacctagctgcatgtaatctgtggacaatggcattctctacaatgcaataaaaacaattacccatgaaaaaaaaaaaaaaaaa

SEQ ID NO: 17 - DNA, 5926 bp, Homo sapiens
gccgtccctgcggaccggacagtgcggccggcggccggcggccgggacggagcccccagcccgcgaggagggcgcggcgcaggcggcggcggcgcggcggggaggagcccgggccggaaccagggctgggccgggggcggggacgccggggtccgggagcccgggagccggagcgagctgacgagcgtcgcggaaggaccgggaaggaagagcggagccggagcgagccaagcagcccacaaagtgccatgccccggcggggttgaggcgcgcggcggtcggcccggcgcgctgggaggacgcccgggagctgcgcgacgcggggcggcgcggaagggcagccccggcgggcggcggcgggcccgggctgcgaccggagcgagccccatgccccgcgcgggctgacgggccggagcccgcacggagcggccgggcgggacaggtaccgctagagcgacatgatggtggaatctgcctcggagacaatcaggtcggctccatctggtcagaatggcgtgggcagcctctctgggcaagccgatggcagcagcggcggggccacagggacaactgcaagtggcacgggcagggaagtgaccacgggtgcagacagcaatggtgagatgagtcccgcagagctgctgcacttccagcagcaacaggctctccaagtggcccggcagttcctgctgcagcaggcctcaggcctgagctccccagggaacaatgacagcaaacagtctgcctctgctgtgcaggtgcctgtgtcggtggccatgatgtcgccgcagatgcttaccccgcaacagatgcagcagatcctgtcgcccccgcagctgcaggccttgctccagcagcagcaagccctcatgctccagcagctacaggagtactacaagaagcagcaggagcagctccacctgcagctcctcacccagcagcaggctgggaaaccgcagcccaaagaggcactggggaacaagcagctggccttccagcagcagctcctgcaaatgcaacagttgcagcagcagcacctgctcaacctgcagaggcaggggctggtcagcctgcagcccaaccaagcctcggggcccctccagacccttccgcaagctgtttgcccaacagacctgccccagctgtggaagggcgagggtgcccccgggcagcctgccgaggacagcgtcaagcaggaggggctggacctcactggcacggccgccaccgctacctcgtttgccgctccccccaaggtctcaccccccctctcccaccataccctgcccaacggacagcctactgtgctcacatctcggagagacagctcttcccacgaggagacccccggctcccaccccctgtacggacacggagagtgcaagtggccaggctgtgagaccctgtgtgaagacctgggccagtttatcaaacacctcaacacagagcacgccctggatgaccggagtacagcccagtgccgggtacagatgcaggtggtgcagcagctggagatccagctcgccaaggagagcgagcggctgcaggccatgatggcccacctgcacatgcggccctcggagcccaagcccttcagccagccagtgaccgtctctgcagcagactcattcccagatggtctcgtgcaccccccgacctcggccgcagcccctgtcacccctctacggccccctggcctgggctctgcctccctgcatggtgggggcccagcccgtcggagaagcagtgacaagttctgctcccccatctcctcagagctggcccagaatcatgagttctacaagaacgccgacgtccggccccccttcacctacgcctccctcatccgccaggccatcctggaaacccctgacaggcagctgaccctgaatgagatctataactggttcaccaggatgttcgcctatttccgcagaaacactgccacctggaagaacgccgtgcgccacaacctcagcctgcacaagtgcttcgtccgcgtggagaacgtcaagggtgccgtgtggactgtggacgagcgggagtatcagaagcggagaccgccaaagatgacagggagccccaccctggtgaagaacatgatctctggcctcagctatggagcacttaatgccagctaccaggccgccctggccgagagcagcttccccctcctcaacagccctggcatgctgaaccctggctccgccagcagcctgctgcccctcagccacgatgacgtgggtgcccccgtggagccgctgcccagcaacggcagcagcagccctcctcgcctctccccgccccagtacagccaccaggtgcaggtgaaggaggagccagcagaggcagaggaagacaggcagcccgggcctcccctgggcgcccctaaccccagcgcctcggggcctccggaagacagggacctggaggaggagctgccgggagaagaactgtcctaagggcctgtagtgaccggcagggctggggtgagacccctcccttccagaatccaggccccatctcccccaactccacagcccctcccgagcctcaaggcaagtccaggactcagaccggggaggcccgggccagcagctcccagtgtgacctgacaaaaacacgtaggggcagggacggtccccacccccagggacacaacccctggtcttggaccagtagaggacacggagggttcagacccctcctcagaccctccccacatctgaaactgcctccccccaaccaccagcagcagcagggccctcctcccccaccagctctccccacagggcccctcagcatcatggagacccgcaggcggggcttagccacccctcaaacccagggccccctggcacctggctctggccgtgttttctggccagaggcccccactttcctaactcgtgctcccttccgccttcttttccgtactgtgaagaaagaactctccaccccagctcccaccctgccctggcctgggtggaggaactgtgcctccatccccagaagaaacagccccctctgctgctggggtgggactgtctgtgtgccctgtgggggtccgtgtgagcaggcccacctggctccagacccgcccccaacctgagacagaaccaggctgagccaggcctccacccccacccccgtttgctgggggctcctccagccgcccccatgggaagaggcctggtaccgcctcacccacagaggtctgtgccaggtgcgcttctgcaggtggagccaagctctccctgaggccagaggcggggcctgggccgggagcccaggggaaggccaggctggaccccggctccacacccacatccagcctgcaggcctctctgcagtcctctcaccctccctcagctccccttcctctgcagtcaccctcagctccccttccttgcccgcctctccccccgccgccccaccagttaaacggatgaccaaagacctttcttatgccggaagcaaaaaccaaaactttttgttggctttttcctttgtcgcctccccagcacctgccctcccagtctcccaccccggccccaggctggaagccctccctccacttaagttattgttttaaaccaaagtttacagtgtctgttggtggccaagaccttctctctccacccctcctccatccaccctgaggaccctggggctcagtggaggcagggccctgcccccctcccttccgctcctgcccagcctgggggaaggagaaaggaggggagaaagcgggctctcaccccctcaggagtgggcacgggagcccttctccctgaccctgggctgcttcctgggggctctccagacccctctctaggaccaagtcacccgtcgtgctgggagtgtggattctagcaaaagagctggaaaaaagtcagactctccacagaccccctatgggggacccccaactcaaggccaaggactgggcgtatcggatgctcataacacccctggcctggcccctttactgagaagactccttggatatttcccaagaaccccccacatacacccctcacaagccacccctcctgagaggcagggggccctccgccccctccccatgtattccccacctgtgttccgtttgaccagcacagaaatattaaacgtcctctattcaccgggccctgtgtgtgtcaccgaggtgcgggaggggaggagcattaaagctgaaagatcgctctgctcggggagcctgggcagagcagcagcaacgtgagggtcgctgtggtggtggtttctgtgagtggatggaatgagcagccctgcaggggcgctgggcatgtgccctcactgtggacagggcccacccacctccggttcccctgtgcctcctgtcccttccacgcttaaacagggttctctgtcattttcctgttttcttccagagtcccaatcctttgccctagttctttcactagtttgaaatccaagttcttgccagagtgttggagcaaggcagctgatttgctgcagggatggagaggaccaccgccgcagggttcttttacctgtgccaccagctctggagacatccacacccattcccaggtgtccttccaggcccattgtccacgtcttcaagggggctgcctggataggcgtgtgtgtgtgtagtgcccaggtgtggtggtggcatcctgaagcagtaggaccattagtgtgcgtgcacacccacgtggcacactgtgtggtgaccatggtcatcatagtgggctcacggcggaaacgggatcattcaacctatacaaaggggaccctggataggctgcaaggaaagaggccaagggccaagctgctaagccaaagatggcccctgacacctcccccagccccagcacaccagcctgcacctcttatcccgtgttaagtcctggttccccacctgctgcccctcctcaacacagagcccctcccgccgcctcagacccctgtgcacatccccagggcctcagccgtctcattggtctttattttttattttttttaagatggagtttcgctcttattgcccagactggagtgcagtgatgctatctcggctcactgcaacctttgcctcccaggttcaagtgattctcctgcctcagcctcccaagtagctgggattacaggcgtgcaccaccacgccgggctaaatttttttgtatttttagtagagacggggtttctctatgttggtcaggctgatctcgaactcccgacctcaggtgatccgccagcctcagcctcccaaagtgctgggattacaggcgtgagccactgcacccggctctcactggtcttacgccaccttctggacactccctccttgagggcagaaaggagtcccaggcctgtccctagggacaaggcccagggaagagtgtatttggggagcaggggaggggagggtgttgagaaagctgaactggagtcaatcacccttcccacaaatcaccaaactgctggaactctccagccaaatgctgggagaaggacctggagggtgagtctttgctgacctctctctactctcaggcatgtcttttgtccttttcgtccatctatttctgtctgtcgctcactcgccccgctttctctgtctcaccttcatccactctgcaggcctgctccaccacagccctaatcctctggacgcttgtgtagggcctggggtgaattccctgtcccccatggtacctcgagaggggctggggagctcagcttggtctcagagtctccccaccagatactgtttaaaaaagtagcactgatgtgttttgtaatctgcccctcccagccctccgtggaggctgccagggccttgtacggtaaacctagctgcatgtaatctgtggacaatggcattctctacaatgcaataaaaacaattacccatgaaaaaaaaaaaaaaaaa

SEQ ID NO: 18 - DNA, 1142 bp, Homo sapiens
ttggccctgacctcgttggaaaacgaagctccccgcagggtcccggcctctagggctgctgtgcgggcgggggtggcctggagctatttccattcggcggcgggaacaggtgccggcgcctccgccccatccccaggggccgcctcccccggggcggcctccaggctgccgagacctataaaggcgccaggttttctcaatgaagccgggacgcactccggagcgcactgcgtggtcgcaccctacccgggctgccttggaagtcgtccccgccgcccctccgcaccggcatgaagctcatcgtgggcatcggaggcatgaccaacggcggcaagaccacgctgaccaacagcctgctcagagccctgcccaactgctgcgtgatccatcaggatgacttcttcaagccccaagaccaaatagcagttggggaagacggcttcaaacagtgggacgtgctggagtctctggacatggaggccatgctggacaccgtgcaggcctggctgagcagcccgcagaagtttgcccgtgcccacggggtcagcgtccagccagaggcctcggacacccacatcctcctcctggaaggcttcctgctctacagctacaagcccctggtggacttgtacagccgccggtacttcctgaccgtcccgtatgaagagtgcaagtggaggagaagtacccgcaactacacagtccctgatccccccggcctcttcgatggccacgtgtggcccatgtaccagaagtataggcaggagatggaggccaacggtgtggaagtggtctacctggacggcatgaagtcccgagaggagctcttccgtgaagtcctggaagacattcagaactcgctgctgaaccgctcccaggaatcagccccctccccggctcgcccagccaggacacagggacccggacgcggatgcggccacagaacggccaggcctgcagcgtcccagcaggacagcatgtgagcgtttccctatgggggtgtctgtacgtaggagagtggaggccccactcccagttgggcgtcccggagctcagggactgagccccaagacgcctctgtaacctcgctgcagcttcagtagtaaactgggtcctgtttttttaaaaaaaaaaaaaaaaaa

SEQ ID NO: 19 - DNA, 4617 bp, Homo sapiens
agatttaagtaagtcttccccaacaccgaatgggattccatcttcagacccagccagcgatgccatggaccccttccatgcttgcagtattcttaagcaactcaaaacaatgtacgatgaaggacagttgacagacattgtagtggaagtggatcacgggaaaacattttcctgtcatagaaacgttcttgctgcaatcagcccttacttcagatccatgttcactagcggccttacagaaagtactcaaaaagaagttcgaatagttggtgttgaagctgaatcgatggatttagtgttgaactatgcctacacttccagagttattcttacagaggccaatgttcaagccttgttcactgcagctagcatcttccagattccttccatccaagaccaatgtgctaagtatatgatcagtcatttggacccacagaattctattggggtctttatctttgctgatcattatggtcatcaggaactcggagatcgatcaaaagaatacattcgtaaaaagtttctgtgtgtcaccaaagaacaagagtttctccagttgacaaaagaccaactgataagtatactagacagtgacgatttaaatgtagaccgagaagagcatgtttatgaaagcattataaggtggtttgagcatgaacagaatgaaagagaagtgcaccttccagaaatttttgctaaatgcatacgttttcctctgatggaagatacctttatagagaaaattccacctcagtttgcacaggctatagccaaaagctgtgtagaaaagggaccatccaacaccaatggctgtacacagaggcttggaatgactgcttctgaaatgatcatatgttttgatgctgcccacaaacactcaggaaagaagcaaacagtgccttgtctagatatagtcacaggaagggtgtttaaactatgcaaaccaccaaatgacctgagagaagttgggattcttgtatcaccagataatgacatttacattgcaggagggtacaggccaagcagcagtgaggtctccatcgaccataaggcagaaaatgatttctggatgtatgatcattccaccaatagatggctatccaaaccatccttgcttcgagccagaataggctgcaaacttgtctattgctgtggtaaaatgtatgcaatcggaggtcgtgtttatgaaggtgatgggagaaactcactaaaatctgttgagtgctacgacagtagagagaattgttggacgactgtttgcgcgatgccagttgcaatggaatttcataatgctgtggagtacaaagagaagatctatgttttacagggagaattttttctcttctatgagcctcaaaaagactactggggtttcttaacccccatgactgtgcctagaatccagggcttagcagctgtatacaaggactctatctactacatagctggaacctgtggaaatcatcaacgtatgtttactgtagaagcctatgatattgagctaaataaatggactcgtaagaaagactttccatgtgatcagtccataaatccataccttaaactggtacttttccagaacaaactccatttatttgttcgagctactcaagtgactgttgaagaacacgtcttcagaaccagcagaaaaaattccctttaccaatatgatgacattgctgaccagtggatgaaagtgtatgagaccccagatcggctctgggaccttggccggcattttgaatgtgctgttgctaaactgtatcctcagtgtcttcagaaagtactctaaatgagtagcaggccttagtgcatcactggcatctcattcttaggaaacttgtctttgatacaaaagagtgctgacagtatttcagaaagctgagagagttttatacatggaaaatgggtatgcttaaagattgcagggtagggagggattttccttcatccttgtgacatttcatttcagtaaggaaaagataacaaagtgcaattatcagcatttttttttcctggcataaaattaatcatttcattttataattttgtgataaatagtaactgaggtaccagatgaatcaggacaactatgcactcttataagagcatttagggtattattgggtaaagacgtctaaacttgtttgatgtgacttttaattttaaatacgggtaacaatctgaggcaatatcactaggactttagctgtgacctctctaacacagagaagcactaacttagatcctcattcttaatatttatatgtatctatttttgtgtactgttttcaagtgtactgagatttaaatgtgttctattattagagtagatcgaagaaaaaattagtctcagaaagagcttttagtctgattgtttccatttcccatgtaattttaagttaagctaaagttttaaagtggcagttttctgtcgatgactttttcaagtgctaacactgtctcttttgtgaaaatctggaaaagtgctcatattcacaggtggctggtgctagtctaacttaattcatgtgtataactagatggatttaaatggtctgagcctatgcctatctttcaaattggtgtggatttcatggccatagtactttacctgttgaactcttgtgatttcacaagattctctacttatgtgataggagggtatggccagttattcatctaactggactcaatcttagaatagtaggaacattatacccagtttgcactaacatgggccatttgtagcccaaccttctcttccatctacctgtccattcattattggtacaaggaaaggtaacttatttctcttctgcacagagcataatgtgaagttttatacctacttttaaaattctgctttccagaaacaaaattcctgcagtggtctaatttaatgtctttaagtttcatattacaattaaaacctcattttttttttccatttttgcacttaacagtgatgaatacttttacgttggaatcctccttctagctgaaggtgattgaaaaggaaaagagtgagtgaacagaaccatagctttctaggtactaaagcattttttgcatttaactgatgaaatttctaacaatcatcagttaggaatattaacatgaaggataaaccaacttatttgtatacctaaggcaggcatttggatcagtaacatgttttactaagcctagagtaattcgtaaagggtataagcataggacagattttgccctcaatcacaatatttgtattcacttgaaagcaaactggcatggttcgtattttaaaaatcttgcacaaattgtaatgtgatactgtgaaacaaattgaaaacattgcctctttgcatcacatacctcgtttttcagaaactttccaaactgctttacatagacctctacaagtagggaatgttttctgaagcagaagttaaaatggacagcatttctagaattaacattttaaaatctagtcttagctagatatgtggtttcttcttattggtgttgatagtatgtctgtaatctctgtataaactttgtcaacatttttacctccccagttttatcttctgttttgtttttgtttttatcatcatgatgttttggagttattactgtgtattttagaaatcattctttacagttttgcattgctgaggagagagaaaaaacaatttttttgcaagagatgttcatgtaatttatttttgaaagctttgttgaataagatttcctgccgctttttgacaatcttgtgtatttagaaaaatgtattacttgaaaacatgacatagaacattgagttagcaatttacatgggctgtatgttatataagagaatgacatactgtggctaattcaacagtagatttattcttttagcctgcacaacagttgatcttttggctatgacaatttgtatggagggtacgatctaagttaagtgtgtcaaaagcaaggcttaggatttgttatgggagtagaatatatattgaattttgtatgaagaactatttgtttaaattatatagctgggatattttgccactgttaaaatggattcagaagaggtcctagaaaagtaagattagtgacatgtgtgggtttatatttagatatttaaggtgcattttcatagtgtggtaagaccttaagtaaaaggcacaatgggtactacagaattaaaatgtaggtctaacataatgccagttccactttaactttgtttttgcatttgaagaatgtatgtagcactttcctatatatttgtcacacattgaaaactggactgggtataactatgttataggaaagtagaaattgtattctttattttccatctttgttttctgttctacaaagttgatgcttaagcatcaagctgattttattggtcatgagaacaaatggatgtgatcatgaaggaatcagattccctatgtaaagcagtttaaaatggaattcaatgttcagtgctcaggtatgtagtaagtactgtagtcctgtgggggcaaatgtgtagatatttttaaacattttgccataattgcacaattttttgcatttttacctgatgtcattgtttcttataataaaaccttttctgattgaaaa

SEQ ID NO: 20 - DNA, 12715 bp, Homo sapiens
agattcgatcatgtgacagtccggaggccagaaccgggcaggttgcttgaagcgcaggggtttgacaaaaacaaacggtgacggcgccgcggaagggtctatggccgaggcggtgaagccccagcgccgggccaaggccaaggccagccggactaaaacaaaggaaaagaagaagtatgaaactcctcagagggaagagtccagtgaagtctcccttccaaaaacctccagagagcaggaaatcccttctctagcctgtgaattcaaaggagaccatctgaaggtggtaactgattcccagctccaggatgatgccagtggacaaaatgagagtgaaatgtttgatgtaccactcacctccttaactataagcaatgaagagtccctgacgtgtaacacagagcccccaaaggaagggggagaggccagaccctgtgtgggggacagtgcagtcactccaaaggtccaccctggagacaatgttggaactaaagtagaaacccccaagaacttcacagaggtagaggaaaatatgtcggtacaaggtggactttcagaaagtgcaccccaatctaatttttcttatactcagccagcaatggaaaatatacaagtcagagaaactcagaatagtaaagaagacaaacaaggcctggtttgttcttcagaggtgccacagaatgttggcttgcagagttcttgcccagccaaacatggttttcagacacctagagtgaagaaactgtatccccagttgccagctgaaattgctggagaagcaccagctttggtggcagtgaaacccttgcttcgcagtgagcgactctacccagaactcccgtctcaactggaactagtaccatttactaaagaacagctaaaaatcttggagcctggttcatggctggaaaatgttgagtcatatttagaagaatttgacagcatggctcatcaagacaggcatgaattttatgagttgcttttgaactactcacgatgtaggaagcaactgctgctggctgaagctgagctgcttactctgacatctgattgccaaaatgctaaaagtcggctgtggcagtttaaggaggaacaaatgtctgtacagggtatctgtgcagatcaagtgaaagttttcagctatcatcgctaccaaagagtagaaatgaatgaaaatgcactggtggagctaaagaagctattcgatgccaaatctgagcacctccaccagaccctggcccttcattcttatacttctgtgctctcaagattgcaagtggagtcttacatctatgcattgctcagtagttcagctgttctgagatcttcagcaattcaccagcaaggccgagcgtctaagcagacagaaagcattccctctgatctgtgtcaactaaaggaatgcattagtgtcttattcatgttcaccaggagagttaatgaagatactcagtttcatgatgatattcttctctggctgcagaaattggtatccgtgctacaaagagttggctgtcctggagatcacctcttccttctaaaccatattcttcgatgccccgctggtgttagtaaatgggctgttccttttatccagatcaaagtgttgcataacccatcaggggtctttcattttatgcaatcccttgccctgctgatgtctcctgtcaaaaatcgagctgagtttatgtgccacatgaagcccagcgagcggaagccatcctcctcagggcctgggtctgggacttggacgctagtagacgaaggaggagaagaggatgaagaccctgagaccagttggattctccttaatgaagatgatttggttaccattttagcacagttcccctttcatgaactctttcagcatcttcttgggtttaaagcaaaaggtgattatttacctgaaacaacaagacctcaagagatgatgaaaatttttgcctttgccaactcactagtggaacttctggctgtggggttagaaacctttaatagagcacgctataggcagtttgtgaagcgaattggttatatgatcaggatgactcttggttatgtaagtgaccattgggcacagtatgtgagccataaccaaggctcaggattggcccaacagccctactctatggagaaactacaggttgaatttgatgaactgtttttgagggctgtcctacatgtgctgaaggccaaaagacttggcatttggctgtttatgtccgagatgccctttgggactctgtctgtgcaaatgctgtggaagctcttctacctcatgcaccaggtggagagcgagaacctgcagcagctctcctcctccctgcagcccgcccagtgcaagcagcagctccaagacccagaacattttaccaactttgagaagtgtctttcttctatgaatagctcagaagagatttgccttctgactacctttgctcagatggctcaggccagaagaaccaatgtggacgaagacttcataaaaattattgttctggagatatatgaggtatcttatgtcaccttgtctaccagagagactttttcaaaggttggtcgagagcttttagggactatcacagctgttcaccctgagataatttccgtccttctggatagagttcaagagaccattgaccaggttggaatggtttctctatacttgtttaaagaactgcctttgtatctttggcaaccttctgcatctgagatagcggtgattcgggattggttattgaattacaacctgacagtggtgaagaataaactggcctgtgttattcttgaaggactgaattggggatttgctaaacaggctacccttcatctggatcaagcagtccatgctgaagtggctttaatggttcttgaagcttatcagaagtaccttgcacagaagccatatgctgggattctctctgaaagtatgaagcaggtttcatatttggccagtattgttcgatatggagagacacccgagacctcatttaaccaatgggcctggaatttaatcttgaggctaaaactgcacaaaaacgattatggaatacagccgaattgtccagctgttcccttctccgtcactgtgcctgacatgacagagtcacccacgtttcatcctctcttgaaggctgtgaaagcgggcatgcccattggctgttatctagccttatctatgacagctgtgggccacagcattgagaagttctgtgcagaaggcatcccactattgggaattctggtccagtcaagacatttgagaacagtggttcatgtcctggataagattctgcctttattttacccttgccagtattaccttctgaagaatgagcagtttttatcgcatctcctcttgttcctacacttggacagcggtgtccctcagggtgtcacacaacaggtcacccacaaggtggcacagcacctgacaggagccagccatggggacaacgtgaagcttctcaacagcatgatccaggcacacatatctgtaagcactcagcccaatgaagtgggccccgttgctgtgttggagttctgggttcaggctctcataagccagcatctctggtaccgagaacaacctatcctcttcctcatggaccacttgtgtaaagcagcttttcagctgatgcaggaagactgcatacagaaattactctaccaacaacataagaatgccttgggttaccactgtgaccggagtctgctctcatctttggtaagctggattgtggcaggcaacatcactccttcctttgtggagggcttggccacgcccactcaggtctggtttgcctggacagtgctcaacatggaatccatctttgaagaggactcccagctccggagagttattgaaggggaattggtgataaactctgctttcacccctgaccaagctctgaagaaagcccagacccagctgaagctccccatcgtgccatccctccagaggctgctgatttatcgctgggcccaccaggctctggtcacaccttctgatcaccccctcctgccactcatttggcagaagttcttccttctgtatcttcaccgtccgggaccacagtatgggttacccatagatggttgtattggaagaaggttttttcaaagtcctgctcatatcaatttgttgaaagaaatgaagagacgtttgaccgaggtggctgacttccaccatgctgcaagcaaggccctccgtgttccagcagagggcagtgaagggctgccagagagccactctggcacccctggttacctgacttcaccagaactgcacaaggagctggtgaggctcttcaatgtatatatattatggctagaagatgagaattttcaaaaaggagatacctatatcccttctctaccaaagcattatgatattcacaggctagcaaaagtgatgcagaatcagcaggatctgtggatggagtatttgaacatggagcgcatctatcatgagtttcaggagactgttggtctgtggacacaggccaagcttgagtcccattccacaccctgcagtttgtccgtgcagctggacttcactgatcctttgctggctaaagaaagggttttaagtaacttgcggaagcatgaggctccccagcctccccttgctctgcacccgacgaagcctcctgtgccagttatttcctctgctgtgctattgagtcagaaggacgccacccagctggtgtgcacagacctgaatctgttgcaacagcaggccagaaccgcagctcttcgggaatctcagcaggttgctctggatggtgagctgttagacacaatgccaaagcagtatgtgaatcgtgaagaacagaccacactacatttggagtgcagaggcagcagcggtaagaaatgccaaggagccgcagttgtcacggttcagtttgaaggcatgcataagaatgaagccataagccaacagcttcatgttttacggaaggaagtgaagcagttgcaagcagaagctgctaaaccaccatcacttaatattgtggaagctgctgtacatgcagaaaacttgatcacggccttagtgaatgcctacaagttgcagcctacacctgggattcagaaagttggcattagccttttctttactattgtggattacgtcagcgatgagacgcagcgtcatcccccaacaaggcagttctttacttcatgtattgagatcttgggacaggtatttatcagtggcattaaatcagagtgcagaaaagtacttgaaaccattctgaagaacagcaggctctgctccctgctgtctcctttcttcactcccaatgctgcacctgcagagttcatacagctgtatgagcaagtggtgaagtttctaagtgaggacaacagtgatatgattttcatgctgctaaccaagttcgatcttaaacaatggttaagcgccactaaacctcctctgtctgatcgtaccaggcttctggagtccattcacttggcacttactgcctggggccttgaaccagatgaggatattttgatgccatttaatcttttctgtaagcactggacttatcttcttctctaccagtttcctgaccagtacagtgacattctcaggctgcttatgcaaagctccgcggagcagcttctgagccccgagtgttggaaggccactctgagagccctgggctgctgcgcccccagctgccagcagggggcagcgtccaccgagggcgccgtgcttcccagctcttctgatgctctcttgtcagacaagcaggtaatggagactatacagtggctttcagactttttttataagcttcggttatccaagatggactttaaaagctttggtttattctcaaaatggagtccttatatggctgatgtgaagacattcttgggctaccttgtgaaaaggctgattgacttagaaatgacctgtttggcccaagacccaactgccagcaggaaaacagtgctgaaatccctacattcagtaatcattcagctctttaagccatggatcctggttttagaggacaacgaaagcagccaacagcggcattacccctggctagagagtgatactgtggtggcctcaagcattgtgcagctgttcactgactgtattgactcactgcatgagagttttaaagataagctgttgccaggtgatgcaggagccctttggttgcacctgatgcattattgtgaagcatgtacagcacccaaaatgccagagttcattctgtacgctttccatagcacgtaccggaaactgccatggaaggacctgcaccctgaccagatgctcatggaggccttcttcaaagtggaacgaggaagccccaagagctgtttcttatttttggggtctgtactctgtgaagtcaactgggttagtgtgctctctgatgcctggaattccagtccccacccagaaacccgcagcatgattgtctgcctccttttcatgatgattttattggcaaaggaagttcaactggtagaccaaacagattcacctttacttagtctccttggacagacaagctcactttcatggcatcttgtggatattgtgtcgtaccagagtgtgctaagttatttcagcagccattacccgccgtccatcatcctggcaaaagaatcttatgctgaattaatcatgaagctcctaaaagtgtctgcgggcctttctattcctactgacagccagaagcatcttgatgcagttccaaaatgccaagcttttactcatcagatggttcaattcctcagcaccctggaacaaaatggaaaaatcaccttagcagtcctagaacaggaaatgtctaagctcttagacgatatcattgtctttaacccgcccgacatggacagccagacccgccacatggccctcagcagcctctttatggaagtcctgatgatgatgaacaacgcgactattccaacagcagagttccttcggggcagtatccggacctggattggccaaaaaatgcatgggctggtggtgctgccccttttaacagcagcctgccagagcctggcgtccgtccgccacatggctgagactacagaagcctgcatcactgcctacttcaaagaaagccctctcaatcagaattcaggatggggacccattctggtatcccttcaggttcccgagctcaccatggaagagttcctgcaggagtgcctcaccttgggcagttacttgactctttacgtctacttgcttcagtgtttaaacagcgaacagactttaaggaatgaaatgaaagtgctgctcatcttaagcaagtggctggaacaggtgtacccaagctccgtggaggaagaggcaaagctgtttttgtggtggcaccaagtccttcagctctccctcattcagacagagcagaatgactccgtcctgacagaatctgtcattcgaattctgctcttggttcagagcaggcagaacctcgtggctgaggagagactcagctctgggatcctgggggcaattgggtttggccggaagtcgcctttgtctaacaggttccgagtggttgcccgaagcatggctgccttcctttcagttcaggttcctatggaagatcagatccgtttgaggcctggctctgaattacatctgacccccaaagctcagcaggctctgaatgctcttgaatccatggcatcaagtaagcagtatgttgaataccaggatcaaatattgcaagccacccaatttataaggcatcctggccattgccttcaagatgggaaaagcttcttggctcttctcgttaactgtctgtatccagaagtgcattatttggaccacatacgatagttaacactgaggctcttgaaaaacccattgctgtttatgtttacatttaactttgctgttgcacaagtaactttgctcaattgcactgtagagctcagtttggccaatgtgtagttgactgagatgcaagttgggaggcgttagatattagataattttggggtgtgtgtgtgtgtgtgtgtgtgttttcttagctcttaagaccttctggggactctttaagtttttatatttatccacaagagaaacttactaagttccacttgggtgcagagccactcacagttgccgaatgtcccagtcatctcacaagacctccagatggagttctttgtatgtttccacttctgtctctgttttatgtaaatgttccagatctgacaaccttggaagtcactcagtacccttacttttaaaccccatttgtgttcctccaaagtaaagaagtcaattttgaaaaatttctgcatttctcaaatgtggacaaatacaatagttttaaagtattgtttttctcagaagggagataaaaatgccgagttagttaaagtgggtcatgtgtaaaatacgaccacttgatcgtgattatagtgggcagtagagatgatgacaagtcaatttccatccagccgtgtatcctcatggagaagctgcctgtctgaatcaggatggcaagctggcagtctgggaggagcatgttttgcacagatgttttgtttggtccacttggtgaggagtgcagacagggctgcctctctctagtcgggagagtctgtgcattccctcgggccctgaccctagcctcattcacatcacttgcccctgtcgacacctaagtttgcaccctttgatagacaccatgttcgatatctgaaaggctcagtgtcaggagacagagactgagggagactgaagacctgattctctgttccctgcttgttttttaacttcaaactcagatgaagccaatggacctgctgaaacacttgtctgtggaaactgggtcaggtcgggagatctactgaaatttggctttttttccatagccacgtgccttctgttgttgacagttcattcattaccaaagcctgtgtgtaactttgccttgttctgtggccatcttcttgctcatgttatttctcctgggaatgagcagtttgacttctgttcccacgttcctcattctatcagctctagatggattttgcctgcatagctggcttaatatgtctttgtgtatgggtagtctgtagcctgagaatatttacctaaaaatgtctaaacagccaccaagaatgtttataggggtataggaatatagttaacagagtgctaatctctcctcaaatgtccttttggaatgcttcccccaaaattgggaagttggtaggagcttttctttactttgaatttctttacttggacagaacgattctgccttaaagacacgctttgcagctctgataaagaacatccctgtttagtctcttgagttttacaggccacaaaatgtccgtctcagagggatctgtctcagcttttcttatttttgcttctctccgttttcaaaattaatcatcttgttctctgtataagaaaatttgagaagctgtggacaatttaatagtctgatctggcaacagcgatttttgtttggaaatattttgtgttttctttgaggaggatataattactgatatcctaggatgtgaaatttttgagtgacagtatgcacattttaaagaaaattatgattaatctgtataatgttttttggtctgtaaaaattataaaaaataaaatcatttatctttggttgtaactgtttaaaaaccaaattatagggatatcacactatcttgtaaagtgtttcagctgttaaagttgctgtaggtttttatgcctgatgtcatttaatttatttgacattgaacttcattaataatcagagatggtcagtgaaagcgcttcctctttaactctttcttgcttaaccttggaaggttgactcaactcctaggtgtctatgggaaactctgggctaggaacgtgctataaagacactgagctagttcagacatggccatgctgctgtagcctcctgggaaagaagggcggcagagagaccagcccgcctgttggcttgcaggggtaatgagccttggcttgaaaaaattgttggcctccagagagcacggggctgtggtttcagaatcagtgatgggtgccgcacatcaagacgggaatcaagcaagaccaaggccctgtggactgagcagcgtggagggcgaacggctgcaggctccagacttcaccacagggtggccaacagtggcatcgggaccaaataaagatgtctaacagcttcctgggagcaggaggaggcaggattctggttgccatgaaaaacatctctctccctctccatcactccccatgctgcagtgcacaggtgggttgcagaggcaggctgcatcccggaatcatgttgtcccactgcctattaatagaacaagtgaagggcagaatgctggaacacaccagacatagagggagggaggtcctgccagatgtgtctacacaactgtctacatagcatgacagtagcagtggattcgggacccacctgtacatgtttccaaagctccttcctgcacactcgggacctcagctccaaggcgtgactcatttctcagtctcaccatcctttgttggctcagacatcgcatgcctctgccccactggggttgtgtgcctgcgtctctcacttctttgaggttggggaaagcctagtccagaaaatgaaaacccatagaccagcctaacttcctttcaaccaagtgacggcctcctggttcctctcagttcatcatcaaaatcagtgtgtacatgtcatacaagccaagagtgttcatgtcctcgttcctttcaaatgaaggtgatatatactttttcactgagtttttattcctgaaattctttcttctggagcaggaagcaaatgtcctggaatcgtagacttttacagtcagaagggtcattcacgttcatctagtgcccctctcactctgcagggatcctcctgcctctcctctgcccctgtccagtgcctggtggtccagcctgtgatgggcaggcctaggctgccatccgcaggctctgtagttctgctttctattgaaccaagatgtttctacgttgcctattggtcgtggttctgtccagagcagttcaggctggggctgttcacttgcccctccttgaggcagacctttagatattttcagttttcatcacatgtctaacaccacttccaccccacccctcacctcttaggctaaatccaagctaaatcccccaatgtcttttttttttttttttttttgagacgagtctcatctgtcacccaggctggagtgcaatggcatggtctcggctcactgcaacctccgcctcctgggttcaagctattctgcctcagcctcccaaggagccaggactacaggtgcatgccaccacgcccggctaatttttgtattttttagtagagacagggtttcacccagccattgagacaagctggtttcaaactcctgaccttgtggtccgcccgccccggcctcccagagtgctgggattacaggcgtgagccaccgcgcccatctcccctgcaatgtctttagttagaccttttccaccatcatgtctaactgggctacggtttggggaaagtgtccaaattagtccgtgttatcctaaaaggggtgtgccccggattagcagggccagggctagggtgagacaaatgaggcacctggggcatacatttaagttggtgcttgcttgcaggtgccaagagagtgcttccttgggtttacccccgtggtgcctcctttacctcattctggccccagccctggggttagagtcgcaccagtgtggtccaagtggcataattatctccctaaatgcttgggcagcatcagctttcagtagctgtgccccatgggaggcacattaagctagtggcaagttgagactgcagacctcagcttaatatcagttgttgcccaagacagatctcaccccacatcttcatgacaggcctaacaacaaggcactttgcccttaatcctctactactgcctgctcttcattttgggccaactgtacagctcattttgagatagtagctgatcatttttctgatcagttaactttgtcttattaagcaaaatggagaatataatgttgggaaataagtgtgttgattaaaagaaagtatccccttctaccatcttccatttgtgtctgggttgtgctgggtaaagttctagacttactaacgcagacttcattttggtccggtttccacagcatgcctcgggcatcagtgtccaggagtagctgtatttgaggtttccttcactctggtaggttcctgattcctgatgaaaataacttgaaaaaaaaataattatactactgatcctcttttgggataatgaaattgcgaaggaatgttgttgattataacttttattttttaatgtacagatgtactgtctctcattgagcactgatagaatttatttttctttcaatagtttaaaatcacttatgtggagacacatacttaagtgtgttcaactcgttttcttcccacatatctagtgtgacctttaaaaaccacaactttattttggacattaaatgtgcaatattcactacttattcattgttccacatttttcatacttgtacaaagggtaagtttttatataatggtgagaaacaggaagaaatgacaactggttaagtaaaattctgcaaataaactagattcgaatttaatttaaaaaaaaaaaaaaaaaa

SEQ ID NO: 21 - DNA, 10923 bp, Homo sapiens
attcatttcctgagaactgcagagagccgctgagaggctctgcgtgtgcgtgtgcgcgggtgacgccgtgtgtgtgcgagtgtgtgtgtgtgtgtgcgcgcgcgcgtgtgagagagagaaagggagagagagagggggactctgtgtgagggaaagaaaacaatttctcctgctctgcagcttctgttcaggatcaatgtgactctaagaacaaatggatgaatgaatatccatatgaagagaaaaacaataaagaatatcaacacctttgagaacagaatgttaatgcttgatgggatgccggcagtcagagtcaaaacagagcttttggaatctgaacaagggtctccaaacgtccacaactatcccgatatggaagccgttcccctgttgctaaataatgtgaaaggggagcccccggaggactcgttatctgtagatcacttccaaacacaaactgagccagtggacttgtcaataaacaaagccaggacgtcccctactgccgtttcatcctccccagtttccatgacagcatctgcctcctcaccttcttcaacttcaacctcttcatcgtcttctagtcgtctagcctcatccccaactgttatcacatcagtatcttcagcgtcatcttcgtcaacagtattaactccagggccccttgtggcctctgcatctggtgttggaggccagcagtttttgcacattatccatcccgtaccgccttcaagtcccatgaatttacagtctaacaaactgagtcatgttcaccgcatccccgtggtggtacagtcggtgcctgttgtctacacagctgtaaggtcacctggaaatgtgaacaacactattgtcgtgccgcttttggaggatgggagaggccatggcaaagcacaaatggacccccgaggcctatctcccagacaaagtaaaagtgacagtgatgatgatgacctgccaaatgtgaccttagatagcgttaatgaaactggatctacggccctttccatagccagagcagtacaagaggtacatccgtccccagtatcaagggtccggggcaatcgaatgaataatcaaaagtttccttgttcaatttcaccatttagtattgagagcacaagacgccagagacggtctgaatccccagactccagaaaacggcgtatccacagatgtgattttgagggatgcaacaaagtgtacacaaaaagttctcacctgaaggctcaccggaggacacatacaggagagaaaccttacaagtgtacctgggaaggctgcacctggaagttcgctcgttcagatgaactgacgaggcattaccgcaaacatacgggagtgaagccattcaagtgcgcggactgtgatcgcagcttttcccggtcagatcatttggccctgcaccgccggaggcatatgttggtgtgaggaatgctacctgtccagctgagcgtaagagctggatctcttagcggcacccaattcagcagggctgaatccccttcacagtgttaacacaaaagggcatcaccatcccacgatgtctgaaaccagagcaggaaaaagaaggcacacttcttttggtctgaaggtaacccccatcatgactagacgagaaccgtctttacccgggcctgggagctcagtgacataaatgctgaagagacaggcattgttttccgtgctgtgtcctctgccatttaaagatgtttgtagcttgtacattttctgagctgtcagacattttgttattgataccttaaaggtcacctaccacaaattgatggctagagcaagaccttttaaatttggatgaatctcccatcatcccatcccttaacccctttttacagaaattttagttacaatctgagtaagctagaacacacatccaatctgttaccagcaagcagcatgaaagtagaaacgaagaagcagatggagaggtcccattacctgcaaagaaagggcactcaggcagccctttgcaatcgcgatggcagccactagatatcactctcaacttgtcattctgccatgccctgaagaaaaccaacattgaatctttcatttgtttgtcgttgattgtttttgttttgtttcgattctgttttgttcatctgttcgagcagaggggcagttgaagtctcgtcctggtctctgccctggcatggactggcacagaggtgttctgtagttgaataggaagagcctgtctaaaaaactactgccccacttcaaattgcagtgttctgtcacctaggcatcatctcttcctgcccctagtatttgattacaaggaaccaggggaaaaaaactttcttagacacactggcaccaaggtaagaggtggggctgcccaggcaaagtcagtgaacatgaaaactcagacaaagcagagatggaaataatgcgcctcttgaggagaaaagcaataatgaataaaaggactttcctacaataacttcactgaggactcacgttaccaattttcatacttactaaagggattgtaaaaaacaccccagcattttaggtgtcttggttccatttacagcactgaggtaatctttctgctgtttgttgtcctgcttggttgagtaccacaattaaagattatgctccccttttcttgtttgaaaacagttatttggtgactagaaaggcaagggaggcatagccgggaattaactcttcggttaatgggtcagttctccttggaactgaatcagtggaaagagaatgcttcccatagaaagcccgacatggtgctagtttcctctcttggagagccaaggataagtgactctccaataggttcttctataccgatttcattttctaaactgtatcaggacccaggtgtcctgcattggcatctgcagggatattgaacccactcatcctgtgcagaggatgagaggaaggtgttagttccatcagccccataaaattatgaacctttttgcaactaggaacatatacagtaaacaagcaatacatcaccaacgagcattctttcagaaaaattaccatatttttgtccccaccacaagctgggtttttttccagctttctgtggctgaggggctggtgagattttttgttgttattgttgttgttgctagaattttttatagcttagatataaaaggtctccaacaaagacctttgcaatatattttaattacaaacacttgattttgggaattgcacatattaacctcacaatattactagctcatttttaaatgtctggacattctgaaataatttccggttacagaattaccctttttaggatcatcttctaattcagataatcttattctgatgaagcgagaactatgaacgttgaaacaaggacaatttgtgttggatggtattcaaaaggaattttttaaaacattaagcaacagtgtaatgattttcaggtcaaattatggcttcacaaatatgtgctctatattgtctgccaggtctcaaaaattcatcaagcaatttccctccaacaagggctgcagttctagtgataaatagcatctttagctgcacagtctactactcatcaaccagtgggttttttttagcacctggaaagtttttttgtactatatgcaactcctacttcacattgcctgtgaccattcagaatagaaaaaggtctgttgatgcatgccagtgctggttactagtcagtgacagagaacacagagagggacaaacacagccatgaaccccctggcactagtaccagcacctagttggcaagtagtgggtgcatctctcaagtgaagtgtagatttgtatttagtcctgcttgctctcataaaaagagccagttcttttctctgctgaaagatgtcttgagagtattacaggtagacttggtttttagaattcataaaactgacaggcaggggaatcttcctgagtgacagcttggtttaaatttagcacagaactagatgagttgcacttttctaataacataggatggatttggggaagggaacattttccctcatcctctgaaagtggaaaccagactgagatggtaagttaactgataaaacctgtcagcattccatcattttccccttttgacgtatcagtacttctaagaagggatctaagcacaattaagtgaattgagtccctggtctagcctcaggaactgaaacttctttggggcttgtcttgagacgtggcaaattctccttggtgagttttctaaaagtatttccccatggaaaggagaaagtggtttgggacagaaagaaatggaatgtcttcagtcatggaagagcctccatttcatctcatgtccatttctagcctctttcaaaaagcacagtgcatcatgagcaacagaaaagcagtagaatcctaaaggacataacagttgttccgtaactagaagcattctttgattttaaatttgaagctgttcagtttgcagctggggatatgtgcatggttgggaacttatacacatagagccattaactacttaagcagctgcagtagacctgattttctgtttgcagtatagagattgatttcaagggagttacattatttgaaaagttatgactttcagcctttgaggttttaagaatcccttttcatggtctgatcttaagttgtttgaaaaaagattcacgcttctgcatccacctctgccctcattctgtcaattgtgtgtggactctgagaagcctgcttgataacttgtcttaagttctattaaggcagttagactgagatttctaatgacttcaccataaagattatacttctgcctggcgtcgtttctataaaacactataggacatttgttttcaaaagcagttgagtaacagcaacataaaccacattttttaaaaaaatgagcacttttcattcacttgaaagcttaagtgggaaaaaggaagatgattgtcaggggaaaaacttacaaaatgctacagtgtttacaaatgccagttccaggtgattagaaaggccgttttcattatggttcagatttggaatagcttatgcaaagattgtgttcatttttatacaattctttttaactttaaattgccatctgtgttttaaacataattctgcactttggaatcagttcattagaatgataacatttatatggataaagatgcagtattccttattctgtacttgatttattatacttaccaaagctgcaactgaataaatctggtgaggtgaggccttcaaaatgtattaatacgcctttgttatgttgttatgactgcttagaaatgtagccatgatgttgttctaaagatgtcttaacatttatagtgaggattgacagaaattaagcagtgttaagaataccagcatccatgttacagtctgcgtataagggactgaatgtgaggtaactcttatgaatcataataggcccagaaagccttaatattcatagttcataatccagtctcagattttgctcttcaatgttgcctgtaaacttagcaggtaaatgtattctagtataaaacatcattgaccaaatctcttcctttagtttttctgaggtagtgcatcccattaaaaaagtctcttcaattagatttggctttagtttagaaaggggtttggtaagtcatgtcttccatatgacatttctactcatccccacactgccttccacttaacctgtacagacagccccaacacatgcacatgtgtgtacacaactgtatatgcagcagccagtgggctaacaaatatcagcaaagaacttttttaaaaagaatttgtaataatccgtgctgtctagaaatgtgagttacttaccttattaggaaaccggcttataatactatatatgactctgcctgcattttatagttaagaaatgtacataaaaattgctatattttcacagtttcattataatgtctgtttagtaacccatgtccactgatactttaaatatgctaattactgagcaattgcaatagaaatccagattttcataagaaaatgaaatagaaggatactgcatctttaaaaaatagagtgaagatattttactgtattcgtaacatatgtgatagtggaaaaagtattttcaaactcacaaattttacagaggttgtaaatagtttgatgaagtatgttgggaaagagagcttctagttttcatcacaataaaaagaaaaaacttgttcagatatgccttgtatatcttacacacaatgagtgaaattgccatgggaactctgtccaactttgtcagagcatgctcttcgtgttctgttcaaaatagagtggccacttgtcatggtttagccaggatggtttaaaatataatgaagtcattttaagttgcagacaactgattccaaactagtaatgtcttttcctgaaaagggcaaaacagctgcacaggattttgcttgtactaaagaggagcatcttacaattgttctcttttctcagttatctccctcctcaacagagtgtgaacaaccatacaggtgtttattcttgttttattccagggagactgcttttaggtataactacatgttgacaagattaagtgctgtggatatggccacgtgttaaaggaatctatactcgcaataggaataagctaatgcccattttcagaaataaattaaatgctgaaagtgcctgtcagtaaaccttatgaccaatgagatattcctatacttttacacagcaataattcttaataagactgggttttttcctgcacatgtgaacacacacacacatacacacagagagagtaaatacatacacatagtaaatcaaatctgttcacatgcccacaaaaaacgcttttatagctttcaaatatacctaatcttgtttacattaacatttcttaatttgatctttctaacttgcagaacgttaagaacacaaatctgaacattaagtttatcttcagtgaacactattgcatatggtaattataatttccagataaaaagttgactgtcatttgccccaaacttatgaaacagtatgtatgattcaaaaagttttgctcagttaaaaacaccaatttatttggcgcaaaagactgaaggatatttgtttgcttgttcattttatccactcatatcaaacgcacaaattcatctttacatttcttcattcccctttcccctaatatttcctattatcatcttaagaatcattttggaatgaatattgacagaatcatttctccccaaaaagtctgttgaagtaccactgacacttagtaagcctagcctttaaccatctttgcagttagtcctaaaaattaccagatgcacattcagaagctcacaggttttttcctgtaattactgtactgctaaaagtggagtcatggatagaaatatacaatgagactatatgaatagacatgaaccctggaaattctccaaccctgccatctcagagcacaaattcacccaaacaagctactgaggctatcagtaaaattatactcatggagagtcacacatcgggtaagggcaattttaaaagtaggactgtgattaaacattcaggctttagacttccatgatggactcagaccacaggcctcaaaaaaacatccactgttttctcctcccaatgttagaaagaagaaaagggagacggaaatgtaccaggataagggggtaaaataaccaattaagtgtcaaaggaaagctgctgggttccttaatctcactgaagtcaagtcttctgactgggcttcttaccatgtgttgtctgaaaaaactaaagtaccttgaaaggttacacattcagcaaaccatgaagataatagctattctttattaaacactgtgtgccaagcaatagactaggcaatttttagatacgttacctgcaacctgtacaacatttctacactttatggatgggaaacggagacatgggaagtgtggctgagttgttcatggatgtagaaatagtaaacggcagagtaggaaagtgaaaccgcctatctctgacctggaggtctgcctgtatctttcccactccaccacactgcacgtgggtgtcccgaaaccaccttcccagattcctgactctcagtaattttattatggacaacatgcatgagtagtcatcatatttttcaagtgaaatatcgggacatgatataacacatgacttaacaatggtactgaatatttgaaatcaggcctttcccggaaaatcatgcatgaaggatcattataaacaaacaatagcaaccagttgtctccccgaacttgtcacttttctcataaatgtctggcctggagctccaaaatcatccaaatacttagtagcattttagcctgagtacactttctcagttcctcaactctttgtatacctttccaccaatatagacattctagaatctgcttcagatgcatttgaaattttcacccccatggaactagtgattaatatcagagcccactcttgcagttggtaatggggtggcaatcaaacgttcagatgatgataaaggagagataatggataattctttttcagagttctcacttaacagctctgttgtggaatgttttaaatagtcttataaataatttgtttatagtattgttgttagtttaattgaattttatgtaagaagctgtccaacatcagagaaatgaaattcctcccactttctgtgtagaacaaggtctctgacagtattgattcatggaagtactaatggacttagaaaacattaagagaatgtcatttctcatagtgtttctgtttctgaaaatgaatctcctgaattattatctttctccctgttacttggctggggaaagagatagaagctgtataaacaaattctcttccatgctcaaagcaagtgttccatgtgcacaacctgctgcagactggggcccttctcagttaattgggtttcacaagcaataatttctccacaacaaaaaccacaacttgaagtgagttgaaaagagatcaatagtggaaacagtcgcctcagtactttttctttctggatttcatctctagaaatttgaagtgtttgagacagagtccaccctttgtgcaaggcgagaaccaatgaatggactccttgtgtgaattattgcatcttcttccaaagcaggttcatcaagactttcacagagattcatttttgttgagaagtaagggttaataggaggatagaatttggatccaaatctagtgataaaagtgtccaagcaatcaaaaagtaagatattttagggacataccaacatcttccctttctgctaatttcatgctccaaagatatggcaaaaaaaaaaatcataaaaagtgcttttgccctacttgtgttctagttttcccatggcagaattttgtaattacatccagaatatagtgtatattttgttcctcaaactttattacattggatggatattgttgaactggggcactggtgcctatattcaaggctctttcctatcaacgtgtctgtccacgatttgttgtgtttaaagcttcattttgaaaaatcactgtccccctgtggggtagtgactgtattgttttgttcatgtctatgtgggacacattgcatcacatggcaaaccaactctctgtggatgtgagataagtacttataaaaccagcttgaaaacatcgtcttatgtattatgtcatcctgcatcataatgcaattatgtgtatcataacatgctcatttaaaaaaagagaaaccagcaaattcatgtttgtccatagaagaatgtactcagaactttgtgttgtgaaacgatgagaacagaccacctttaagatacccacctgccacttaaaatgacttagttataattagtagtagtctagacgttgttcttggtgtgtgggggtcaattctaacgtcatgttcttttgaataaatctctcagtcatatttgaaaaaaaaatacatgggaataaagaaaaatatcatctttggccaaatcaagcaggcatcttttttcttttccttgacgtttagctcattatacgtggtgattggatcacgagatctgtccgtgtgaaaatacagaaacatcctttagtttacaaaacagttattctaggcttgaagcctctgaacagcaaattgaatagatgggctgcatctgatttgctttatggatgtaattttacaaaacactcttgggtctctgaccccagggagttaagagtgcccagaggaggtcctacacattaaaggataaagccccccagtgatgctggcaagcaaatgtgttgagttcttaaatcttcatttggttttctgttcaggattttaattgcaaatgaatttatttctccagtttatctaaagacctaatttcccaatagtttcctctgcatttatatactctgtagtgtttaggcaaccctgttataagtttattaatattatgtaagtgttgttcttgtatttatgtatagtgtatgtattgtaaatatactcagagcttttttccttttactgtaaaatggtgatttttttgccctatgataatgtaaagggagaccctcctaatgagattctctcagaggatgattattccagtctattctcagagatttaaatgaacaagtgttattgtttttaatggtgtctcagacatattctgttggtgcattgcttttctgtattcaactttcctatgaattgagctgtgaactgaaatagagtttaaacctttaactgtatgcatttgtataattatctgaatgaaggcatgaaggttaaataaagcattttgtatggaacaaaactccctaactgactcagacactttggaaatcatagttattaaccattctaattaaacctttgttatgaaaagttttaaaaaaaaaaaaaaa

SEQ ID NO: 22 - DNA, 849 bp, Homo sapiens
cagctgaactcacatctcccgtcaacatgtcctacaactgctgctctggaaacttctcctcccgctcctgtggtgactacctgcgctacccagcatcctcacgtggcttttcctaccccagcaatctggtctacagcactgacctctgctctcccagcacctgccagctgggttcctctctctataggggctgtcaggagatctgctgggagcccaccagctgccagacgtcctatgtggagtccagcccctgccagacctcctgctaccgccccagaacctccttgctctgcagtccttgcaagacgacttactctgggtctctaggctttggatccagcagctgccgctccctgggctatggatcgaggagctgctactcagtgggctgtgggtccagtggtgtcagatccctgggttatggaagctgtggcttcccttccctcggctatggatctggattctgccgcccaacctacttggcttctaggagctgccagtctccttgttacagaccagcctatggatcaaccttctgcagatcaacttgctgaatttccagaccttttaagcaaagtgtctcagtctctacgtagagctgttatcataggcatttccagcaatgtgagctaacccctcttactactagctcttcatcctttctctggcatcaagtactggctggacaggctagttctttcagactgtgaaattaatgaatgagcaaaatatagagtcaaatgtctataattttgaaacaagtgattcgttatcacgtaagttcatcttataaagtatatggaagttcagttttgtttcacgtaataaattcatttactgttgattcca

SEQ ID NO: 23 - DNA, 1666 bp, Homo sapiens
gacacactgcacagcgaccactgagcatgcctgcaggctccatgtctactacaggctatcctggtgtctgcagtaccacatcatacagaactcactgttatatcccagtgacctcttctgttactcttagctccagtgatttaagccctacctttggacactgcttacccagtagctaccaaggaaatctctggctcctggattactgccaagaatcctacggtgaagcaccaacctgcaaatctcccagctgtgagcccaagacctgcagtaccactggttgtgacccgtcaaactcctctgtgccctgcaactccccatcagcaggccaagtcttcagtgtctgtgaaactaccaacgtcagccccagccccagctgcagcccaagcacccagaccaatgggtatgtatgcaattgccacatacccactcgaaatgcatccaaagcctgccaaaccctccgcaacggttccaactgctttggacaacttaactgcttatccaagagtttccaaactctaaaccactgcagattgagtactttggggtataaaagctaccaaaatccttgcttcatacccagctacgtctcaccattatgttatatttccaacagctgccaaccccaaagctatttagtgagaaattatcactattcaagctacaggcctacgagctgccgaccactgagctatttatctagaagcttcagatctctgagctatatacccagtacctttccacctctgaggtatttgtgcagtggtagcagacctctgaaatgctattgaccaacttccagaatttatagcagctggaaattgcccaatggggaagattctactaagtactagaacgtctaattttctgctgaatctctttattcagcctaagaatcttgttacattaagttcaaatacaactcccaggtttattaaccacagccagtatcacctgctaggttttcttttttctgttgttctgttattgctctttgtactaaaagctgaccctgaaggtaacatcattatttctgagatttattacaatggacttaccgaagagactccatttgaaatacaaccatcaccggctttcttactttggctgtcactgtcacttgtctgacagtgtgattatcacctacctttcctgatgaaatggggcctccatggtttgactgcagattccagcatgcaaattcattcggatggctttgattgtcattaatatttttgtcaactacctaactagcaccttgctaataagccgatagaaaacactatcttgagcataataagttgaactatttcatccttttcttactgattgattgtaagaacaggcaaatagcaatggtgactagagctcaaaaatagaagacttcagcaaatcttctcttccagagaagccataaaacaagattcactggtactcagcttttgttctccatgcctaagaaaaagcctcagaattagctaaagcatgaaaattatttgttgaaagaagaacaaatactgttagagaccctttacaattatgtgtaatctgcgtttaggattctcctatcatcttgccttgccaatttattgcattctgactctggaaaatgtcctagttcttagttaataaacaaatttctgtctggaaaaaaaaaaaaaaaaaa

SEQ ID NO: 24 - DNA, 1172 bp, Homo sapiens
gtcgcattggtttatagatagacgtaatcaatggatggcattgcaaggagcatccagttttatggagggtggaagcctcacttccttggctataataaagagttctgatgcatcttcatacaacaagaggaagagtctgcacgcagaagcaccaccttctagggataaataaagggtcaagctaaggaagggcagaacaaacttcagacactcacttctttgcctcaacttcagcctgctctcacaacctcactatgtcttgccccaactactgctcgggaaactccaactcaggatctctcagaacctcccgccatattcctctcacctccatcgacctctgccctaccagcgtgagctgtggagatgtcctctacttacccactagctctcaagaccatacctgggtcacagacaactgccaagagacctgcggtgaaccaaccagctgccagccggtccactgtgagaccggcaatcttgaaacctcttgcggttcttccactgcttactacgtgcccaggccttgccaaggaagcagttttcttcctgcttctttcttctccagttcctgccttccagtatcctgtagaccacagaggtatgtgtccagcggctgtcgtccactgaggccgctgctcaatagttaccagcccataggagactgtgtgcccaatgcctatcgcccccaattctgcttgtccaagagttgccagccccaaaacctcctcacttctggatgccaaccctcgagttgcttggcctatcgtcctcaaagtcttcacgttgtgtccagcagcctcagacctctggggcctctgttcagtggttgccaacctctgacccatgtgttcagcacgtgtcgtccatcttgctctggactgtgaaaccagcagcttctttgttccagtgaataatcactctgagcatccacaacaaaaattcaaactccatggacttttgcttctttgctagtagcaactgatgtttcttagttttactgtgcctgatctaatgcaagctgcttctctcgcatgttttatcttgttttcatctttccttgacatcaaaaaaattagtttacaatgctattcaatgttgctctggtctgggaagaatgtatttgttttgcactataataaatgcgattaagtccaaaaaaaaaaaaaaaa

SEQ ID NO: 25 - DNA, 6279 bp, Homo sapiens
gtgtgtgtggaggccagtatgaagctgaaaaagcaggtgacagtgtgtggggctgccatcttctgtgtggcagtcttctcgctctacctcatgctggaccgagtgcaacacgatcccacccgacaccagaatggtgggaacttcccccggagccaaatttctgtgctgcagaaccgcattgagcagctggagcagcttttggaggagaaccatgagattatcagccatatcaaggactccgtgctggagctgacagccaacgcagagggcccgcccgccatgctgccctactacacggtcaatggctcctgggtggtgccaccggagccccggcccagcttcttctccatctccccgcaggactgccagtttgctttggggggccggggtcagaagccagagctgcagatgctcactgtgtcggaggagctgccgtttgacaacgtggatggtggtgtgtggaggcaaggcttcgacatctcctacgacccgcacgactgggatgctgaagacctgcaggtgtttgtggtgccccactctcacaatgacccaggctggatcaagacctttgacaagtactacacagagcagacccaacacatcctcaatagcatggtgtctaagctgcaggaggacccccggcggcgcttcctctgggcagaggtctccttcttcgccaagtggtgggacaacatcaatgtccaaaagagagcggcagtccgaaggctggtgggaaacgggcagctggagattgcgacaggaggctgggtgatgccagatgaggccaattcccactactttgcattgattgaccagctcatcgaaggacaccagtggctggagagaaatcttggtgcaaccccccgctctggctgggcagtggacccctttggatacagctccaccatgccttacctgctgcgccgtgccaacctcaccagcatgctgattcagagagtgcactatgccatcaagaagcactttgctgccacccacagcctagagttcatgtggaggcagacatgggactcggactccagcacagacatcttctgtcacatgatgcccttctacagctatgacgtcccccatacctgtggcccagatcccaagatctgctgccaatttgatttcaaacgcctgcctggtgggcgcatcaactgcccttggaaggtgccaccccgggccatcacagaggccaacgtggcagagagggcagccctgcttctggaccaataccggaagaagtcccagctgttccgaagcaacgtcctcctggtgcctcttggagatgacttccgatatgacaagccccaggagtgggatgcccagttcttcaactaccaacggctctttgacttcttcaacagcaggcctaacctccatgtgcaggcccagtttggcactctttctgactattttgatgccctgtacaagaggacaggggtggagccaggggcccggcctccagggtttcctgtgctgagcggggatttcttctcctatgcggaccgggaggatcattactggacaggctattacacttcccggcccttctacaagagcttagaccgagtcctggaagcccacctgcggggggcagaggttctgtacagcctggctgcagctcacgctcgccgctctggtctggctggccggtacccactgtctgatttcaccctcctgacggaagctcggcgcacattggggctcttccagcatcacgatgccatcactggcacggccaaggaggctgtggtggtggactatggggtcaggcttctgcgctcccttgtcaacctgaagcaggtcatcattcatgcagcccactatctggtgctgggggacaaggagacctaccactttgaccctgaggcgcccttcctccaagtggatgacactcgcttaagtcacgacgccctcccagagcgcacggtgatccagctggattcctcgcccaggtttgtggtcctattcaacccactggaacaggagcgattcagcatggtgtccctgctggtcaactctccccgcgtgcgtgtcctttcggaggagggtcagcccctggccgtgcagatcagcgcacactggagctctgccaccgaggcggtccctgacgtctaccaggtgtctgtgcctgtccgcctgccagccctgggcctgggcgtgctgcagctacagctgggcctggatgggcaccgcacgctgccctcctctgtgcgcatctacctgcacggccggcagctgtccgtcagcaggcacgaagcgtttcctctccgtgtcattgactctggcaccagcgacttcgccctcagcaaccgctacatgcaggtctggttctcaggccttactgggctcctcaagagcatccgaagggtggatgaggagcacgagcagcaggtggacatgcaggtccttgtctatggcacccgtacgtccaaagacaagagtggagcctacctcttcctgcccgatggcgaggccaagccctacgtccccaaggagccccccgtgctgcgtgtcactgaaggccctttcttctcagaggtggttgcgtactatgagcacattcaccaggcggtccggctttacaatctgccaggggtggaggggctgtctctggacatatcatccctggtggacatccgggactacgtcaacaaggagctggccctgcacatccatacagacatcgacagccagggtatcttcttcacagacctcaatggctttcaggtgcagccccgacggtatctgaagaagctccccctccaggccaacttctaccccatgccagtcatggcctatatccaggacgcacagaagcgcctcacgctgcacactgcccaggccctgggtgtctctagcctcaaagatggccagctggaggtgatcttggaccggcggctgatgcaggatgacaaccggggcctaggccaagggctcaaggacaacaagagaacctgcaaccgtttccgcctcctgctagagcggcgaaccgtgggcagtgaggtccaagatagccactctaccagctacccatccctcctcagccacctgacctccatgtacctgaacgccccggcgctcgctctgcctgtagccaggatgcagctcccaggccctggtctgcgctcatttcatcctctggcttcctcactgccctgtgacttccacctgctcaacctacgtacgctccaggctgaggaggacaccctaccctcggcggagaccgcactcatcttacaccgcaagggttttgactgcggcctggaggccaagaacttgggcttcaactgcaccacaagccaaggcaaggtagccctgggcagccttttccatggcctggatgtggtattccttcagccaacctccttgacgttactgtaccctctggcctccccgtccaacagcactgacgtctatttggagcccatggagattgctacctttcgcctccgcttgggttagggcttcttgtggcctgaagagaaagttcattcacagagactgcctcttaacatgaagatcattggacaagccacacgggtatcccatcccgatctgcctcccagaactgtgacacactgggctctgccctcattttctgtttattgctgctgctgtgttttcggcgcaacccacaaacccagtgatgggtaaatagggcagacgccagtgagatcagggagagaaggcccttggtcagagtgggcagtgccaggctctgctttgggttgtgagtggacacccaactgggcacaggctcaggcacccatcctttttccaaacagggatatagaagtggtggaagcagacagaagaggtaagggaggctaagtgggtaacagcccagcatcagggtcactgtggcaacagcaggctctaggggaatcctgtggttatgtagagactccatgtcctggtgtgatgagcaggatcagagtgactctgggaggacaggggtggggacccagagttagcagtggggatggagcagtagaaggaatcactgtttctcctaggagtctgaaggcctcgctgctttctgtgatggctttgcagtaagtgccgcctggcctgcatgcattggctaacaggctgcagaatggcaggaaggactcgctagagattgtcatggccagagatcataggtcacttcaggtagcaagacccctggcaaactgggcacttggcctatgtactgatttgtgggatggtggcaggggtgtggggtccttcaccctgcctgaattctctttggcttctgtgctctgtatgctgctgtccccaagggctctttcttattatggcagggagtggggattggtcctactttctttctctggaaaggaaagcctccaagactccatgtgcttgggcagcttgagaaggcgttcagcaccacgcctagcaggcagaccttgaagcctcacctttagtctatctgcagaggtattcagttcctggcacaggggactaggggcatgtagagtatatgaggaggcagtatggctgtgcaggagccttcatttcagcttcaattaatagggaagaatttatgatagctctatagatgctgaaaaggtatttcgtaagatttaaaatccatcccttattaaaactcttagtaaattaagtctggaaagaaacaccctaatctagataaaggtctgtttcagaaaccaacagtgatggcattctaaagagtcagacgccacaggcattcccattaaagtcagaaactagccaagggcaagctattattcagcagtgtcccggcactactaacccctgcaacaagccagatgaggaacataaggaagaattataattgtcattatttgtagacaataaaactgcctacctgtaaaacctaagaatcaactgaagacctgttaagagtattctgtaagtcaacccaatgatacacatcatgttcctgtccacatactggttttccccaaatcagctgataaattcagtgtaattccaatgagattgaaactttggaattgacagttctaaagtgcatttgggagagtgaatgtgtgagaacactaagaccactctgaacgatgataatgagttggggggtggactgctcgggggtgatcctgccagattcccagaggattctcacgccaccattacctcactcagtgtgacctggagggggtcagacagacgggagagtccagaaacagacccagggctacaggaatttagtatatggtaagagggatgttttaagtggggaaaaaggtggattatttaataaacagcacttttagacaactagctatcaaagctagatctcagctgggtgcgatggctcacgcctgtaatcccggcactttgggaggccaaggtgggtggatcacttgaggtcaggagttcgagaccagcctggccaagatggcgaaaccctgtgtctactaaaaatacaaaaactagccaggaatggtggcgcgcgcctgtaatcccagttacttaggaggctgaggcaggagaatcacatcaacctgggaggcggaggttgcagtgagcttagatcatgccaccatgccactgcactccagcctgggtgacacagccaaaaaaaaaaccactaagttagatctctacctcacagtgtccatacaaattagttccagagggaagatataccacaaaattactcaaaaatttttatacctctggtgtgggacggtcttttctaaactttaacatgagacttaaaagatataataagggaaaagataagcagatttcgcaaccaaaaaatatcgaaagtctctgtgtgatggaaaacatcaaggttaaaacacaaatgacagatatggaagaaaatatttgcagcacataaaaaaatcaacgagtacaattactttaggagaaaagcttgcttcagggtccttagagaaagtcactggggcctgccaagctgccacctaaagacaagagtgagagggctgagttcttccaggtcatcagagttgttgctgcccgtattaggccacacagtggaaccccatttatatcatagcagaagaaataggattatcaatgtgaactgcttagcatggtgcctggtatatacgagagctccacaaatgtgagctataatcctactagtaaaggatgctaagcagttccactgtggcaggtgtcatttgctagtagaatttgtaatcaaacaataggaggggaatctgtgaacgcctagaaaatgagcagaataaaggatattatctttggaagtcttaaaaaaaaaaa

SEQ ID NO: 26 - DNA, 2501 bp, Homo sapiens
cgaaaagattcttaggaacgccgtaccagccgcgtctctcaggacagcaggcccctgtccttctgtcgggcgccgctcagccgtgccctccgcccctcaggttctttttctaattccaaataaacttgcaagaggactatgaaagattatgatgaacttctcaaatattatgaattacatgaaactattgggacaggtggctttgcaaaggtcaaacttgcctgccatatccttactggagagatggtagctataaaaatcatggataaaaacacactagggagtgatttgccccggatcaaaacggagattgaggccttgaagaacctgagacatcagcatatatgtcaactctaccatgtgctagagacagccaacaaaatattcatggttcttgagtactgccctggaggagagctgtttgactatataatttcccaggatcgcctgtcagaagaggagacccgggttgtcttccgtcagatagtatctgctgttgcttatgtgcacagccagggctatgctcacagggacctcaagccagaaaatttgctgtttgatgaatatcataaattaaagctgattgactttggtctctgtgcaaaacccaagggtaacaaggattaccatctacagacatgctgtgggagtctggcttatgcagcacctgagttaatacaaggcaaatcatatcttggatcagaggcagatgtttggagcatgggcatactgttatatgttcttatgtgtggatttctaccatttgatgatgataatgtaatggctttatacaagaagattatgagaggaaaatatgatgttcccaagtggctctctcccagtagcattctgcttcttcaacaaatgctgcaggtggacccaaagaaacggatttctatgaaaaatctattgaaccatccctggatcatgcaagattacaactatcctgttgagtggcaaagcaagaatccttttattcacctcgatgatgattgcgtaacagaactttctgtacatcacagaaacaacaggcaaacaatggaggatttaatttcactgtggcagtatgatcacctcacggctacctatcttctgcttctagccaagaaggctcggggaaaaccagttcgtttaaggctttcttctttctcctgtggacaagccagtgctaccccattcacagacatcaagtcaaataattggagtctggaagatgtgaccgcaagtgataaaaattatgtggcgggattaatagactatgattggtgtgaagatgatttatcaacaggtgctgctactccccgaacatcacagtttaccaagtactggacagaatcaaatggggtggaatctaaatcattaactccagccttatgcagaacacctgcaaataaattaaagaacaaagaaaatgtatatactcctaagtctgctgtaaagaatgaagagtactttatgtttcctgagccaaagactccagttaataagaaccagcataagagagaaatactcactacgccaaatcgttacactacaccctcaaaagctagaaaccagtgcctgaaagaaactccaattaaaataccagtaaattcaacaggaacagacaagttaatgacaggtgtcattagccctgagaggcggtgccgctcagtggaattggatctcaaccaagcacatatggaggagactccaaaaagaaagggagccaaagtgtttgggagccttgaaagggggttggataaggttatcactgtgctcaccaggagcaaaaggaagggttctgccagagacgggcccagaagactaaagcttcactataatgtgactacaactagattagtgaatccagatcaactgttgaatgaaataatgtctattcttccaaagaagcatgttgactttgtacaaaagggttatacactgaagtgtcaaacacagtcagattttgggaaagtgacaatgcaatttgaattagaagtgtgccagcttcaaaaacccgatgtggtgggtatcaggaggcagcggcttaagggcgatgcctgggtttacaaaagattagtggaagacatcctatctagctgcaaggtataattgatggattcttccatcctgccggatgagtgtgggtgtgatacagcctacataaagactgttatgatcgctttgattttaaagttcattggaactaccaacttgtttctaaagagctatcttaagaccaatatctctttgtttttaaacaaaagatattattttgtgtatgaatctaaatcaagcccatctgtcattatgttactgtcttttttaatcatgtggttttgtatattaataattgttgactttcttagattcacttccatatgtgaatgtaagctcttaactatgtctctttgtaatgtgtaatttctttctgaaataaaaccatttgtgaatataaaaaaaaaaaaaaaaaaaaaaaaaaaaaaaaaaaaaaaaaaaaaaaaaaaaaaaaaaaaaaa

SEQ ID NO: 27 - DNA, 1079 bp, Homo sapiens
gttcgcgttcgccccgcctcaaaggaagaagagtccaccttgcgaccgtatccgctagcgcggcctgggatgcgcttgggctccctgttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagttggaggacttcatcaacaacattaacagtgtcttggagtccttgtatattgagataaagagaggagtcacggaagatgatgggagacccatttatgcgttggtgaatcttgctacaacttcaatttccaaaatggctacggattttgcagagaatgaactggatttgtttagaaaggctctggaactgattattgactcagaaaccggctttgcgtcttccacaaacatattgaacctggttgatcaacttaaaggcaagaagatgaggaagaaggaagcggagcaggtgctgcagaagtttgttcaaaacaagtggctgattgagaaggaaggggagttcaccctgcacggccgggccatcctggagatggagcaatacatccgggagacgtaccccgacgcggtgaagatctgcaatatctgtcacagcctcctcatccagggtcaaagctgcgaaacctgtgggatcaggatgcacttaccctgcgtggccaagtacttccagtcgaatgctgaaccgcgctgcccccactgcaacgactactggccccacgagatcccaaaagtcttcgaccctgagaaggagagggagtctggtgtcttgaaatcgaacaaaaagtccctgcggtccaggcagcattagccatcgtgccctgctgaggggctggctgccttgagtggcctgatcgccacagcccttcttggaagaaaggcgtccgtgtttcaggttccacgcgagtcacctctttcgtcttaatgttcaccgtccacagctttggaataaaccatcctgggaagttgctgcaaaaaaaaaaaaaaaaaa

SEQ ID NO: 28 - DNA, 990 bp, Homo sapiens
atgcaattagttctattacttatgtttctccttgtctttataggcaatactgcacctgcattctcagtgaccttggaatctatggacataccacaaaatatcacagaatttttcatgctggggctctcacagaactcagaggtacagagagttctctttgtggtctttttgctgatctatgtggtcacggtttgtggcaacatgctcattgtggtcactatcacctccagccccacgctggcttcccctgtgtattttttcctggccaacctatcctttattgacaccttttattcttcttctatggctcctaaactcattgctgactcattgtatgaggggagaaccatctcttatgagtgctgcatggctcagctctttggagctcattttttgggaggtgttgagatcattctgctcacagtgatggcttatgaccgctatgtggccatctgtaagcccctgcacaatactaccatcatgaccaggcatctctgtgccatgcttgtaggggtggcttggcttgggggcttcctgcattcattggttcagctcctcctggtcctttggttgcccttctgtgggcccaatgtgatcaatcactttgcctgtgacttgtaccctttgctggaagttgcctgcaccaatacgtatgtcattggtctgctggtggttgccaacagtggtttaatctgcctgttgaacttcctcatgctggctgcctcctacattgtcatcctgtactccttgaggtcccacagtgcagatgggagatgcaaagccctctccacctgtggagcccacttcattgttgttgccttgttctttgtgccctgtatatttacttatgtgcatccattttctactttacctatagacaaaaatatggcattattttatggtattctgacacctatgttgaatccactcatttataccctgagaaatgaagaggtaaaaaatgccatgagaaagctctttacatggtaa

SEQ ID NO: 29 - DNA, 8788 bp, Homo sapiens
ctccagtctagctcgcattgcggctcccgcccgggcgagttctcgcccccgcgcggccgttgccgaggagacggcgcatgtcccgccgcgcgttgccccctctgcagtacccccgcccctcttctcccaccacaatgagatcctaagatggcggtggctgcggcggttggcgctgcgtagctgaggtcgaaaaggcggccactggggccgaggcagccaggaaacgtgtgggcctctctgctgcggtctccgagggccgaccgctgccggcggcgggtcgtgggggctgactgtcgctctgcctttgacaggagaggctgcttcttgtagaggaaacagctttgaagtgtggagcgggaaaggagcagtttctgagctgcaaaaactagtttctaaacagagagttaattgttaaatccagtatggccacaggaggaggtccctttgaagatggcatgaatgatcaggatttaccaaactggagtaatgagaatgttgatgacaggctcaacaatatggattggggtgcccaacagaagaaagcaaatagatcatcagaaaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagagaagcattggaagtgattcccaaggtagagcaacagctgctaacaacaaacgtcagcttagtgaaaaccgaaagcccttcaactttttgcctatgcagattaatactaacaagagcaaagatgcatctacaagtcccccaaacagagaaacgattggatcagcacagtgtaaagagttgtttgcttctgctttaagtaatgacctcttgcaaaactgtcaggtgtctgaagaagatgggaggggagaacctgcaatggagagcagccagattgtaagcaggcttgttcaaattcgcgattatattactaaagctagttccatgcgggaagatcttgtagagaaaaatgagagatctgctaatgttgagcgccttactcatctaatagatcaccttaaagaacaagagaagtcatatatgaaatttcttaaaaaaatccttgccagagatcctcagcaggagcctatggaagagatagaaaatttgaagaaacaacatgatttattaaaaagaatgttacaacagcaggagcaactaagagctctacagggacggcaggctgcacttctagctctgcaacataaagcagagcaagctattgcagtgatggatgattctgttgttgcagaaactgcaggtagcttatctggcgtcagtatcacatctgaactaaatgaagaattgaatgacttaattcagcgttttcataatcagcttcgtgattctcagcctccagctgttccagacaatagaagacaggcagaaagtctttcattaactagggaggtttcccagagcaggaaaccatcagcttcagaacgtttacctgatgagaaagtcgaactttttagcaaaatgagagtgctacaggaaaagaaacaaaaaatggacaaattgcttggagaacttcatacacttcgagatcagcatcttaacaattcatcatcctctccacaaaggagtgtcgatcagagaagtacttcagctccctctgcttctgtaggcttggcaccggttgtcaatggagaatccaatagcctcacatcatctgttccttatcctactgcttctctagtatctcagaatgagagtgaaaacgaaggccacctcaatccatctgaaaaactccagaagttaaatgaagttcgaaagagattgaatgagctaagagaattagttcattattatgaacaaacgtcagacatgatgacagatgctgtgaatgaaaacaggaaagatgaagaaactgaagagtcagaatatgattctgagcatgaaaattccgagcctgttactaacattcgaaatccacaagtagcttccacttggaatgaagtaaatagtcatagtaatgcacagtgtgtttctaataatagagatgggcgaacagttaattctaattgtgaaattaacaacagatctgctgccaacataagggctctaaacatgcctccttctttagattgtcgatataatagagaaggggaacaggagattcatgttgcacaaggtgaagatgatgaggaggaggaggaagaagcagaagaggagggagtcagtggagcttcattatctagtcacaggagcagtctggttgatgagcatccagaagatgctgaatttgaacagaagatcaaccgacttatggctgcaaaacagaaacttagacagttacaagatcttgttgctatggtacaggatgatgatgcagctcaaggagttatctctgccagtgcatcaaatttggatgatttctacccagcagaagaagacaccaagcaaaattcaaataacactagaggaaatgccaataaaacacagaaagatactggagtaaatgaaaaggcaagagagaaattttatgaggctaaactacagcagcaacagagagagctaaaacaattgcaggaagaaagaaagaaactgattgacattcaggagaaaattcaagcattgcaaacggcatgccctgacttacagctgtcagctgctagtgtgggtaactgtcccaccaaaaaatatatgccagctgttacttcaaccccaactgttaatcaacacgagaccagtacaagcaaatctgtttttgagcctgaagattcttcaatagtagataatgagttgtggtcagaaatgagaagacatgaaatgttgagggaggagctgcgacagagaagaaagcagcttgaagctctgatggctgaacatcagaggaggcaaggtctagctgaaactgcatctccagtggctgtgtcattgagaagtgatggatctgagaacctatgtactcctcagcaaagtagaacagaaaaaacgatggcaacttggggagggtctacccagtgtgcactagatgaagaaggagatgaagacggttacctttctgaaggaattgttcggacagatgaagaggaggaagaagagcaagatgccagttccaatgataacttttctgtgtgtccttctaacagtgtgaatcataactcctacaatggaaaggaaactaaaaataggtggaagaacaattgccctttttcggcagatgaaaattatcgtcctttagccaagacaaggcaacagaatatcagcatgcaacggcaagaaaaccttcgttgggtgtcagagctctcttacgtagaagagaaagaacaatggcaagaacaaatcaatcagctaaagaaacagcttgattttagtgtcagtatttgtcagactttgatgcaagaccagcagactctatcttgtctgctacaaactcttctcacgggtccttacagtgttatgcccagcaatgttgcatctcctcaagtacacttcataatgcaccagttgaaccagtgctatactcagctaacatggcaacagaataatgttcagaggttgaaacaaatgctaaatgaacttatgcgccagcaaaatcagcatccagaaaaacctggaggcaaggaaagaggcagtagtgcatcgcaccctccttctcccagtttattttgtcctttcagctttccaacacagcctgtaaatctcttcaatatacctggatttactaacttttcatcatttgcaccaggtatgaatttcagccctttatttccttctaattttggagatttttctcagaatatctctacacccagtgaacagcagcaacccttagcccagaattcttcaggaaaaacagaatatatggcttttccaaaaccttttgaaagcagttcctctattggagcagagaaaccaaggaataaaaaactgcctgaagaggaggtggaaagcagtaggacaccatggttatatgaacaagaaggtgaagtagagaaaccatttatcaagactggattttcagtgtctgtagaaaaatctacaagtagtaaccgcaaaaatcaattagatacaaacggaagaagacgccagtttgatgaagaatcactggaaagctttagcagtatgcctgatccagtagatccaacaacagtgactaaaacattcaagacaagaaaagcgtctgcacaggccagcctggcatctaaagataaaactcccaagtcaaaaagtaagaagaggaattctactcagctgaaaagcagagttaaaaacatcaggtatgaaagtgccagtatgtctagcacatgtgaaccttgcaaaagtaggaacagacattcagcccagactgaagagcctgttcaagcaaaagtattcagcagaaagaatcatgagcaactggaaaaaataataaaatgtaataggtctacagaaatatcttcagaaactgggagtgatttttccatgtttgaagctttgcgagatactatttattctgaagtagctacattaatttctcaaaatgaatctcgtccacattttcttattgaactcttccatgagctgcagctactaaacacagactacttgagacagagggctttatatgcattgcaggacatagtatccagacatatttctgagagccatgaaaaaggagaaaatgtaaagtcagtaaactctggtacttggatagcatcaaactcagaacttactcctagtgagagccttgctactactgatgatgaaacttttgagaagaactttgaaagagaaacccataaaataagtgagcaaaatgatgctgataatgctagtgtcctgtctgtatcatcaaattttgagccttttgcaacagatgatctaggtaacaccgtgattcacttagatcaagcattagccagaatgagagaatatgagcgtatgaagactgaggctgaaagtaactcaaatatgagatgcacctgcaggattattgaggatggagatggtgctggtgcaggtactacagttaataatttagaagaaactcccgttattgaaaatcgtagttcacaacaacctgtaagtgaagtttctaccatcccatgtcctagaattgatactcagcagctggaccggcaaattaaagcaattatgaaagaagtcattccttttttgaaggagcacatggatgaagtatgctcctcgcagcttctaacttcagtaaggcgcatggttttgacccttacccagcaaaatgatgagagcaaagagtttgtaaagttctttcataaacaacttggaagtatattacaggattcactggcaaaatttgctggcagaaaactgaaagactgtggagaagatcttcttgtagagatatctgaagtgttgttcaatgaattggctttctttaagcttatgcaagatttggataataatagtataactgttaaacagagatgcaaaaggaaaatagaagcaactggagtgatacaatcttgtgccaaagaggctaaaaggattcttgaagatcatggctcacctgctggagagattgatgatgaagacaaagacaaggatgaaactgaaacagttaagcagactcaaacatctgaggtgtatgatggtcccaaaaatgtaagatctgatatttctgatcaagaggaagatgaagaaagtgaaggatgtccagtgtctattaatttgtctaaagctgaaactcaggctttaactaattatggaagtggagaagatgaaaatgaggatgaagaaatggaagaatttgaagaaggccctgtggatgtccagacttccctccaggctaacactgaagctactgaagaaaatgaacatgatgaacaggtcctacaacgtgactttaaaaagacagcagaaagcaaaaatgtcccattggaacgagaagccactagtaaaaatgaccaaaataactgtcctgtgaaaccctgttacctcaatatcttggaagatgagcaacctttaaatagtgctgcccataaggagtcacctcctactgttgattcaactcaacagcctaaccctttgccgttacgtttacctgaaatggaacccttagtgcctagagtcaaagaagttaaatctgctcaggaaactcctgaaagctctctggctggaagtcctgatactgaatctccagtgttagtgaatgactatgaagcagaatctggtaatataagtcaaaagtctgatgaagaagattttgtaaaagttgaagatttaccactgaaactgacaatatattcagaggcagatctaagaaagaaaatggtagaagaagaacagaaaaaccatttatctggtgaaatatgtgaaatgcagaccgaagaattagctggaaattctgagacactaaaagaacctgaaacggtgggagcccagagtatatgagatgtcttcagaggctcatctaactctgtccttacatactcaatgcatatatgaaaacaatactaaataaacatctgatctgtataaaaatgtaaattagtttgacactgcttttttgataggtgtggtcatttctccccatggtagtttaaaacatcagaaactgaattctggacagatttaagccttgacacactgtgtttttttttttttcccccttcttttttgggtcttcatttttttccccattgtgatgtttggtaacgaatttaaaatgtagttttaaataaagtttggacttatctataaagtatcttttttggaaattatattgaattctatacagcaagtcaatgttttatataactttaggctgctcagagaagagcaatggttaagagttagttagagaaatatattatttgttataaagcccatccattaggccagtcttccaactaatgccagtgttgctgctgttgggtctgatgttcttcttttagatacctgcaggtcctattcctgtgcaagaatagggcagattatcaagatatccaggatacctatgaagttattatagaatatttattaatccattgaaattggataataagtttagaacataggttctcagtatctagaacttacatcattatcatctgtttgttaggatttgaaattctggaaaatatttatctacatcgcctcagactaaaagtaaaaaaaataagctttatataattagggagatttctgcacagagaagtaacattgtggttaattttaaatgaaaaacttaactttttcaagtggggataaataatacaactaaatttctgtaatagtaagattctgtatgccttcagataaacttgcctattgagatggtaatttaaagccaaagcatagcagtttcttttgtgtgtagtgaggttgaagcagatttgcaggtgaagtattgaaagtttatgtgactttaagtcagcttttgaaaagtgattgatttgctttttatcccaaactgtccatatacccagtaaggcttcaaaaaaccagtcaacaatgagtaagtcaatcttatagattcttcttcctcgaataaaatacaaagaattagttccaataagtattttaactttgttaacaactgaaataccccataaaaaaagaacttgttgagagtatttctttaaaatggttacttgctgcccaggcaccatggctcactcctgtaatcccagcaccttgggaggccgaggcgggcagatcacgaggtcaagagattgagaccatcctgcccaacatgggggaaaccccgtctctactaaaaataaaaaaattagctgggagaggtggcacgtgcctgtagtcctagctacttgggaggctaaggcaggagaatagcctgaacccgggaggtggaggttgcaggttgcagtgagccgagatcatgccactgcactccagcctggcaacagagcgagactctgtctcaaaaaaaaaaaaaaaaaaaaaaaaaagttaacttgctgtatacctcagtgtaatgtccattcaaggagtattaaatgaggatttccctgcgaggacatttactgtattgctacttaaattatggaagacaatatatcttcaactttaataaaacctattcagaaaattaccaattcagaattcggagttcttatccaggtgctctaactaacttcagggaaattggaacaataagttatgttacatgcacactcaaattctttattttctccactttaagcaggaaagggtaaaaactgttttggtactcaagcccagccttacatactgtgtttctctctctgtctgcatgcatattaaagtggaaaaattgtatttatatcttagttattaccatagtacctatgaaccttatcaaaattgcttatttgactggtgttacagctgctattaatctaagtctattgtttttctattttagtagataatttagttttaaaatacgtagggtttgagagcagatatatttatttaatctgttttctctagtaactattgctgaagggttaggcattcagtattcctatttgtcctaattttgaagttaaaaattttggttacagatagatagagggagaaaagttcaaaatgagtgagagagaactttatgcaggttgagataatgcctaaaataatgagctggccagactgtggaggtactctttgtattttgtaacattgactttgggtaaatgctttttcactgttaataaatatatatcctgtatacaaaaaaa

SEQ ID NO: 30 - DNA, 3734 bp, Homo sapiens
gcggagcgtgtgacgctgcggccgccgcggacctggggattaatgggaaaagttttggcaggagcgggagaattctgcggagcctgcgggacggcggcggtggcgccgtaggcagccgggacagtgttgtacagtgttttgggcatgcacgtgatactcacacagtggcttctgctcaccaacagatgaagacagatgcaccaacgaggctgatgggaaccaccctgtagaggtccatctgcgttcagacccagacgatgccagagctatgactgggcctgcaggtgtggcgccgaggggagatcagccatggagcagccacaggaggaagcccctgaggtccgggaagaggaggagaaagaggaagtggcagaggcagaaggagccccagagctcaatgggggaccacagcatgcacttccttccagcagctacacagacctctcccggagctcctcgccaccctcactgctggaccaactgcagatgggctgtgacggggcctcatgcggcagcctcaacatggagtgccgggtgtgcggggacaaggcatcgggcttccactacggtgttcatgcatgtgaggggtgcaagggcttcttccgtcgtacgatccgcatgaagctggagtacgagaagtgtgagcgcagctgcaagattcagaagaagaaccgcaacaagtgccagtactgccgcttccagaagtgcctggcactgggcatgtcacacaacgctatccgttttggtcggatgccggaggctgagaagaggaagctggtggcagggctgactgcaaacgaggggagccagtacaacccacaggtggccgacctgaaggccttctccaagcacatctacaatgcctacctgaaaaacttcaacatgaccaaaaagaaggcccgcagcatcctcaccggcaaagccagccacacggcgccctttgtgatccacgacatcgagacattgtggcaggcagagaaggggctggtgtggaagcagttggtgaatggcctgcctccctacaaggagatcagcgtgcacgtcttctaccgctgccagtgcaccacagtggagaccgtgcgggagctcactgagttcgccaagagcatccccagcttcagcagcctcttcctcaacgaccaggttacccttctcaagtatggcgtgcacgaggccatcttcgccatgctggcctctatcgtcaacaaggacgggctgctggtagccaacggcagtggctttgtcacccgtgagttcctgcgcagcctccgcaaacccttcagtgatatcattgagcctaagtttgaatttgctgtcaagttcaacgccctggaacttgatgacagtgacctggccctattcattgcggccatcattctgtgtggagaccggccaggcctcatgaacgttccacgggtggaggctatccaggacaccatcctgcgtgccctcgaattccacctgcaggccaaccaccctgatgcccagtacctcttccccaagctgctgcagaagatggctgacctgcggcaactggtcaccgagcacgcccagatgatgcagcggatcaagaagaccgaaaccgagacctcgctgcaccctctgctccaggagatctacaaggacatgtactaacggcggcacccaggcctccctgcagactccaatggggccagcactggaggggcccacccacatgacttttccattgaccagcccttgagcacccggcctggagcagcagagtcccacgatcgccctcagacacatgacacccacggcctctggctccctgtgccctctctcccgcttcctccagccagctctcttcctgtctttgttgtctccctctttctcagttcctctttcttttctaattcctgttgctctgtttcttcctttctgtaggtttctctcttcccttctcccttgccctccctttctctctccaccccccacgtctgtcctcctttcttattctgtgagatgttttgtattatttcaccagcagcatagaacaggacctctgcttttgcacaccttttccccaggagcagaagagagtggggcctgccctctgccccatcattgcacctgcaggcttaggtcctcacttctgtctcctgtcttcagagcaaaagacttgagccatccaaagaaacactaagctctctgggcctgggttccagggaaggctaagcatggcctggactgactgcagccccctatagtcatggggtccctgctgcaaaggacagtgggcaggaggccccaggctgagagccagatgcctccccaagactgtcattgcccctccgatgctgaggccacccactgacccaactgatcctgctccagcagcacacctcagccccactgacacccagtgtccttccatcttcacactggtttgccaggccaatgttgctgatggccccctgcactggccgctggacggcactctcccagcttggaagtaggcagggttccctccaggtgggcccccacctcactgaagaggagcaagtctcaagagaaggaggggggattggtggttggaggaagcagcacacccaattctgcccctaggactcggggtctgagtcctggggtcaggccagggagagctcggggcaggccttccgccagcactcccactgcccccctgcccagtagcagccgcccacattgtgtcagcatccagggccagggcctggcctcacatccccctgctcctttctctagctggctccacgggagttcaggccccactccccctgaagctgcccctccagcacacacacataagcactgaaatcactttacctgcaggctccatgcacctcccttccctccctgaggcaggtgagaacccagagagaggggcctgcaggtgagcaggcagggctgggccaggtctccggggaggcaggggtcctgcaggtcctggtgggtcagcccagcacctgctcccagtgggagcttcccgggataaactgagcctgttcattctgatgtccatttgtcccaatagctctactgccctccccttcccctttactcagcccagctggccacctagaagtctccctgcacagcctctagtgtccggggaccttgtgggaccagtcccacaccgctggtccctgccctcccctgctcccaggttgaggtgcgctcacctcagagcagggccaaagcacagctgggcatgccatgtctgagcggcgcagagccctccaggcctgcaggggcaaggggctggctggagtctcagagcacagaggtaggagaactggggttcaagcccaggcttcctgggtcctgcctggtcctccctcccaaggagccattctgtgtgtgactctgggtggaagtgcccagcccctgcccctacgggcgctgcagcctcccttccatgccccaggatcactctctgctggcaggattcttcccgctccccacctacccagctgatgggggttggggtgcttcctttcaggccaaggctatgaagggacagctgctgggacccacctccccctccccggccacatgccgcgtccctgccccgacccgggtctggtgctgaggatacagctcttctcagtgtctgaacaatctccaaaattgaaatgtatatttttgctaggagccccagcttcctgtgtttttaatataaatagtgtacacagactgacgaaactttaaataaatgggaattaaatatttaa

SEQ ID NO: 31 - DNA, 925 bp, Homo sapiens
ttttttctgctaccgtgactaagatggaagcgtttttggggtcgcggtccggactttgggcggggggtccggccccaggacagttttaccgcattccgtccactcccgattccttcatggatccggcgtctgcactttacagaggtccaatcacgcggacccagaaccccatggtgaccgggacctcagtcctcggcgttaagttcgagggcggagtggtgattgccgcagacatgctgggatcctacggctccttggctcgtttccgcaacatctctcgcattatgcgagtcaacaacagtaccatgctgggtgcctctggcgactacgctgatttccagtatttgaagcaagttctcggccagatggtgattgatgaggagcttctgggagatggacacagctatagtcctagagctattcattcatggctgaccagggccatgtacagccggcgctcgaagatgaaccctttgtggaacaccatggtcatcggaggctatgctgatggagagagcttcctcggttatgtggacatgcttggtgtagcctatgaagccccttcgctggccactggttatggtgcatacttggctcagcctctgctgcgagaagttctggagaagcagccagtgctaagccagaccgaggcccgcgacttagtagaacgctgcatgcgagtgctgtactaccgagatgcccgttcttacaaccggtttcaaatcgccactgtcaccgaaaaaggtgttgaaatagagggaccattgtctacagagaccaactgggatattgcccacatgatcagtggctttgaatgaaatacagatgcattatccagaactgaagttgccctacttttaactttgaacttggctagttcaaagatagactcttcttttgtaaagtaaataaattcttcaaaatg

SEQ ID NO: 32 - DNA, 8062 bp, Homo sapiens
cgtccctgcagccctcgcccggcgctccagtagcaggacccggtctcgggaccagccggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctagatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatg

SEQ ID NO: 33 - DNA, 8119 bp, Homo sapiens
cgtccctgcagccctcgcccggcgctccagtagcaggacccggtctcgggaccagccggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgagagagcttcgtttaggagcctgaatctccaagcagagtctgttagaggatttaatatgggacgagcaatcagcactggcagtctggccagcagcaccctcaacaaacttgctgttcgacctttatcagttcaagctgagattctgaagaggctatcctgctcagagctgtcgctttaccagccattgcaaaacagttcaaaagagaagaatgacaaagcttcatgggaggaaaagcctagagagatgagtaaatcataccatgatctcagtcaggcctctctctatccacatcggaaaaatgtcattgttaacatggaacccccaccacaaaccgttgcagagttggtgggaaaaccttctcaccagatgtcaagatctgatgcagaatctttggcaggagtgacaaaacttaataattcaaagtctgttgcgagtttaaatagaagtcctgaaaggaggaaacatgaatcagactcctcatccattgaagaccctgggcaagcatatgttctaggaatgactatgcatagttctggaaactcttcatcccaagtacccttaaaagaaaatgatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatg

SEQ ID NO: 34 - DNA, 7546 bp, Homo sapiens
cgtccctgcagccctcgcccggcgctccagtagcaggacccggtctcgggaccagccggtaatatgcacgtgtcactagctgaggccctggaggttcggggtggaccacttcaggaggaagaaatatgggctgtattaaatcaaagtgctgaaagtctccaagaattattcagaaaagtaagcctagctgatcctgctgcccttggcttcatcatttctccatggtctctgctgttgctgccatctggtagtgtgtcatttacagatgaaaatatttccaatcaggatcttcgagcattcactgcaccagaggttcttcaaaatcagtcactaacttctctctcagatgttgaaaagatccacatttattctcttggaatgacactgtattggggggctgattatgaagtgcctcagagccaacctattaagcttggagatcatctcaacagcatactgcttggaatgtgtgaggatgttatttacgctcgagtttctgttcggactgtgctggatgcttgcagtgcccacattaggaatagcaattgtgcaccctcattttcctacgtgaaacacttggtaaaactggttctgggaaatctttctgggacagatcagctttcctgtaacagtgaacaaaagcctgatcgaagccaggctattcgagatcgattgcgaggaaaaggattaccaacaggaagaagctctacttctgatgtactagacatacaaaagcctccactctctcatcagacctttcttaacaaagggcttagtaaatctatgggatttctgtccatcaaagatacacaagatgagaattatttcaaggacattttatcagataattctggacgtgaagattctgaaaatacattctccccttaccagttcaaaactagtggcccagaaaaaaaacccatccctggcattgatgtgctttctaagaagaagatctgggcttcatccatggacttgctttgtacagctgacagagacttctcttcaggagagactgccacatatcgtcgttgtcaccctgaggcagtaacagtgcggacttcaactactcctagaaaaaaggaggcaagatactcagatggaagtatagccttggatatctttggccctcagaaaatggatccaatatatcacactcgagaattgcccacctcctcagcaatatcaagtgctttggaccgaatccgagagagacaaaagaaacttcaggttctgagggaagccatgaatgtagaagaaccagttcgaagatacaaaacttatcatggtgatgtctttagtacctccagtgaaagtccatctattatttcctctgaatcagatttcagacaagtgagaagaagtgaagcctcaaagaggtttgaatccagcagtggtctcccaggggtagatgaaaccttaagtcaaggccagtcacagagaccgagcagacaatatgaaacaccctttgaaggcaacttaattaatcaagagatcatgctaaaacggcaagaggaagaactgatgcagctacaagccaaaatggcccttagacagtctcggttgagcctatatccaggagacacaatcaaagcgtccatgcttgacatcaccagggatccgttaagagaaattgccctagaaacagccatgactcaaagaaaactgaggaatttctttggccctgagtttgtgaaaatgacaattgaaccatttatatctttggatttgccacggtctattcttactaagaaagggaagaatgaggataaccgaaggaaagtaaacataatgcttctgaacgggcaaagactggaactgacctgtgataccaaaactatatgtaaagatgtgtttgatatggttgtggcacatattggcttagtagagcatcatttgtttgctttagctaccctcaaagataatgaatatttctttgttgatcctgacttaaaattaaccaaagtggccccagagggatggaaagaagaaccaaagaaaaagaccaaagccactgttaattttactttgtttttcagaattaaattttttatggatgatgttagtctaatacaacatactctgacgtgtcatcagtattaccttcagcttcgaaaagatattttggaggaaaggatgcactgtgatgatgagacttccttattgctggcatccttggctctccaggctgagtatggagattatcaaccagaggttcatggtgtgtcttactttagaatggagcactatttgcccgccagagtgatggagaaacttgatttatcctatatcaaagaagagttacccaaattgcataatacctatgtgggagcttctgaaaaagagacagagttagaatttttaaaggtctgccaaagactgacagaatatggagttcattttcaccgagtgcaccctgagaagaagtcacaaacaggaatattgcttggagtctgttctaaaggtgtccttgtgtttgaagttcacaatggagtgcgcacattggtccttcgctttccatggagggaaaccaagaaaatatctttttctaaaaagaaaatcacattgcaaaatacatcagatggaataaaacatggcttccagacagacaacagtaagatatgccagtacctgctgcacctctgctcttaccagcataagttccagctacagatgagagcaagacagagcaaccaagatgcccaagatattgatgtgctacacaaaagatggagcatagtatcttcaccagaaagggagatcaccttagtgaacctgaaaaaagatgcaaagtatggcttgggatttcaaattattggtggggagaagatgggaagactggacctaggcatatttatcagttcagttgcccctggaggaccagctgacttggatggatgcttgaagccaggagaccgtttgatatctgtgaatagtgtgagtctggagggagtcagccaccatgctgcaattgaaattttgcaaaatgcacctgaagatgtgacacttgttatctctcagccaaaagaaaagatatccaaagtgccttctactcctgtgcatctcaccaatgagatgaaaaactacatgaagaaatcttcctacatgcaagacagtgctatagattcttcttccaaggatcaccactggtcacgtggtaccctgaggcacatctcggagaactcctttgggccatctgggggcctgcgggaaggaagcctgagttctcaagattccaggactgagagtgccagcttgtctcaaagccaggtcaatggtttctttgccagccatttaggtgaccaaacctggcaggaatcacagcatggcagcccttccccatctgtaatatccaaagccaccgagaaagagactttcactgatagtaaccaaagcaaaactaaaaagccaggcatttctgatgtaactgattactcagaccgtggagattcagacatggatgaagccacttactccagcagtcaggatcatcaaacaccaaaacaggaatcttcctcttcagtgaatacatccaacaagatgaattttaaaactttttcttcatcacctcctaagcctggagatatctttgaggttgaactggctaaaaatgataacagcttggggataagtgtcacgggaggtgtgaatacgagtgtcagacatggtggcatttatgtgaaagctgttattccccagggagcagcagagtctgatggtagaattcacaaaggtgatcgcgtcctagctgtcaatggagttagtctagaaggagccacccataagcaagctgtggaaacactgagaaatacaggacaggtggttcatctgttattagaaaagggacaatctccaacatctaaagaacatgtcccggtaaccccacagtgtaccctttcagatcagaatgcccaaggtcaaggcccagaaaaagtgaagaaaacaactcaggtcaaagactacagctttgtcactgaagaaaatacatttgaggtaaaattatttaaaaatagctcaggtctaggattcagtttttctcgagaagataatcttataccggagcaaattaatgccagcatagtaagggttaaaaagctctttcctggacagccagcagcagaaagtggaaaaattgatgtaggagatgttatcttgaaagtgaatggagcctctttgaaaggactatctcagcaggaagtcatatctgctctcaggggaactgctccagaagtattcttgcttctctgcagacctccacctggtgtgctaccggaaattgatactgcgcttttgaccccacttcagtctccagcacaagtacttccaaacagcagtaaagactcttctcagccatcatgtgtggagcaaagcaccagctcagatgaaaatgaaatgtcagacaaaagcaaaaaacagtgcaagtccccatccagaagagacagttacagtgacagcagtgggagtggagaagatgacttagtgacagctccagcaaacatatcaaattcgacctggagttcagctttgcatcagactctaagcaacatggtatcacaggcacagagtcatcatgaagcacccaagagtcaagaagataccatttgtaccatgttttactatcctcagaaaattcccaataaaccagagtttgaggacagtaatccttcccctctaccaccggatatggctcctgggcagagttatcaaccccaatcagaatctgcttcctctagttcgatggataagtatcatatacatcacatttctgaaccaactagacaagaaaactggacacctttgaaaaatgacttggaaaatcaccttgaagactttgaactggaagtagaactcctcattaccctaattaaatcagaaaaaggaagcctgggttttacagtaaccaaaggcaatcagagaattggttgttatgttcatgatgtcatacaggatccagccaaaagtgatggaaggctaaaacctggggaccggctcataaaggttaatgatacagatgttactaatatgactcatacagatgcagttaatctgctccgggctgcatccaaaacagtcagattagttattggacgagttctagaattacccagaataccaatgttgcctcatttgctaccggacataacactaacgtgcaacaaagaggagttgggtttttccttatgtggaggtcatgacagcctttatcaagtggtatatattagtgatattaatccaaggtccgtcgcagccattgagggtaatctccagctattagatgtcatccattatgtgaacggagtcagcacacaaggaatgaccttggaggaagttaacagagcattagacatgtcacttccttcattggtattgaaagcaacaagaaatgatcttccagtggtccccagctcaaagaggtctgctgtttcagctccaaagtcaaccaaaggcaatggttcctacagtgtggggtcttgcagccagcctgccctcactcctaatgattcattctccacggttgctggggaagaaataaatgaaatatcgtaccccaaaggaaaatgttctacttatcagataaagggatcaccaaacttgactctgcccaaagaatcttatatacaagaagatgacatttatgatgattcccaagaagctgaagttatccagtctctgctggatgttgtggatgaggaagcccagaatcttttaaacgaaaataatgcagcaggatactcctgtggtccaggtacattaaagatgaatgggaagttatcagaagagagaacagaagatacagactgcgatggttcacctttacctgagtattttactgaggccaccaaaatgaatggctgtgaagaatattgtgaagaaaaagtaaaaagtgaaagcttaattcagaagccacaagaaaagaagactgatgatgatgaaataacatggggaaatgatgagttgccaatagagagaacaaaccatgaagattctgataaagatcattcctttctgacaaacgatgagctcgctgtactccctgtcgtcaaagtgcttccctctggtaaatacacgggtgccaacttaaaatcagtcattcgagtcctgcggggtttgctagatcaaggaattccttctaaggagctggagaatcttcaagaattaaaacctttggatcagtgtctaattgggcaaactaaggaaaacagaaggaagaacagatataaaaatatacttccctatgatgctacaagagtgcctcttggagatgaaggtggctatatcaatgccagcttcattaagataccagttgggaaagaagagttcgtttacattgcctgccaaggaccactgcctacaactgttggagacttctggcagatgatttgggagcaaaaatccacagtgatagccatgatgactcaagaagtagaaggagaaaaaatcaaatgccagcgctattggcccaacatcctaggcaaaacaacaatggtcagcaacagacttcgactggctcttgtgagaatgcagcagctgaagggctttgtggtgagggcaatgacccttgaagatattcagaccagagaggtgcgccatatttctcatctgaatttcactgcctggccagaccatgatacaccttctcaaccagatgatctgcttacttttatctcctacatgagacacatccacagatcaggcccaatcattacgcactgcagtgctggcattggacgttcagggaccctgatttgcatagatgtggttctgggattaatcagtcaggatcttgattttgacatctctgatttggtgcgctgcatgagactacaaagacacggaatggttcagacagaggatcaatatattttctgctatcaagtcatcctttatgtcctgacacgtcttcaagcagaagaagagcaaaaacagcagcctcagcttctgaagtgacatgaaaagagcctctggatgcatttccatttctctccttaacctccagcagactcctgctctctatccaaaataaagatcacagagcagcaagttcatacaacatgcatgttctcctctatcttagaggggtattcttcttgaaaataaaaaatattgaaatgctgtatttttacagctactttaacctatgataattatttacaaaattttaacactaaccaaacaatgcagatcttagggatgattaaaggcagcatttgatgatagcagacattgttacaaggacatggtgagtctatttttaatgcaccaatcttgtttatagcaaaaatgttttccaatattttaataaagtagttattttataggggatacttgaaaccagtatttaagctttaaatgacagtaatattggcatagaaaaaagtagcaaatgtttactgtatcaatttctaatgtttactatatagaatttcctgtaatatatttatatactttttcatgaaaatggagttatcagttatctgtttgttactgcatcatctgtttgtaatcattatctcactttgtaaataaaaacacaccttaaaacatg

SEQ ID NO: 35 - DNA, 4008 bp, Homo sapiens
aggcagtgattttggggcagagaattttgcaacacgtggtagtgaactgtgaggagtttgaggggtctgaagactgaaagagtcgaatggtttgttggcagggtgtcctggtggattggtttctgtaagttcagattctcataaatcgtgtgagcgtcgccgacacctctgagataaaagggcccctttcgactagcctctgctgaaaggacctagaagaatcccttaggatgaagctgagtcttaccaaggtagttaatggctgtcgcctaggaaaaataaaaaacctgggcaaaacaggggaccacaccatggatattccaggctgccttctgtataccaagactggctccgccccacacctcacccatcacacgctgcataatatccacggggttcctgccatggctcagcttacgctgtcatccctagcagaacatcatgaagtcttgacagaatataaagaaggagttggaaagtttataggcatgccagaatcactcttgtactgctccctgcacgatccagtcagcccctgcccggctggttatgtaacaaacaagtctgtgtctgtgtggagtgttgcaggacgagtggaaatgactgtttccaagttcatggcaattcagaaggcccttcagccagactggttccagtgcctctccgatggagaagtatcttgtaaggaagcaacttccataaaaagggtcagaaagtctgttgaccgatcacttcttttcttggataactgtctgcggctgcaggaagagtcagaggttcttcagaagagtgtgatcattggagtgattgaaggtggagatgtgatggaagagaggctgaggtcagcacgagagacagccaagcggcctgtgggtggcttccttctggatggttttcaaggaaatccaacaaccctggaggctagactacgcttgctgtcatcagtcactgcagagctgccggaggacaagccaaggctcatatctggtgttagtcggccagatgaggtgctcgagtgtattgaaagaggagtggacttatttgagagttttttcccttatcaagtaacagagcggggatgtgccctgactttcagttttgattaccagccgaatcctgaagagacactactacaacaaaatggaacacaagaagaaataaaatgtatggatcaaataaagaaaattgaaacaactggttgcaaccaagaaataacatcatttgaaattaatctgaaggaaaaaaagtaccaggaggactttaacccgctggtgagaggatgttcctgttactgctgtaagaatcacactcgggcatacatccaccatctgctggtgaccaatgagctgctggccggagtcctgcttatgatgcacaactttgaacactactttgggtttttccattacatccgggaagcactaaaaagtgacaaactggcacagttgaaagagctcatccacaggcaagcatcttgagatcttgcaaatacaagtctcactcttcacactgagcctgtaccactgttgtaacatgggaagacgtgaagaagaaataatctgagctttaattatttatatttggatataaggtctgcttaaataaagaatctttgtaccaaactgcccacatgagggtgaagagatttcctcaaaagacttaaatgacctggattgatcagagagaattgaactgtgacctttaagacttctagactaattcttttagttgatagagattcatttagtcaaagacaaaagctttaactgtgagggcacagccttgaagtgggagtgatgagattctgagggacccatgaattggattgaggcttgaggggaaatggtgtgagacgaatgggctctggacatatgcctgttgatttgagaagaaatctggctggtttgagggtttcctttagttcaccctcatactctcaggagactcttctggatacttttgtcttccaccctgccctggcagtgcagccaatcagaaatggctcttgtgacttaactgggcttggatatccctggaatgtggggcttgaacattgctcctgtgatgatcatctgtcccaggtcacactccttcatttgaccacatggcctatttgcaacttctttttagagccaatgtaattgcctgttaggagccagaagtttgcccagctgctttcttctggttgtacagatccattgtggtctgccttccaggctcattaatagtctaactacgtaataactgaagacctatctcttgtgaagattcattctcaatgtgttcacttggacagagccctgcctggcctaacgattagagggttagtctccatcctgctcagatatgactcctgggcaattcacttaacttctccatggctgcttcctgctgaataaatagggacaggcataatggataggaatgaatgaacttttaagatactgtctagctctaaaattggaagaacaaaaagttttagattagagtcatagccttaatagccctagttgtcatcctgggagacaggcaacagtagagatatttgagagcctaaagagaggtttggcctgtgggtttttaagtggttattgaattggtatcaggagatcctgaggctggtaggggaaggtaattctttctaagttacctctgtatttttcaagttttctataaggaatacacatacacccacatgcacacaccatagtttttatacaaacagcaataacaaaaccaaaaagatgcccctttttttgtagggataagaaatacatttgttttatacttctatgctatattttgctattcaaaatttagtgggcattacttaacattgtttctaattattttgtggctgctgtatgttttatgtgttgggagcccattgtattaggccgttcttggattgctataaagaaatacctgagactgggtaatttggttttttggttttttggggttttttttgagacggagccttgctctgtcgcccaggctggagtgcagtggcgcgatctcggctctatgcaacctccacctcctgggttcatgccattctcctgcctcagcctcccgtgtagctgggactacaggcgcccgccaccatgcctggctaattttttatatttttagtagagatggggtttcaccgtatgagccaggatggtctcgatctcctgacctcatgatccacaagactgggtaatctgtaaagaaaagaggtttaattggctcatggctctgcaggctttacaggaagcatggtactggcatctgcttggtttctggggaggcctccggaagcttatagtcatgacagaaggtgaagggggagcaggcacatcacatgacaaaagcaggaacaagactcagagcaagaagtcacttatcaccaaggggatggcccaggccattcatgagggatccacctttgtgctccaaacacctcccaccaggccccacctccagtattggggattacatttcaacttgaggtttgggcgggaacaaatagtcaaattatattacccatctacatggttttctttttcttagtatgggagtgtccatgaataaattcatgggcatcctcataactcttccatgaatggcaaggggtacttatggaaaacagttttccaaagatctgattgttttgaaatgtgttagattggacttgttcaaatgttcatatttttgttctatgctaaatgcatcgttaggggagtagtggtaaatattccagaatccatatgaaattcatgagtttatttatgtctaaaacactgaaaactgtgtccaatatcgttcagtttcctgggtctttttcttattagcacatttgagaaaaatattcctttcctttattgtagtaaatctattaaaggcaatagccaataaaacatttttaattttaaaaatttactgtgtttggctttctgtaaatgtagtaggtctgttaaacaaaatattaaatttccatagtaccagaaaaaaaaaaaaaaa

SEQ ID NO: 36 - DNA, 2803 bp, Homo sapiens
tgaacttactacatcagaactcctgctgaggtataagaggatacgtctaataactcaattgctgtaaacctatgattgtttttctggtttttaaacatctcttcagcctcagattgattacaatgttctttctacttcatttcatcgttctgatcaatgtcaaagattttgcactgactcaaggtagcatgatcactccttcatgccaaaaaggatattttccctgtgggaatcttaccaagtgcttaccccgagcttttcactgtgatggcaaggatgactgtgggaacggggcggacgaagagaactgtggtgacactagtggatgggcgaccatatttggcacagtgcatggaaatgctaacagcgtggccttaacacaggagtgctttctaaaacagtatccacaatgctgtgactgcaaagaaactgaattggaatgtgtaaatggtgacttaaagtctgtgccgatgatttctaacaatgtgacattactgtctcttaagaaaaacaaaatccacagtcttccagataaagttttcatcaaatacacaaaacttaaaaagatatttcttcagcataattgcattagacacatatccaggaaagcattttttggattatgtaatctgcaaatattatatctcaaccacaactgcatcacaaccctcagacctggaatattcaaagacttacatcagctaacttggctaattctagatgacaatccaataaccagaatttcacagcgcttgtttacgggattaaattccttgtttttcctgtctatggttaataactacttagaagctcttcccaagcagatgtgtgcccaaatgcctcaactcaactgggtggatttggaaggcaatagaataaagtatctcacaaattctacgtttctgtcgtgcgattcgctcacagtgctgtttctgcctagaaatcaaattggttttgttccagagaagacattttcttcattaaaaaatttaggagaactggatctgtctagcaatacgataacggaactatcacctcacctttttaaagacttgaagcttctacaaaagctgaacctgtcatccaatcctcttatgtatcttcacaagaaccagtttgaaagtcttaaacaacttcagtctctagacctggaaaggatagagattccaaatataaacacacgaatgtttcaacccatgaagaatctttctcacatttatttcaaaaactttcgatactgctcctatgctccccatgtccgaatatgtatgcccttgacggacggcatttcttcatttgaggacctcttggctaacaatatcctcagaatatttgtctgggttatagctttcattacctgctttggaaatctttttgtcattggcatgagatctttcattaaagctgaaaatacaactcacgctatgtccatcaaaatcctttgttgtgctgattgcctgatgggtgtttacttgttctttgttggcattttcgatataaaataccgagggcagtatcagaagtatgccttgctgtggatggagagcgtgcagtgccgcctcatggggttcctggccatgctgtccaccgaagtctctgttctgctactgacctacttgactttggagaagttcctggtcattgtcttccccttcagtaacattcgacctggaaaacggcagacctcagtcatcctcatttgcatctggatggcgggatttttaatagctgtaattccattttggaataaggattattttggaaacttttatgggaaaaatggagtatgtttcccactttattatgaccaaacagaagatattggaagcaaagggtattctcttggaattttcctaggtgtgaacttgctggcttttctcatcattgtgttttcctatattactatgttctgttccattcaaaaaaccgccttgcagaccacagaagtaaggaattgttttggaagagaggtggctgttgcaaatcgtttcttttttatagtgttctctgatgccatctgctggattcctgtatttgtagttaaaatcctttccctcttccgggtggaaataccagacacaatgacttcctggatagtgatttttttccttccagttaacagtgctttgaatccaatcctctatactctcacaaccaacttttttaaggacaagttgaaacagctgctgcacaaacatcagaggaaatcaattttcaaaattaaaaaaaaaagtttatctacatccattgtgtggatagaggactcctcttccctgaaacttggggttttgaacaaaataacacttggagacagtataatgaaaccagtttcctagcaatcattttggatcactggactttcagtggactacctaaaacaggggacagcttttggaagatgacatctgcaatgcttttcatctttaccaacggcaagcctttctgcacagagagcacagcagaatggctcctgtcactgcattccaatggcagctgtactatctaccaaccatgctgaggacagcaccaaaggttcctctcctcaccccacatgcctgaaaagcacatgtgaattcgtgtatagtgggctgaggtgcagctgatctctagctaatcaacacaacccaccaacaaatgaccacaggttggcactgtgtggtctttcacatcgggttgcactgtccatgaaatagaaacactcacaacatctgattccagtgtggccataataacagaaatctaacaactctttccttgccttttcaatatcaaataaaaccatcagcatcctgctggattgata

SEQ ID NO: 37 - DNA, 4465 bp, Homo sapiens
cctgcagcctccggagtcagtgccgcgcgcccgccgccccgcgccttcctgctcgccgcacctccgggagccggggcgcacccagcccgcagcgccgcctccccgcccgcgccgcctccgaccgcaggccgagggccgccactggccggggggaccgggcagcagcttgcggccgcggagccgggcaacgctggggactgcgccttttgtccccggaggtccctggaagtttgcggcaggacgcgcgcggggaggcggcggaggcagccccgacgtcgcggagaacagggcgcagagccggcatgggcatcgggcgcagcgaggggggccgccgcggggcagccctgggcgtgctgctggcgctgggcgcggcgcttctggccgtgggctcggccagcgagtacgactacgtgagcttccagtcggacatcggcccgtaccagagcgggcgcttctacaccaagccacctcagtgcgtggacatccccgcggacctgcggctgtgccacaacgtgggctacaagaagatggtgctgcccaacctgctggagcacgagaccatggcggaggtgaagcagcaggccagcagctgggtgcccctgctcaacaagaactgccacgccggcacccaggtcttcctctgctcgctcttcgcgcccgtctgcctggaccggcccatctacccgtgtcgctggctctgcgaggccgtgcgcgactcgtgcgagccggtcatgcagttcttcggcttctactggcccgagatgcttaagtgtgacaagttccccgagggggacgtctgcatcgccatgacgccgcccaatgccaccgaagcctccaagccccaaggcacaacggtgtgtcctccctgtgacaacgagttgaaatctgaggccatcattgaacatctctgtgccagcgagtttgcactgaggatgaaaataaaagaagtgaaaaaagaaaatggcgacaagaagattgtccccaagaagaagaagcccctgaagttggggcccatcaagaagaaggacctgaagaagcttgtgctgtacctgaagaatggggctgactgtccctgccaccagctggacaacctcagccaccacttcctcatcatgggccgcaaggtgaagagccagtacttgctgacggccatccacaagtgggacaagaaaaacaaggagttcaaaaacttcatgaagaaaatgaaaaaccatgagtgccccacctttcagtccgtgtttaagtgattctcccgggggcagggtggggagggagcctcgggtggggtgggagcgggggggacagtgccccgggaacccggtgggtcacacacacgcactgcgcctgtcagtagtggacattgtaatccagtcggcttgttcttgcagcattcccgctcccttccctccatagccacgctccaaaccccagggtagccatggccgggtaaagcaagggccatttagattaggaaggtttttaagatccgcaatgtggagcagcagccactgcacaggaggaggtgacaaaccatttccaacagcaacacagccactaaaacacaaaaagggggattgggcggaaagtgagagccagcagcaaaaactacattttgcaacttgttggtgtggatctattggctgatctatgcctttcaactagaaaattctaatgattggcaagtcacgttgttttcaggtccagagtagtttctttctgtctgctttaaatggaaacagactcataccacacttacaattaaggtcaagcccagaaagtgataagtgcagggaggaaaagtgcaagtccattatgtaatagtgacagcaaagggaccaggggagaggcattgccttctctgcccacagtctttccgtgtgattgtctttgaatctgaatcagccagtctcagatgccccaaagtttcggttcctatgagcccggggcatgatctgatccccaagacatgtggaggggcagcctgtgcctgcctttgtgtcagaaaaaggaaaccacagtgagcctgagagagacggcgattttcgggctgagaaggcagtagttttcaaaacacatagttaaaaaagaaacaaatgaaaaaaattttagaacagtccagcaaattgctagtcagggtgaattgtgaaattgggtgaagagcttaggattctaatctcatgttttttccttttcacatttttaaaagaacaatgacaaacacccacttatttttcaaggttttaaaacagtctacattgagcatttgaaaggtgtgctagaacaaggtctcctgatccgtccgaggctgcttcccagaggagcagctctccccaggcatttgccaagggaggcggatttccctggtagtgtagctgtgtggctttccttcctgaagagtccgtggttgccctagaacctaacaccccctagcaaaactcacagagctttccgtttttttctttcctgtaaagaaacatttcctttgaacttgattgcctatggatcaaagaaattcagaacagcctgcctgtccccccgcactttttacatatatttgtttcatttctgcagatggaaagttgacatgggtggggtgtccccatccagcgagagagtttcaaaagcaaaacatctctgcagtttttcccaagtaccctgagatacttcccaaagcccttatgtttaatcagcgatgtatataagccagttcacttagacaactttacccttcttgtccaatgtacaggaagtagttctaaaaaaaatgcatattaatttcttcccccaaagccggattcttaattctctgcaacactttgaggacatttatgattgtccctctgggccaatgcttatacccagtgaggatgctgcagtgaggctgtaaagtggccccctgcggccctagcctgacccggaggaaaggatggtagattctgttaactcttgaagactccagtatgaaaatcagcatgcccgcctagttacctaccggagagttatcctgataaattaacctctcacagttagtgatcctgtccttttaacaccttttttgtggggttctctctgacctttcatcgtaaagtgctggggaccttaagtgatttgcctgtaattttggatgattaaaaaatgtgtatatatattagctaattagaaatattctacttctctgttgtcaaactgaaattcagagcaagttcctgagtgcgtggatctgggtcttagttctggttgattcactcaagagttcagtgctcatacgtatctgctcattttgacaaagtgcctcatgcaaccgggccctctctctgcggcagagtccttagtggaggggtttacctggaacattagtagttaccacagaatacggaagagcaggtgactgtgctgtgcagctctctaaatgggaattctcaggtaggaagcaacagcttcagaaagagctcaaaataaattggaaatgtgaatcgcagctgtgggttttaccaccgtctgtctcagagtcccaggaccttgagtgtcattagttactttattgaaggttttagacccatagcagctttgtctctgtcacatcagcaatttcagaaccaaaagggaggctctctgtaggcacagagctgcactatcacgagcctttgtttttctccacaaagtatctaacaaaaccaatgtgcagactgattggcctggtcattggtctccgagagaggaggtttgcctgtgatttcctaattatcgctagggccaaggtgggatttgtaaagctttacaataatcattctggatagagtcctgggaggtccttggcagaactcagttaaatctttgaagaatatttgtagttatcttagaagatagcatgggaggtgaggattccaaaaacattttatttttaaaatatcctgtgtaacacttggctcttggtacctgtgggttagcatcaagttctccccagggtagaattcaatcagagctccagtttgcatttggatgtgtaaattacagtaatcccatttcccaaacctaaaatctgtttttctcatcagactctgagtaactggttgctgtgtcataacttcatagatgcaggaggctcaggtgatctgtttgaggagagcaccctaggcagcctgcagggaataacatactggccgttctgacctgttgccagcagatacacaggacatggatgaaattcccgtttcctctagtttcttcctgtagtactcctcttttagatcctaagtctcttacaaaagctttgaatactgtgaaaatgttttacattccatttcatttgtgttgtttttttaactgcattttaccagatgttttgatgttatcgcttatgttaatagtaattcccgtacgtgttcattttattttcatgctttttcagccatgtatcaatattcacttgactaaaatcactcaattaatcaatgaaaaaaaaaaa

SEQ ID NO: 38 - DNA, 7757 bp, Homo sapiens
ctcactgtccctggaatcttcaagggagttactgcattacatcatcagaaacaaggcatttctatattactatggaaagatttcgtctggagaagaagttacctggtcctgatgaagaagctgttgtggatcttggcaaaactagctcaactgtgaacaccaagtttgaaaaagaagaactagaaagtcatagagctgtatatattggtgttcacgtcccgtttagtaaagagagtcgtcggcgtcataggcatcgcggacacaaacatcaccaccggagaagaaaagataaagaatcagataaagaagatggacgggaatctccttcttatgatacaccatcccagagagttcagtttatccttggtactgaagatgatgatgaagaacatattccccatgatctcttcacggaaatggatgaactgtgttacagagatggagaagaatatgaatggaaagaaactgctagatggctgaaatttgaagaggatgttgaagatggcggtgaccgatggagtaaaccttatgtggcaactctctctttgcacagtctttttgaactaaggagttgcatcctcaatggaacagtcatgctggatatgagagcaagcactctagatgaaatagcagatatggtattagacaacatgatagcttctggccaattagacgagtccatacgagagaatgtcagagaagctcttctgaagagacatcatcatcagaatgagaaaagattcaccagtcggattcctcttgttcgatcttttgcagatataggcaagaaacattctgaccctcacttgcttgaaaggaatggggaaggcctttcagcctcccgccactctttgcgaacaggtctgtctgcctcaaacctttccttgagaggagaatcacctttatctcttcttcttggtcatcttcttccttcttcaagagctggaacccctgcaggctcaaggtgtacaaccccagtacccacccctcaaaacagtcctccttctagccctagcatcagccgcctgacctccagaagttcccaagagagtcagcgtcaggccccagaactactggtttcacctgccagtgatgatattcccacagtagtaattcatccgcctgaggaagacttagaagcagcgctgaaaggcgaggagcagaagaatgaggaaaatgttgacttaactccaggtattttggcctctccccagtctgctcctggaaacttggacaatagtaaaagtggagaaattaaaggtaatggaagtggtggaagcagagaaaatagtactgttgacttcagcaaggttgatatgaatttcatgagaaaaattcctacgggtgctgaggcatccaacgtcctggtgggcgaagtagactttttggaaaggccaataattgcatttgtgagactggctcctgctgtcctccttacagggttgactgaggtccctgttccaaccaggtttttgtttttgttattgggtccagcgggcaaggcaccacagtaccatgaaattggacgatcaatagccactctcatgacagatgagattttccatgatgtagcttataaagcaaaagacagaaatgacctcttatctggaattgatgaatttttagatcaagtaactgtcctacctccaggagagtgggatccttctatacgcatagaaccaccaaaaagtgtcccttctcaggaaaagagaaagattcctgtgtttcacaatggatctacccccacactgggtgagactcctaaagaggccgctcatcatgctgggcctgagctacagaggactggacggctttttggtggtttgatacttgacatcaaaaggaaagcaccttttttcttgagtgacttcaaggatgcattaagcctgcagtgcctggcctcgattcttttcctatactgtgcctgtatgtctcctgtaatcacttttggagggctgcttggagaagctacagaaggcagaataagtgcaatagagtctctttttggagcatcattaactgggattgcctattcattgtttgctgggcaacctctaacaatattggggagcacaggtccagttctagtgtttgaaaaaattttatataaattctgcagagattatcaactttcttatctgtctttaagaaccagtattggtctgtggacttcttttttgtgcattgttttggttgcaacagatgcaagcagccttgtgtgttatattactcgatttacagaagaggcttttgcagcccttatttgcatcatattcatctacgaggctttggagaagctctttgatttaggagaaacatatgcatttaatatgcacaacaacttagataaactgaccagctactcatgtgtatgtactgaacctccaaaccccagcaatgaaactctagcacaatggaagaaagataatataacagcacacaatatttcctggagaaatcttactgtttctgaatgtaaaaaacttcgtggtgtattcttggggtcagcttgtggtcatcatggaccttatattccagatgtgctcttttggtgtgtcatcttgtttttcacaacattttttctgtcttcattcctcaagcaatttaagaccaagcgttactttcctaccaaggtgcgatcgacaatcagtgattttgctgtatttctcacaatagtaataatggttacaattgactaccttgtaggagttccatctcctaaacttcatgttcctgaaaaatttgagcctactcatccagagagagggtggatcataagcccactgggagataatccttggtggaccttattaatagctgctattcctgctttgctttgtaccattctcatctttatggatcaacaaatcacagctgtaattataaacagaaaggaacacaaattgaagaaaggagctggctatcaccttgatttgctcatggttggcgttatgttgggagtttgctctgtcatgggacttccatggtttgtggctgcaacagtgttgtcaataagtcatgtcaacagcttaaaagttgaatctgaatgttctgctccaggggaacaacccaagtttttgggaattcgtgaacagcgggttacagggctaatgatttttattctaatgggcctctctgtgttcatgacttcagtcctaaagtttattccaatgcctgttctgtatggtgttttcctttatatgggagtttcctcattaaaaggaatccagttatttgaccgtataaaattatttggaatgcctgctaagcatcagcctgatttgatatacctccgttatgtgccgctctggaaggtccatattttcacagtcattcagcttacttgtttggtccttttatgggtgataaaagtttcagctgctgcagtggtttttcccatgatggttcttgcattagtgtttgtgcgcaaactcatggacctgtgtttcacgaagagagaacttagttggcttgatgatcttatgccagaaagtaagaaaaagaaagaagatgacaaaaagaaaaaagagaaagaggaagctgaacggatgcttcaagatgatgatgatactgtgcaccttccatttgaagggggaagtctcttgcaaattccagtcaaggccctaaaatatagtcctgataaacctgtgagtgtgaaaataagttttgaagatgaaccaagaaagaaatacgtggatgctgaaacttcattatagaattgaaccaagaggcattatacatatagatatatacatatgtaatgtgtgcgtatcatgtcactatatataagaatattgtatgtcatgctgtttatgtgtgactaccgggtttttaaaagtagtgtctggagtttgtaatgagcaccgtggagactatgtatttaatgaaatgctctctttgaagtgaggtacatggttcttaactattcaaatatttattctgttagaaaaaaaaattttctgttttgcaatagaaggatgtggagaaatgctttcagtctacttttcttaaatctctgttcatcagtggcaattcgtaaaaaccttaagtgatactttgtttatatgtttataatttttaggtgtttcctgaaattttcacatattatttcacttttgttagtgctttatgggaagaatagggagtctataccagtgctgtgggaaaaatggtaacatttcagggcttctctatttgtgtttcatttctgtagatgtccatcgtgtttcactaactggcgttttcttagccatagagatgactgtagaacaatagaaactttaataatgatagtttttaacttttatgtttaaattttttttaaatcttaaaaccttcatatctaggtatccattgtgacagacaagtaaaattgcaggtgatttgataattaagcacccataccatttataacttctgaatttaaaaagttatacaatgccagtttgcaatagttgattttgatgcctttgtagaatattttttctgaatccttatgctcttttaaagccaatgattcccactctgttctctgccttgtctctctttgtcttaaaatgctttagtttccatcaggttcaagttcttgactattattctcttataagtagtaggcgtaaataatcaggagttagaattctctcagaagggtctatgatcagtattactttattaagaattacctttcattttctctttatgttattctttcacttttgtagattacatttaatagcttgttacctgtgattttattttaaaatatttattttgatatgatgcttaaatattatataaacatttggaaaagtaacaaatagagtaaattgttaatgtaaatagttggtgcttactttcatttatgtttattatcttaaagcaattgatagattttacatctttgatataaagcactgccatatttatattttaaaaggaaattagacattttatatgtagctcagattaatgacatttttattttgtgtattagtttttgcttttctgagctttttaaagtctaacaaatctttttagtcatcttttatatacttttagttccacatgaaataaatgttgttaagcctgtaggactggatgaatggggttgtgaaactgatttgacaagagaataatttacaaaaatcaaatgagtattgagaagccacagaaatatcaaaaatggtgacatcactattaggatgaaaattttatgaaattccaatgctccctttaaccatataattaaattacaaaggtatacataattaatctaataaaggatcatgaggaatgccaaaagctgaaattttagcaagtctggtgttttaaattcattataaactatttattaactaatgtaatgtcctcctctaagaccatattgtaagagtcttgttaaaatgatggattcaacttctgcctcggatgagaggttggaaatgtagctgcttttctttagaaaatatgtagctgtcatcatttggtactgcctaaaaagagttagactctattggcaattgatagagtattacccacggtgcttattattgtttatgagcttccattgtaatgattcctttttatttgtagcagcataattatttccaaagaccccagtatttgctgctatttttaaaactcccctgatgtacctgaacaagaggatttcctcacatcatttccttgtgtctggacatcaggggtaacaactgtacttactttacaggaagaaattttaaaactgaaaactacctgggatcatagtgtttctgtgattttatttaattgtgtatagtaattatccagtgccagaaaaaccgtcacttgcaaaatactttgcactcaaaatgtttttacaatgcttctaaatgttactggtttctgctttcttttgactacttgactgacaaaatgatctgactactccatttaagagcaaaggtaactcatgtttaggtaattaactgcttgttttaagtgattatatttcttccactgtttttgaaaaataatcaaagatagcattcattgagagacagtgacagatataatttactacatatattgatttttaaataaagttgccttaaataagtgtatgtaagcagtagtagttgctatgtactgatttacctcaaggtgcaaaataattaaacctgtacatattccatttacaaaataaattcagccctgcactttctttagatgccttgatttccagaatggagcttagtgctactgaataccctggccacagagccacctcaggatattcttttctccaccctagtttatttatttatagatatctgtttacaaagtctgtagtaaatcctgatgctgaccatctgaaatgtactttttttctgaatgctgtttcaatctaaaatagcagcttttgagaaaacaatgatgtaaattccttatgataaaaggatgattctatatattctttaatgatattaaatatgccgaagccaagcacacagtctttctaaagtgtgtgtatgtttgtgtgaatgtgaatgatactgatcttatatctgttaaaagttgttttaaaaagctgtggcatcccattgttcatatttgccaagtcttctgtaaagatgtctaggacgaaatattttatgtgctaatgcatgtatttgtaaaccagatttgtttaccactcaaaattaacttgttttcttcatccaaaaaagtttatttcttccacgtacttaaattttctgtgtgggtataatatagctttctaatttttttctttcacaaaggcaggttcaaaattctgttgaaagaaaaatgctttctgaaactgaggtataacaccagagcttgctgtttaaaggattatatgatgtacatcagttctataaatgtgctcagcagtttaacatgtgaatcctgttttaaagtgctcagatttcaactgtgtaagccattgatataacgctgtaattaaaaatgtttatatgaaataacttaatgttttaaatttatttatgtagatcacatcatttttatcgtatgcagtgcaaatatgtgaaatgtcttttggtttattccaacaattatttattttagaaagtaagtttaaagactttaaggacattcaaagtttaaaatagtgttcaaattgcaaaatttggcaatcttcatataaattggtttcttttctaacttttcaaaaactaacattaaatgtcaattataggaaaacatagttggaaatgtaatcatccaaagatcatttttaaaatgaaatttaattagcacatattgaacatttgacttaattgttaaaccccagttttgttttgtttttttaatcagatttttgcacactgattagtttttgtgttgtggcttttgttgctttattattcaaggttttttttttttttcttccccatgggggagattgtcttccaatgtttaactacgtttaaataaataaaaattgaattttattgttcatttatataaaatctgataccttgatgtaatttcacaatacagttccaatttttatggcttttataattacaatgatattttcttctataataaaatccaaagtaaacatttaaattgtagaactgatatttttcatttatatgaagtataagcctctactgggtctatattgtgaatcatcctgcctttcaaatttgtttcataattgttagatgaaaactatttttttggagatgttactgaagttgattgagcaataaaagtctacttaatta

SEQ ID NO: 39 - DNA, 1159 bp, Homo sapiens
agtgccccaggagctatgacaagcaaaggaacatacttgcctggagatagcctttgcgatatttaaatgtccgtggatacagaaatctctgcaggcaagttgctccagagcatattgcaggacaagcctgtaacgaatagttaaattcacggcatctggattcctaatccttttccgaaatggcaggtgtgagtgcctgtataaaatattctatgtttaccttcaacttcttgttctggctatgtggtatcttgatcctagcattagcaatatgggtacgagtaagcaatgactctcaagcaatttttggttctgaagatgtaggctctagctcctacgttgctgtggacatattgattgctgtaggtgccatcatcatgattctgggcttcctgggatgctgcggtgctataaaagaaagtcgctgcatgcttctgttgtttttcataggcttgcttctgatcctgctcctgcaggtggcgacaggtatcctaggagctgttttcaaatctaagtctgatcgcattgtgaatgaaactctctatgaaaacacaaagcttttgagcgccacaggggaaagtgaaaaacaattccaggaagccataattgtgtttcaagaagagtttaaatgctgcggtttggtcaatggagctgctgattggggaaataattttcaacactatcctgaattatgtgcctgtctagataagcagagaccatgccaaagctataatggaaaacaagtttacaaagagacctgtatttctttcataaaagacttcttggcaaaaaatttgattatagttattggaatatcatttggactggcagttattgagatactgggtttggtgttttctatggtcctgtattgccagatcgggaacaaatgaatctgtggatgcatcaacctatcgtcagtcaaacccctttaaaatgttgctttggctttgtaaatttaaatatgtaagtgctatataagtcaggagcagctgtctttttaaaatgtctcggctagctagaccacagatatcttctagacatattgaacacatttaagatttgagggatataagggaaaatgatatgaatgtgtatttttactcaaaataaaagtaactgtttacgttaaaaaaaaaaaaaaaaaaaaaaaaaaaaa

SEQ ID NO: 40 - DNA, 2081 bp, Homo sapiens
acagctcccattccccatgtagccgcgccctctccttcccctgggcgtctccggggcgtggacaggccgctgaaaggaaccggctgcggcctgtgtgaggctccgcgggccgctgcactgcgaggccgacgcagctggagagaagttaggcaggtcctagggagggcaggctcgagtgctgggcccgcctccccgcgggactgtaggcccgggggctccgcctcgtcgcagcggcaggtaggaggcggtgcgcgcggcccggcgacgggggatcctgaggcccgaagtgatgccaccaaaaagaaatgaaaaatacaaacttcctattccatttccagaaggcaaggttctggatgatatggaaggcaatcagtgggtactgggcaagaagattggctctggaggatttggattgatatatttagctttccccacaaataaaccagagaaagatgcaagacatgtagtaaaagtggaatatcaagaaaatggcccgttattttcagaacttaaattttatcagagagttgcaaaaaaagactgtatcaaaaagtggatagaacgcaaacaacttgattatttaggaattcctctgttttatggatctggtctgactgaattcaagggaagaagttacagatttatggtaatggaaagactaggaatagatttacagaagatctcaggccagaatggtacctttaaaaagtcaactgtcctgcaattaggtatccgaatgttggatgtactggaatatatacatgaaaatgaatatgttcatggtgatataaaagcagcaaatctacttttgggttacaaaaatccagaccaggtttatcttgcagattatggactttcctacagatattgtcccaatgggaaccacaaacagtatcaggaaaatcctagaaaaggccataatgggacaatagagtttaccagcttggatgcccacaagggagtagccttgtccagacgaagtgacgttgagatcctcggctactgcatgctgcggtggttgtgtgggaaacttccctgggaacagaacctgaaggaccctgtggctgtgcagactgctaaaacaaatctgttggacgagctcccccagtcagtgcttaaatgggctccttctggaagcagttgctgtgaaatagcccaatttttggtatgtgctcatagtttagcatatgatgaaaagccaaactatcaagccctcaagaaaattttgaaccctcatggaatacctttaggaccactggacttttccacaaaaggacagagtataaatgtccatactccaaacagtcaaaaagttgattcacaaaaggctgcaacaaagcaagtcaacaaggcacacaataggttaatcgaaaaaaaagtccacagtgagagaagcgctgagtcctgtgcaacatggaaagtgcagaaagaggagaaactgattggattgatgaacaatgaagcagctcaggaaagcacaaggagaagacagaaatatcaagagtctcaagaacctttgaatgaagtaaacagtttcccacaaaaaatcagctatacacaattcccaaactcattttatgagcctcatcaagattttaccagtccagatatattcaagaagtcaagatctccatcttggtataaatacacttccacagtcagcacggggatcacagacttagaaagttcaactggactttggcctacaatttcccagtttactcttagtgaagagacaaacgcagatgtttattattatcgcatcatcatacctgtccttttgatgttagtatttcttgctttattttttctctgaagatgataccaaaattccttttgataattttttaagtttccagctcttcaccgaaatgttgtattcttatttcagtgtttccttccagacatttttaaggtaattggctttaaaaagagaacatattttaacaaagtttgtggacactctaaaaaataaaattgctttgtactagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 41 - DNA, 2322 bp, Homo sapiens
ggctcggaggctgttcccacccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacggacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaataacattagaacatacaggaaaaacgaggcaggcagatcactttaggtcaggagttcaagaccagcctgtacgtgcgtgcctgtagtcccagctactcgggaggctgagatgggagaatcacttgaacctgggaggcagagtttgcagtgagctgagattgtgccactgcactccagtctgtgtgacagaatgagaccttgtcttgaaaaaaaaaaaaacaaaaaaccacatacaggaaa

SEQ ID NO: 42 - DNA, 2455 bp, Homo sapiens
ggctcggaggctgttcccacccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacggcaggcctgatgaaattatagaagagagaattcaaactaaagcttttcaagagtatagcccagctcacatggataccgtctctgtcgtggctgctttgaactcagacctttgtgtctctggagggaaagataagacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaataacattagaacatacaggaaaaacgaggcaggcagatcactttaggtcaggagttcaagaccagcctgtacgtgcgtgcctgtagtcccagctactcgggaggctgagatgggagaatcacttgaacctgggaggcagagtttgcagtgagctgagattgtgccactgcactccagtctgtgtgacagaatgagaccttgtcttgaaaaaaaaaaaaacaaaaaaccacatacaggaaa

SEQ ID NO: 43 - DNA, 2452 bp, Homo sapiens
ggctcggaggctgttcccacccccaggctccgcgttcccgccggccccagctccagccccgcagcccaccgtgcaaacatgcttagacagagaagagattaacttcagtggcttcccactaattacagagattaagaagtggctgcctgaactattttccaaaggatacacattacaaattattgaatagggcagctaaccaagaagatcctattggtttggggggaacacaacttccagcagccacaagggatgctgctactcaggtgccaactgaaacaagctcctccacagaaggtttcgtttaggttttgtgtcgtgatggggaaacagcaaagcaaactcaaacacagcacttataaatacgggcctgatgaaattatagaagagagaattcaaactaaagcttttcaagagtatagcccagctcacatggataccgtctctgtcgtggctgctttgaactcagacctttgtgtctctggagggaaagataagacagttgtggcctataattggaaaactggaaatgtggtgaaaaggttcaaaggacatgaacatgagatcaccaaggtagcctgtattcccaaatccagccagttcttcagtgcctctcgtgacaggatggtcatgatgtgggacttgcacggttcctcacaaccaaggcagcaattgtgtggccatgccatggtggtcaccggattggctgtgagtccagactcatcacagctgtgcactggctctcgggacaacaccctgcttctgtgggatgtggtgacaggacagagtgtggaaagagcatctgtctccaggaacgtggtcactcacctgtgctgggtccccagagaaccatacatactacagacctctgaagataaaaccctcagattatgggacagtcgggggctgcaggtagctcatatgtttcctgcaaagcagcacattcagacctactgtgaagtcagtgtggatggacacaagtgtatctcctgcagcaatggctttggaggagaaggctgtgaagccacgttgtgggacctaagacagactcgaaacagaatatgtgagtataaggggcatttccagactgtcgcatcctgcgtctttctaccaagagcattggccttgatgcctttaattgctacctcatcacatgattgcaaggtgaagatttggaaccaagatactggagcctgccttttcaccttgtctctggatggatcaggacccttgacttctctggctgttggtgacgccatctccttattgtgtgcaagttttaacagaggaattcacttactcagaatggaccacagccaagggctggaactgcaggaagtggcagcattctgaggccaagagacactcactggacaatatcaaaccatggctcctcctcagcatggctttgtgtctttcccagttatcttgaggggagtgggatgtagggctggtattctttgcttaggttcatttacaagatgtatcagtgttgtaagtccaataatttaagtccagtgattcaaaatcaggtatagagtccagaaacatggactacacataaggttctctatttaagttaaatacaaatgcaactttttagtgagcttttaggactactcttcaaaaaaagtgtattgctcagaatgatgacctgtaaatgtaagagtggcaggcctctgtctgtgaaagtcagaacacagggctcgagcctctggaactgaccctttgcaagtctttacaaaagaaaaaaggcagtggggagagagagtgttttggttacatcagaaataattgagatgggaaagaatagtgcagctccatagaggagacggactgtagacaatgagattaagcttcaatcactgctcctcagcaatgtgaagaatcaaagtcagggcaagaaagcgaaagcttggacttctattcaaagtggcagcagagtgggagggcggtacccttctagcccagtgctgctgagcttgtgtgaaaatcagacctgagatggcttgaagcagccaagaaccacatgggcattgcccagaattacaggagttagcacaccagctctacagataagaaaacattgaaattcaaagattaaggccaaaaatatctcacttgcaattttaatattttcatttggatttatataaatgaaacatatatatgttttggaatggccagagtgaggcaaaggggatccctgaaataacattagaacatacaggaaaaacgaggcaggcagatcactttaggtcaggagttcaagaccagcctgtacgtgcgtgcctgtagtcccagctactcgggaggctgagatgggagaatcacttgaacctgggaggcagagtttgcagtgagctgagattgtgccactgcactccagtctgtgtgacagaatgagaccttgtcttgaaaaaaaaaaaaacaaaaaaccacatacaggaaa

SEQ ID NO: 44 - DNA, 1945 bp, Homo sapiens
ggggaagcaactcggcagcggaccaagatggcggcgccctgtgagggacaagcgtttgccgtaggggttgaaaagaattggggtgcagtagttcgctccccagaagggaccccccagaaaatccggcagctgatagatgaggggattgccccggaagagggaggcgtggacgcgaaggacacgtctgccacatcccagtcagttaatggatcaccccaagcggaacaaccttcattggaatctacaagcaaagaagccttctttagcagagtggaaacattttcttctttgaaatgggcaggtaagccctttgagctgtctccactcgtctgtgcaaaatatggctgggtcacagtggaatgtgatatgctcaagtgctctagctgtcaagcttttctctgtgccagtttacaaccagcttttgactttgacagatataagcaacgatgtgctgagctgaagaaagccttgtgtactgcccatgagaagttctgtttctggccagacagcccatccccagaccgatttgggatgttgcccctggatgagcctgctattcttgttagtgaattcctagatcgttttcaaagcctttgtcacttggacctccagcttccttccctaaggccggaggacttgaaaactatgtgcttgacagaagacaagatcagtcttctcctacacttgcttgaagatgaacttgatcaccgaactgatgagagaaaaactacaatcaaattaggctcagacatccaagtccacgtcactgcctgtattctctctgtgtgtggctgggcgtgtagttcctctttggaatccatgcagctctccctgataacatgttcgcaatgtatgaggaaggtggggctctggggcttccagcagattgaatcgtccatgactgacctggatgcatcctttggcctgaccagctccccaatcccaggccttgaggggcgaccagagcgcttacctctggtgcctgaatctcctcggaggatgatgacccggagccaggatgccactttctccccaggctcagagcaggctgaaaagagccctggtcccattgtctctcgaactcggagctgggactcttccagtcctgttgaccgtcctgagccagaggctgctagccccaccaccagaactcgcccagtgacccgaagcatgggaacaggagacacccctggcctggaggtaccatctagccctctgcggaaagccaagcgagctcgcctctgctcctccagcagttcggacacatcttcccgaagcttctttgatcccacctctcagcatagagactggtgcccttgggtgaatatcacacttggcaaagaaagcagggagaatggtggaactgaaccagatgccagcgccccagcagagccaggctggaaagcagtgctgaccatcctcttggcgcacaaacagtctagccagccagctgaaacggactccatgagtctctctgagaaatcaaggaaagtattccgaatatttcggcagtgggaatctctgtgctcatgctgaagatactccagcgccttcctggagatagctggaatgagagtgactttttgaaaaattaaggctgagttcctttcggtcagctgacactaagtttttcctgttctgggttaatcataaggagccccctgccatagcaaaggcagtgagtgtcaactatctgcatctggctgagagagacccgtttcctttcagggatgtggacagggtaagggcagcaagcatggttctgttaaaggagtgtgggattaacagactagaaggaagactaaggacctgaccacccatttcagcatcttcaatgtggagcagtgttctgaggactcttctatcctaggactatgacagtgtgtattaataaaatatttgctaagattctcaaaaaaaaaaaaaaaaaaaaaaaaaaaaaaaa

SEQ ID NO: 45 - DNA, 3789 bp, Homo sapiens
ggggtacccggaagcgcgcgtggacctggcgcaccgagccgggcgggcggaggggcggttgggacggcgcggggaggcgggcgcgccgcccgggccgcggcgggctgtggtcacaggtgggcggctgcggcgagggagcggccgagcggagcccgggtcccggagactcctgccgtcacgcccggggctccgcgtagcagagatcgggagacgcgtctgtgcctccggggaagccgacccatctcccctccgcctctttggctgcagttgcacctccggccagagggcaggtgcaaatcatgacacagaagggcagtatgaagcctgtgaagaaaaagaaaaccgaagaacctgaattggagcccctgtgctgctgcgagtacatagatcggaatggggaaaagaaccacgtggctacttgtttgtgtgattgtcaagatctggatgaagggtgtgatcgatggattacatgtaaatctttacagccagagacttgtgaaagaatcatggatacaatttctgatcgcctccgaattccttggcttaggggagccaaaaaagtgaacatcagcatcatccctccgcttgtcctgctgcctgtcttccttcatgtggcttcctggcatttcctcctgggggtggtggttttgacctcccttcctgtgctggcactgtggtactactacctcactcacagaaggaaagaacagaccctgtttttcctgagccttggactgttctctctgggctacatgtactatgtgttcctgcaggaagtggtccccaaagggcgtgtgggtcccgttcagctggcggttcttacctgcgggttatttctgatactcttagccttgcacagagccaagaagaatccaggctacctcagcaatccagcaagcggtgacagatctctaagcagcagccagctggagtgcctgagcagaaaagggcaggagaagaccaaagggttccctggggcagacatgtcgggcagtctcaacaatcgcacaacaaaggatgaccccaagggctcttccaagatgccagctggaagccccaccaaagcgaaggaggactggtgtgccaagtgccagctggtgcgaccagcccgggcatggcactgccggatatgtggcatctgtgtgaggagaatggatcatcattgtgtctggataaatagctgcgttggagaatcaaatcatcaagcatttatacttgcccttttgatcttcttgctcacctcggtgtatgggatcacactgaccttggacaccatttgtagagacagaagtgtcttcacagctcttttctattgtcctggagtttatgcaaattacagctcggctctgtccttcacctgcgtgtggtactctgtgatcatcacagcaggcatggcctacatcttcctgatccagctgatcaacatcagctacaatgtgactgagcgggaagtccagcaggccctccgacagaagactgggcgccggctcctctgcgggctcatcgtggacacagggttacttggatgagccaactccgcttccttcccatggataggaagggactctgtgtattattcaggtttattggcacgaagatacttgttttaagttccttgagaacccatgatggacagttgacagaatgcttaaacctgtcaaaagatgagtgatcttgtgtgggaaaagccttcccaggcgtctgtaccgaaaggagcagcaaacaaggggctaatccatgagcagtgttctgtaggctctgtgacatctttggtttataggattttggagccttttatgatctggaactatttgaggggtttcattataggccttggttctctccaggggccagatgagtttattgtggaatctttgaaaggacaaggcctctgtgaatgaatcagtcccagggaagcatttggtggtggcggcagtggaggattgcccggtgaacctataaatcagcagtctcttgggcagaggagcaagcccctcgaacatgatttcaaacaagcaggtcctcttctctcatctcacgtccttagtctctgttaatgaacatactggatgtggagtttaataaattacctactatcatctggccacttagattattatcacaccactgtggactgttcctggggggagaagaacagaccgatttgaaagattcaagggagaaagattaaggatcaggattgcatgaaagaagaaaatccttcaatatttaaaatgtttcttacaatacccacggagcacttttatggttccagccgagcgttcctgaaatgaactgaccattaacagcgcctctttgataggttaccctgatgctgctaaagtaaagccttaagtgtgtttttgggacaacgtgctgcttattccacctcagccacatatgtgtttgtgtttaggatattgtaaatctttgctaagtagtgttttccttggtgaatgaagtcattgttgtcttcaagtgtaccatctgcctagcaaaaaattgctacaaactttctcttatgcaatagtccttggtacttctaatatttttagcaagagacaattttctgtactagaatcttccactgccagaaaacacagtgccagtaaggttctacataccactgaccatctgcttaatagacatgtatttcctttgagtaggacattagcttttgattataaagctcaactagtataagcaaaaatataacatctagaagcacagttttagccaggatgtttaaaaattacagttttgtgagacttaagggtctttttaacctaggtaagtttatatgacctaacttaattgtagccatattctggtaccttccattttgaaaagtagaggttgcttaagcaagcaatggataataagagacttttcctgaggcacctgtttggaatctggttttctcagcggcagcttgacatgtgcacccttttgtattaaacactgcaagggtgatgcaggggagcaggaaagccatcctaaactcactactgagtacgattcagtatgttcctgtggatgtctgctgtgactaatataaatttcttgcagaatcagctacacttaattatgttgctgatagacaagcatccacgcttcagctggcactaagtgttttcattgtaggatcagcagcaggttaaagactgaacggttagtgaagacaaatgtcttaagaggctgcgatgtctaggttgggcttgtgacttcttagtggcctagccttcttgatggcaccttgaaagtgaacttctagaaatctacatttaaaaggcaaagctttaaaagcagagctagtctattctagttactgatgcaactaaaattctgtatttcttaagatggagccactgacgagatgtcacagtatagagcctgcagtctcaactcattgtgatcctaatggtctgggtgattggatggtttgagttgttagggattttgagtttttcattttattgcatatctgggttggatgttagactaaaggaaacccaggaatatttacctggtgttacatttaatatttaatgtaactggtctagcaacattaagggggatttctgaagccaactccggaggctgtgggctgcacattttgcactgtttttatatacttgtattcatatcctcttatcacctcagactcagacacaaggccttttacatggaaattttacaaattacttccatttatgtaaaataacgtcctgtgaccaagttgtttaaatggaaaataaagtgctttctttaaggaaaaaaaaaaaaaaa

SEQ ID NO: 46 - DNA, 4078 bp, Homo sapiens
agtgaagcggaagccattactctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtatgccagcttggagagtcacgtgagagcaagagagtagctttctggttgtcctggtgccctgctcaggcaaactgactgccattctctgaggatggcagctctgtcccccacatttgccacgtccacccaggattccacctgtctccaggactcagaatttcctgtttcttcaaaagaccattcctgtccccagaatttggacctgttcgtgtgcagtggtctggagcctcacacacccagtgttggttcccaggaatcggtgactttccaagatgtcgctgtggactttaccgagaaggagtggcccttgctggattcttctcagagaaaactgtacaaagatgtaatgctggagaactacagcaacctcacttcactggggtatcaggtcggcaaacccagcctcatctcacacttggagcaggaggaggagccgaggacagaggagaggggcgctcaccagggcgcttgtgcagattgggagactccatctaaaaccaagtggtcacttcttatggaagatatttttgggaaggaaacgcccagtggtgtgacgatggaaagagccggtcttggagagaagtccactgaatacgctcacttgttcgaagtctttggcatggaccctcatctcactcagccaatgggaaggcacgctggcaagaggccctatcaccgccgcgactatggggtagcgttcaagggcaggccgcacctcactcagcacatgagcatgtacgacgggagaaaaatgcatgaatgtcatcagtgccaaaaagccttcaccacgagcgcgtccctcacacggcacaggagaatccacaccggggagaagccttacgagtgcagcgactgcgggaaagccttcaacgacccttcagcccttaggagccacgcaagaactcacctcaaagagaagccctttgactgcagtcagtgtggaaatgcattccggaccctctcggccctgaaaatccacatgcgagttcacactggcgagaggccttacaagtgtgatcagtgcgggaaggcttacggccggagctgccacctcatcgcacacaagagaacgcacaccggagagaggccctacgagtgtcacgactgtgggaaagctttccagcacccctcccacctcaaagagcacgtgaggaatcacacgggggagaagccctacgcgtgcacgcagtgcggcaaagccttccgctggaagtccaactttaatttgcacaagaagaaccacatggtggagaagacctacgaatgtaaagaatgcgggaaatcctttggcgatctcgtgtcccggaggaaacacattaggattcacatcgtcaagaaacccgtggaatgtcggcagtgcgggaagaccttccgaaaccagtccatccttaagactcacatgaactctcacactggagagaaaccatacgggtgcgatctctgcgggaaagctttcagcgcgagttcaaacctcaccgcacacaggaagatacacacgcaagagagacgctacgaatgcgccgcctgcgggaaagtcttcggtgactatttatcccggcggaggcacatgagcgttcaccttgtaaagaaacgagttgagtgtaggcagtgtggcaaggccttcaggaaccagtcaacgctgaagacgcacatgcgaagccacacgggggagaaaccgtacgaatgcgatcactgtgggaaggccttcagcataggctccaacctgaatgtgcacaggcggatccacaccggggagaagccctacgaatgccttgtctgcgggaaagccttcagcgaccactcatccctcaggagccacgtgaaaactcaccggggagagaagctctttgtgtcatccgtgtggaaaaggctccagtgagcgcgcctgctttagagacacaggatgattcagaccggaaacagacctcgtgggtgtaagaggaagcctctgtgagctcgcaccttactgggtgcaaaagaatccacggaacttgggagaagtccagttcctgtaaaaactgggaagacgaggcgttctcatcccataggaggtttgtgagaactcacgccgggggtgaaaatgtacgtctgtagcatggagaagccttcagggtacattcagctcttaacaaacacaggaggacttaatggcagcttggcatttaatgtcaaaatccaagccgtggcatttaatgtcaaaatgacttcagaccacttctagccttctgggcccatgagtaataatgagcacactagggagcatctctgtaaacacagtggctggggaaacccttcctagtctcacttgattcctcatgacggaaatcacactaaagagagaaatcagtgaagtaaggaacgtggaaggtcatgaatgggcagcaaaccacggccagctgcttgtctttgtatggcttgtcagctaacaatagtggttccctctttaaggaagaagaatgtttgatggagaaaatttgtggccaatgaagtctggaatacttcctgtcatctgccccttccagaaaaacttggcccgacccttggtctacagcacgggttctcagtcgggcgacgatttggctgtctaggcgtcatttggcaatgtctagagacatttttggtagttagaatggggggaagatactcctgacttgtaataagaagacatcagagatgctgctaagtcggctccagcacacaggagccccccacaacgaagagttagtgcccccaaacgtcactgttgctgaggttgaaaataatcatgcagtcattcctcaattactgcctgcagcaattcctccatttttatgaatcttgtgagcacttacgctaggagaaatttcttttacaaaacttttaaaatacaattagtgctgataattcctatgtggaaatgattccagccatggtcccctcacttgagcatgtgaatattctcacggagagaagccccagcgagattttccggtgaatacgggattgcacttactctttcatcacggaaacagaccccccgagagaagccccaacgagattttccggtgaatacgggactgcacgtactctctcatcatgaaaacagagccccgttcataaatttttcatctttatttttaaggttatactcctctaaataacccttaagcctcatcaagaaaggtttgtttatagtatttttactatagcttcatccttgataacgtcctaatttccttctggacaacctccttgaccaatggcatattgagatctatgtgacatgaggatatttctcagtaccactttgttactggtacctgatgtacacggattgcgaccagagcatgatgcctccatcaagtggtaatatgtttgcagcctgctgtccagccaagagtgacagatacttctagtgacttccccggtatccactctcatcttcttccaatatcaagagaatccaggttctgtcagattagtaaggtgtgctaatctaaattttaaaaaatctcttacaggttttcttgcagctggtgccatccatgtctcacagccctggccactggcagatcagcagatgtcaccacatgggcttctgagaaagctcttgaatggggatcgttcttaaacatgaattcctccctgtatgttttgttctttgctttacttttcaccttgcaaagagatccagtacctagtattggaagatccaccttaacgaccgtgcatatgaaaaccacagtctaaggaagtgactgcagaaagctcacagcgaccctggcctcccctgtggcctctttgagtgtctgcagcagccctggacttccagacttctatcacatgagaaaaaataaaactgattattggtttaaaaaaaaaaaaaaaaaaaaaaaaaaaaa

SEQ ID NO: 47 - DNA, 5163 bp, Homo sapiens
atttgcgccgtgtagagttgcatgctgggaaacactgacgggcgcccttccagctgcgtcgaagcttctctggtttcgcattacatttcccagagggccttggggcacagtccaatgaggagcgagccgggtggccggctgaggggcgtgcttcatgctcgcgggatttttaaaaatggtttctcctggatcttatcccaactgcgcctgagaccttgtttcacctcctgatgtgctgggtgtggttaggcctcgagccgggagctatttgcctcccaggaggaagccagggcagggttccgcggggaatggcggtgagggagccactcgggacgcggaggccctaaaatgaagaagcttcggcctgaggcttcgggagcggcgagcagggaagtgggagtgtgtgtgagtgtgtgtgtgtgtgtgtgtgtgtgtgtgtgaataagccagaggctgcctggtggggccccgccgtggcccagtgactgagataattgtcttcgtctgtggggtaatgcgaacaagccccgttcccctaagccgtgatgcatgcggggttgacgcggccgggctctgtccccataaactgtgacacaggtgtgtgtagacgtctatgagggccatagcgccgggctgtaagggcatctgtaggggtgacgcagccgggctgtgtctctgcacctccgttctgtgcgaggtcaatgctggtggggtctgcagaggtggcacggccaggacgggtctccgtgtctctgaaatgtgcctttgcacttctgtcaggttgacagggacaggcagtgtccctctggtgtgagcgtctgtgggtgtgaaagggccagcgagtgtgcggctgtgactggtcgggatcgggcctgggtgcatggccttttgagtgagcacaggtgtgtgcgaccatgtcacctgtctttctagtgtctccgttgcttcctgtgccttggccttccagccatgtggtacctgctagggagcagtggtcccaaagtgacgtgagaggctctacgctattgtgaaaatgaccaagaagaaggcttcacaagtcacgagatggcagttttggagccagaagtgctctccgtgcacactacctggacgacaagaggaagtaacctcaagaatagaattccttttggggaagaaagagctggccttcaggaaaagcatcccggaggaggaagaagaagtgttatatgtcctaaagtaaggtttcaggccagcatccttcagaaaaagcatccccgaggaggaagacgaatcgttaaacatctgaaagggtcaggccagcatccttcagaaaaagcatccccgaggaggaagacgaatcgttaaacatcttaggtcagctctagcctctcggaatttgtcttcttcagtggaaaccccgagaagactgatcagttcttcagttctaaaacaatggcccagggtttggtgacgttcgccgacgtagccatagacttttctcaggaggagtgggcctgtctgaactctgctcagagggacctgtactgggacgtgatgctggagaactacagtaacttggtctcactggatttggagtcagcatatgaaaataagagtttacctacagaaaaaaacattcatgaaataagggcttccaaaaggaattcagatagaagaagtaaatcccttggccgtaactggatatgtgaaggtacgcttgaaagaccacagcgctccagagggaggtatgtcaatcagatgatcatcaattatgtcaaaagacctgctactagagaaggcacccctcctagaacacatcagagacatcataaggagaattcctttgaatgtaaggactgtgggaaggcctttagtcgtggctatcaacttagtcaacatcagaaaatccatactggtgagaaaccttatgaatgtaaagaatgtaagaaggccttccgttggggcaatcagcttactcaacatcaaaaaattcatactggggagaagccctacgaatgtaaagactgtgggaaggcttttcgatggggctcaagcctcgttattcataagaggattcatactggtgaaaaaccctatgaatgtaaagactgtggaaaggcctttcggcgtggtgatgagctcactcagcaccagagattccacactggggagaaagactacgaatgcaaagactgtgggaagacctttagccgtgtgtataaacttattcagcacaagagaattcatagtggggagaagccttacgagtgtaaagactgtgggaaggcttttatttgtggttcaagcctcattcagcataaaagaattcacacaggtgagaaaccctatgaatgtcaagaatgtgggaaggcctttactcgagtcaattaccttactcagcatcagaagatccacaccggtgagaagcctcacgaatgtaaggagtgtgggaaggcctttcgctggggttcgagcctcgttaagcacgagaggatacatacgggcgagaagccgtacaagtgcacagaatgtgggaaggccttcaattgtggctatcacctcactcagcacgagagaatccacacaggcgaaaccccgtataaatgtaaggagtgtgggaaggctttcatttatggatcgagcctcgtgaaacatgagagaattcataccggggtgaaaccctatgggtgtacagaatgtgggaagagctttagtcacggccatcagcttacacaacatcagaaaacgcacagtggggcgaaatcctacgaatgtaaggagtgcgggaaggcatgtaaccacctaaaccatctccgagaacatcagaggatccacaacagttgaagagccttttgaacgcagtagcccgctcgtatctatggtttcgctttccacagtttgttacctgcagtcaactgcagttcaaaaatattaaatggaaaattccagaaataaagaattttaagtctcaaatggtgtgcccttctgagtagcgtgatgaaatctctcgctgtccggctccagccggccggggatgtgagtcatcccttggtccagcacatccacgctgtatacgccacccaccctgctagtgacttagtagccgtcttggtgatcagatcaactatcccagcatcacagtgcctgtgcccaagcagtcctcactttgcttaacagtggccccagagagcaggagtagtgatgctggtgattcggatatgccaaagagaagccacaaagtgcttccttttaaatgaaaaggtgaaagttctcaacttaaaaaagaaaagaaaaaaatcatatactgaggttgctaagatctacatgacaataagatattttgggagagagatacgttcacataattttattacatatattgttacaattgttctattttgttagttactgttggtaatctcttactgtgcctaatttataaattaaactttagatatgtatgtacaggaaaaaatgtagtatatagtatcgtatatatgtacaggaaaaaaacgtactatctgtggtttcaggtgtccactgcgggtcttcaaacgtacccccctcaggtgagaggggactgctgtacaaagaatataggaaggcctctagactacatccattccttcctcaacaggaggaaaattcctggtacagtttaacgtaaggcttcactgatcactgttgtttttgtttttgtttttgtttttttgagacagagtctcactcttgcccaggctggagtgcagtggcacggtcttggctcactgcaacctccacctcccaggttccagcaattctcctgcctcagcctccccagtagctgggattacagacatgcaccaccacacctggctaatttttgtatttttagtagagacagttttcaccatgttgtccaggctggtctcaactcctgacctcaggtgatccacccaccttgccctcccaaagtgctaggattacaggcgtgagccactgcacctagcccactgatcactcttctgcttacagaatatcagaagtcattctagaggcaaatttgaagagtggaaaaatcactttttctgaatgatcttgtttttggtgtagatgtttttattgtgtgggttagtttaatgaatacataaagactaccagtaccattctgtctttactccgtggcatctgtggaataaccctgctaatgtaacacgtgagaaagcctttggtcatgccacccactctaccagttgtccccaccatcccccgccctcctccctgtgagacactgggccaaaggctcactacccctgtgcgttgtccagcacacagacactatgtgcattatttgtacataaggataatcacatctacctgagactgctatcatggaaattaaatgtttggtacatgtaaagtctttgaaagtgtaactggaatattgtgtaattttaataaataataactattgttgtttttatgatcattactaccatttgtgttgccattagtgaatttttacaagaaaactccctgtgggtgcaatgagtctggaaaagaccattgagtcttctagaagaaaacattaagagattattggcacagccgtgggttacgcaatgatttcttagtacacaaaacacagcaaacataaaaagttgttacacttcatcaaaagtacaaagttctgttcatcaaatgatgctgttaagatagggaaaagacaagaaacaggactggaagaagatgtttgctctaaggtacacctgacaaaggaactctcatagaaaatataaagaatccctcaagttgaaaaaaaaatcaatttaaaggggagaaaacttcagcacgtctcaacagaagaccaccaaatggccaataagtaagtgaaaatgtattcaatgtcattgctcctcaaggaactgtagagtaaaaccacaatgtgctgtcactctagacagtcaccaggatgattaaatttaaatcacaataacaaggctgatttcagatgtctcaccacaaagaaggaggataagggagcgaggtgatggatatgttaattagcttgatttaatccttccacattgtatacatgtatcagaacatcacattgtactccatcaatataatacaattattatttgtcaatcaaatattaataaaatcaaagatgagcaggaaaaaaaaaaaaaaaaaaaa

SEQ ID NO: 48 - DNA, 1591 bp, Homo sapiens
ccctcgcctacagaggcggcgctgtccctgatcgagcggcgggagcgagggttcagagatgggcagtgagaaggagcagagtccagaaccacacctgcctgaggaaggggaagggggtaagccttggagagtggatgactcagagggttcttggatcccacctggggagaaggagcatgggcaagagagcctgtcggatgaactgcaagaaactcatccaaaaaagccatggcagaaagtcactgtccgggctcgagagctaggggaccccattgctcatccaaggcatgaggcagatgagaagccctttatatgtgcccagtgtggcaaaaccttcaataatacctccaacctgagaacacaccagcggatccacactggtgagaagccttacaagtgttctgaatgtggcaagagcttctcgagaagctccaaccgcatccggcacgagcggatccacctggaagagaaacactacaaatgccccaagtgccaggagagctttcggcggcgctcagacctcaccacgcaccagcaagatcacctaggcaagcggccataccgctgtgacatctgtggcaagagcttcagccagagtgccacgctagctgtgcatcaccggacccacctggagccagcaccctacatctgctgtgagtgtgggaagagcttcagcaacagctccagctttggcgtgcatcaccgcacccacacaggtgagagaccttatgagtgcactgagtgtgggcggaccttcagcgatatctccaactttggagcacaccagcggacccacagaggggagaagccctaccggtgcactgtgtgtgggaaacacttctcccggagctcgaatctcatccgccaccagaaaactcacttgggcgaacaggctgggaaagattccagctgaaggagagccccatttagagtgagggagagagagtgagagaccctaacctattggaggaagatcttcagcatcttttgctgctaccttgacctcaagcccttcatcccactttggagaatggttttgtatagcctctgaagtcaggatctcaggaagtcctgaggagggactctggaataaaaacccttgcctctttccaggccaatttctcgtgttggaaagtcagaagacccagtcttggctttactttcttggggtgaaagagaaatagggtaggctcagaacatgctcatgttattaaggcagcagtccccctggcctttgaggaagtacttatgagatgggtgtcactgtctgaaggttctccaaattgtctgtgaactgcttaggtaggagtgcactgcagtttcctgctagttcccacctgttgtgccccaactttgcttctagatctctggggtgggaggagtgaccttctcaatggaaggggcctccttggtctggagaagagatctgaggtcccaccttagaaatgaaagggaaaccctcagggagccatgacccagggaccttcacactcccccatgtttgttacttgttatccctcccccaacctgcctctgttttccccagagtgattagcagtaaaacccttcaatgaaaaaaaaaaaaaaaaaa

SEQ ID NO: 49 - DNA, 2560 bp, Homo sapiens
gccggagccagcagtggcaacccgctggggtccctttccacactgtggaagctttgttctttcgctctttgcaataaatcttgctacttctcactctttgggtccacactgcttttaccagctgtaacactcaccgcaaacgtctgcagcttcactcctgaagccagcgagaccacgagcccaccgggaggaacgaacaactccagacgcgccgccttaagccttaagagctgtaacactcaccacgaaggtctgcagcttcactcctgagccagcgagaccacgaacccgccagaaggaagaaactccgaacacatccgaacatcagaaggaacaaactctagacgcgccaccttaagagctgtaacactcaccacaagggtccgcggcttcattcttgaagtcagtgagaccaagaacccaccaattccggacacagttggaaatgcagaagggcacttgagtttggctgcagtctcccacacggagaccttctggaggaagatgagccctaaacgcgatgggttggggacaggtgatggtctgcactcacaggttttacaggagcaggtctccacaggagacaatctccatgaatgtgactcccagggaccaagtaaagacactttggttcgtgaggggaagacctacaaatgcaaggaatgtgggagcgtgtttaacaaaaacagcctccttgttcgacatcagcagattcacactggggtgaagccttatgaatgccaggagtgtggaaaagcctttcctgaaaaggtcgacttcgttcgacccatgaggattcacacaggggagaagccctgtaagtgcgtggagtgcgggaaggtcttcaaccgcaggtcgcacctcctgtgctaccgccagattcacactggagagaagccctatgagtgcagcgagtgtggaaagaccttcagctatcactctgtcttcatccagcatcgtgtgacccacactggagaaaaactctttgggtgcaaagaatgtggaaaaaccttttactacaactcttccttaacccggcacatgaagattcacactggagagaagccctgcaagtgcagtgagtgcgggaagaccttcacctaccgctctgttttcttccgacatagtatgacccacactgcaggaaagccctacgagtgcaaagaatgtgggaaaggtttttactacagctattccctcactcgacatacaaggagtcacactggagagaaaccttatgagtgccttgaacatagaaaggactttggctaccactctgcttttgcccaacagagtaagatccactctggaggaaaaaacctttgagtgcaaatgatgtgggaatttgtgggttttctttttttttttttctttgatacatagagagccacactgaggagaagcactctgaattcagtggcagtaggaaagctgtgacctgcagctcatcctcacttggcattgaagaattccttccagagataaactctatgagatatgtgggaaggccttttgcaagtgggcccacatcagtcaacgtcagagaacttaaactgcgaaaagacattttgacaaaaactagtgaagaaaatcttttggccacaggaaatatcttcctcagcatctgagaatttttccaggagggagacctgttggttattgtgcacttaaaagaaccacccacacctctctccatagtttatatcactaagccacttcaggattttttttttttaagtaagaagggaactgtaaaagagaaaaaaagaaattcatgcatagcttctgtcagacttctctgaaagccatgcctatcaaaatttgaattcagttcttcattttgcagatggctgaaagggacgagagaatgatggtgaagctgtgttgctttcccaggtgagccttgattatttcctctgtgctttctcagcttctttggccttctgtaagaggggcttctccaagagcatgtcactagttttctagaagttaaacaagagctaagacaaacaaaacaaaacacagcttatctaatctaatgagaaactcagaaaaaaatgttttgatgaatacaatgtattaaaatataaaacatgtagatcctttgacatgttaattcaattctagaaatcctcagaaatgtttttatattatgcagagatgtgcgtgcaaagaataatcgctgcagttttgtttttatgtgtgaaacgttgagaacaatctaaatgtttatcagttggaagtaagttatggtacatctgttctatgaaatactgtgaaacaataaggtatctctgtatgtactgatatcaaaacatctctaagatacagtatttagtaaaagagaaagtttcaggaaataaaactacatctagaagtataagcataaaactgttaatagtggttttctgcaggaaatgggatggaccagggttatatgcaatgttcagtttttacttttatacttaagtattgtttatgtttgaaaaataaaaagcatttattgtttttgcaataaatgtttaaaatatttcaataaagatagcatgttagaataaaa

SEQ ID NO: 50 - DNA, 384 bp, Homo sapiens
cagcgagtgtcatgggcaaagcgaggagtccagcaggatggacgctgtgtggtttctcagctggagcgcagcaggagcaagcgtggaaacatccttcttttctcttctcccctcccctccccaagtgcaaatggaacctgtgaaatatggcttgattttgaggcttctaattcttcattgcactcccagacccttcttttatctctggtggcagccctgagaataaatctcttggtcacattcttcaatcagtttctcccagagaaaaggttaggctgcaaggatgataggaaccagacttcaaatgggtttccaggagctgagggaaggaaaggtttttcctacagtttctccagccaagggattaagaaaaggatggggtca

SEQ ID NO: 51 - DNA, 1555 bp, Homo sapiens
agtaccctcaggtgactacagatgtgttaacacccagcatgttccggtaggagactttctggatggggaagatttccaggaattggcaacaagctcatttcactggtgggtttgctgaagcattatcacaagacagtcagaatgactgatgagtgctcttcaggtgtgaatcatggcaatacagtgaaagacagtgatttactgcttttgagggcgtgcatgtatatgattaacggatggaagtgcaggactccaagatttacttccttccctttccagcagaattacctgagacgagtaaaatctactggtggagtcactccattattcttatctgtggagatctagatcttgatttgaaagtttctgagaaaatcttcagctcagacttgagggtcaactttaccagctgaaggatctgcatttactgctcaaccacatctaatttgatgtcctctgcagatttaaaatgtgtgccttcttttccgtcaccaagtcatccctgggttactactgaacatccttctcaattccccccgacccatggatggctgttctccattgtctgtttcaccagatgtcctcaaaacaaacagacagaagaaggaagtggctaatggagctgtggagtccaagtgtgactgccaagaggaatccagcaaagccaaaaagcccaagcatgtagccctgcccgaagcacgccacacgcatggaaaacccagaggaaatgagtgaggatcaatgggaagaagagagccagccaggaagttgaagatttgtccaggagcagatagctgaagagagagagagagaagagagaacggcttacagctcaggtcctctctccatgcttaggaaccactacaaatgctactgccttgagtctcattttgtttccctctggaaaccacatgtgtaccttgtttgcaacagtatggttctcgatctacacataggctggaatgcagtggtgttggtgtgataagggtcagtgcagtctcaacctcctgggctcaagtgatcctcctgcctcagccttttgagtagctgggaccacaggctcacaggcagaaggaattttccttgtcttggatgagacttttgacttggacttttgggttaagttctggagaccagaaggccaaaatcaaaagtatgggcaggcttgatttctttagaagactccagcggagaactgtgtctccttgcttctgattctacatctccatccatgggccactgtttcagcaacctcagccagtgcaacacaacctcagccaagaagagtatgcagagaaaggagtcccctacctgccacaaaactgttgtctgaaaactgtctcatattgtctcaagttgtcattcattgtgaattagacctgtttaacatgtaatctgcaacatgcttcactgtctaattttccagagcccctcatataaggaactgtattattggtataatcatcatggtgaagaagttggtatgtgggggagagatgacagaaacagagagtaagtcagagctggctgcctgacagataaaaaggaaatgacc

SEQ ID NO: 52 - protein, 411 aa, Homo sapiens
MNCCIGLGEKARGSHRASYPSLSALFTEASILGFGSFAVKAQWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDAMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 53 - protein, 395 aa, Homo sapiens
MPGRSCVALVLLAAAVSCAVAQHAPPWTEDCRKSTYPPSGPTYRGAVPWYTINLDLPPYKRWHELMLDKAPMLKVIVNSLKNMINTFVPSGKVMQVVDEKLPGLLGNFPGPFEEEMKGIAAVTDIPLGEIISFNIFYELFTICTSIVAEDKKGHLIHGRNMDFGVFLGWNINNDTWVITEQLKPLTVNLDFQRNNKTVFKASSFAGYVGMLTGFKPGLFSLTLNERFSINGGYLGILEWILGKKDAMWIGFLTRTVLENSTSYEEAKNLLTKTKILAPAYFILGGNQSGEGCVITRDRKESLDVYELDAKQGRWYVVQTNYDRWKHPFFLDDRRTPAKMCLNRTSQENISFETMYDVLSTKPVLNKLTVYTTLIDVTKGQFETYLRDCPDPCIGW

SEQ ID NO: 54 - protein, 670 aa, Homo sapiens
MGEPAGVAGTMESPFSPGLFHRLDEDWDSALFAELGYFTDTDELQLEAANETYENNFDNLDFDLDLMPWESDIWDINNQICTVKDIKAEPQPLSPASSSYSVSSPRSVDSYSSTQHVPEELDLSSSSQMSPLSLYGENSNSLSSAEPLKEDKPVTGPRNKTENGLTPKKKIQVNSKPSIQPKPLLLPAAPKTQTNSSVPAKTIIIQTVPTLMPLAKQQPIISLQPAPTKGQTVLLSQPTVVQLQAPGVLPSAQPVLAVAGGVTQLPNHVVNVVPAPSANSPVNGKLSVTKPVLQSTMRNVGSDIAVLRRQQRMIKNRESACQSRKKKKEYMLGLEARLKAALSENEQLKKENGTLKRQLDEVVSENQRLKVPSPKRRVVCVMIVLAFIILNYGPMSMLEQDSRRMNPSVSPANQRRHLLGFSAKEAQDTSDGIIQKNSYRYDHSVSNDKALMVLTEEPLLYIPPPPCQPLINTTESLRLNHELRGWVHRHEVERTKSRRMTNNQQKTRILQGALEQGSNSQLMAVQYTETTSSISRNSGSELQVYYASPRSYQDFFEAIRRRGDTFYVVSFRRDHLLLPATTHNKTTRPKMSIVLPAININENVINGQDYEVMMQIDCQVMDTRILHIKSSSVPPYLRDQQRNQTNTFFGSPPAATEATHVVSTIPESLQ

SEQ ID NO: 55 - protein, 511 aa, Homo sapiens
MSRGPEEVNRLTESTYRNVMEQFNPGLRNLINLGKNYEKAVNAMILAGKAYYDGVAKIGEIATGSPVSTELGHVLIEISSTHKKLNESLDENFKKFHKEIIHELEKKIELDVKYMNATLKRYQTEHKNKLESLEKSQAELKKIRRKSQGSRNALKYEHKEIEYVETVTSRQSEIQKFIADGCKEALLEEKRRFCFLVDKHCGFANHIHYYHLQSAELLNSKLPRWQETCVDAIKVPEKIMNMIEEIKTPASTPVSGTPQASPMIERSNVVRKDYDTLSKCSPKMPPAPSGRAYTSPLIDMFNNPATAAPNSQRVNNSTGTSEDPSLQRSVSVATGLNMMKKQKVKTIFPHTAGSNKTLLSFAQGDVITLLIPEEKDGWLYGEHDVSKARGWFPSSYTKLLEENETEAVTVPTPSPTPVRSISTVNLSENSSVVIPPPDYLECLSMGAAADRRADSARTTSTFKAPASKPETAAPNDANGTAKPPFLSGENPFATVKLRPTVTNDRSAPIIR

SEQ ID NO: 56 - protein, 472 aa, Homo sapiens
MNMPQSLGNQPLPPEPPSLGTPAEGPGTTSPPEHCWPVRPTLRNELDTFSVHFYIFFGPSVALPPERPAVFAMRLLPVLDSGGVLSLELQLNASSVRQENVTVFGCLTHEVPLSLGDAAVTCSKESLAGFLLSVSATTRVARLRIPFPQTGTWFLALRSLCGVGPRFVRCRNATAEVRMRTFLSPCVDDCGPYGQCKLLRTHNYLYAACECKAGWRGWGCTDSADALTYGFQLLSTLLLCLSNLMFLPPVVLAIRSRYVLEAAVYTFTMFFSTFYHACDQPGIVVFCIMDYDVLQFCDFLGSLMSVWVTVIAMARLQPVVKQVLYLLGAMLLSMALQLDRHGLWNLLGPSLFALGILATAWTVRSVRRRHCYPPTWRRWLFYLCPGSLIAGSAVLLYAFVETRDNYFYIHSIWHMLIAGSVGFLLPPRAKTDHGVPSGARARGCGYQLCINEQEELGLVGPGGATVSSICAS

SEQ ID NO: 57 - protein, 472 aa, Homo sapiens; identical to SEQ ID NO: 56

SEQ ID NO: 58 - protein, 112 aa, Homo sapiens
MEKILILLLVALSVAYAAPGPRGIIINLENGELCMNSAQCKSNCCQHSSALGLARCTSMASENSECSVKTLYGIYYKCPCERGLTCEGDKTIVGSITNTNFGICHDAGRSKQ

SEQ ID NO: 59 - protein, 2136 aa, Homo sapiens
MSRSRHARPSRLVRKEDVNKKKKNSQLRKTTKGANKNVASVKTLSPGKLKQLIQERDVKKKTEPKPPVPVRSLLTRAGAARMNLDRTEVLFQNPESLTCNGFTMALRSTSLSRRLSQPPLVVAKSKKVPLSKGLEKQHDCDYKILPALGVKHSENDSVPMQDTQVLPDIETLIGVQNPSLLKGKSQETTQFWSQRVEDSKINIPTHSGPAAEILPGPLEGTRCGEGLFSEETLNDTSGSPKMFAQDTVCAPFPQRATPKVTSQGNPSIQLEELGSRVESLKLSDSYLDPIKSEHDCYPTSSLNKVIPDLNLRNCLALGGSTSPTSVIKFLLAGSKQATLGAKPDHQEAFEATANQQEVSDTTSFLGQAFGAIPHQWELPGADPVHGEALGETPDLPEIPGAIPVQGEVFGTILDQQETLGMSGSVVPDLPVFLPVPPNPIATFNAPSKWPEPQSTVSYGLAVQGAIQILPLGSGHTPQSSSNSEKNSLPPVMAISNVENEKQVHISFLPANTQGFPLAPERGLFHASLGIAQLSQAGPSKSDRGSSQVSVTSTVHVVNTTVVTMPVPMVSTSSSSYTTLLPTLEKKKRKRCGVCEPCQQKTNCGECTYCKNRKNSHQICKKRKCEELKKKPSVVVPLEVIKENKRPQREKKPKVLKADFDNKPVNGPKSESMDYSRCGHGEEQKLELNPHTVENVTKNEDSMTGIEVEKWTQNKKSQLTDHVKGDFSANVPEAEKSKNSEVDKKRTKSPKLFVQTVRNGIKHVHCLPAETNVSFKKFNIEEFGKTLENNSYKFLKDTANHKNAMSSVATDMSCDHLKGRSNVLVFQQPGFNCSSIPHSSHSIINHHASIHNEGDQPKTPENIPSKEPKDGSPVQPSLLSLMKDRRLTLEQVVAIEALTQLSEAPSENSSPSKSEKDEESEQRTASLLNSCKAILYTVRKDLQDPNLQGEPPKLNHCPSLEKQSSCNTVVFNGQTTTLSNSHINSATNQASTKSHEYSKVTNSLSLFIPKSNSSKIDTNKSIAQGIITLDNCSNDLHQLPPRNNEVEYCNQLLDSSKKLDSDDLSCQDATHTQIEEDVATQLTQLASIIKINYIKPEDKKVESTPTSLVTCNVQQKYNQEKGTMQQKPPSSVHNNHGSSLTKQKNPTQKKTKSTPSRDRRKKKPTVVSYQENDRQKWEKLSYMYGTICDIWIASKFQNFGQFCPHDFPTVFGKISSSTKIWKPLAQTRSIMQPKTVFPPLTQIKLQRYPESAEEKVKVEPLDSLSLFHLKTESNGKAFTDKAYNSQVQLTVNANQKAHPLTQPSSPPNQCANVMAGDDQIRFQQVVKEQLMHQRLPTLPGISHETPLPESALTLRNVNVVCSGGITVVSTKSEEEVCSSSFGTSEFSTVDSAQKNFNDYAMNFFTNPTKNLVSITKDSELPTCSCLDRVIQKDKGPYYTHLGAGPSVAAVREIMENRYGQKGNAIRIEIVVYTGKEGKSSHGCPIAKWVLRRSSDEEKVLCLVRQRTGHHCPTAVMVVLIMVWDGIPLPMADRLYTELTENLKSYNGHPTDRRCTLNENRTCTCQGIDPETCGASFSFGCSWSMYFNGCKFGRSPSPRRFRIDPSSPLHEKNLEDNLQSLATRLAPIYKQYAPVAYQNQVEYENVARECRLGSKEGRPFSGVTACLDFCAHPHRDIHNMNNGSTVVCTLTREDNRSLGVIPQDEQLHVLPLYKLSDTDEFGSKEGMEAKIKSGAIEVLAPRRKKRTCFTQPVPRSGKKRAAMMTEVLAHKIRAVEKKPIPRIKRKNNSTTTNNSKPSSLPTLGSNTETVQPEVKSETEPHFILKSSDNTKTYSLMPSAPHPVKEASPGFSWSPKTASATPAPLKNDATASCGFSERSSTPHCTMPSGRLSGANAAAADGPGISQLGEVAPLPTLSAPVMEPLINSEPSTGVTEPLTPHQPNHQPSFLTSPQDLASSPMEEDEQHSEADEPPSDEPLSDDPLSPAEEKLPHIDEYWSDSEHIFLDANIGGVAIAPAHGSVLIECARRELHATTPVEHPNRNHPTRLSLVFYQHKNLNKPQHGFELNKIKFEAKEAKNKKMKASEQKDQAANEGPEQSSEVNELNQIPSHKALTLTHDNVVTVSPYALTHVAGPYNHWV

SEQ ID NO: 60 - protein, 102 aa, Homo sapiens
MSSPPEGKLETKAGHPPAVKAGGMRIVQKHPHTGDTKEEKDKDDQEWESPSPPKPTVFISGVIARGDKDFPPAAAQVAHQKPHASMDKHPSPRTQHIQQPRK

SEQ ID NO: 61 - protein, 791 aa, Homo sapiens
MGEERWVSLTPEEFDQLQKYSEYSSKKIKDALTEFNEGGSLKQYDPHEPISYDVFKLFMRAYLEVDLPQPLSTHLFLAFSQKPRHETSDHPTEGASNSEANSADTNIQNADNATKADEACAPDTESNMAEKQAPAEDQVAATPLEPPVPRSSSSESPVVYLKDVVCYLSLLETGRPQDKLEFMFRLYDSDENGLLDQAEMDCIVNQMLHIAQYLEWDPTELRPILKEMLQGMDYDRDGFVSLQEWVHGGMTTIPLLVLLGMDDSGSKGDGGHAWTMKHFKKPTYCNFCHIMLMGVRKQGLCCTYCKYTVHERCVSKNIPGCVKTYSKAKRSGEVMQHAWVEGNSSVKCDRCHKSIKCYQSVTARHCVWCRMTFHRKCELSTLCDGGELRDHILLPTSICPITRDRPGEKSDGCVSAKGELVMQYKIIPTPGTHPLLVLVNPKSGGRQGERILRKFHYLLNPKQVFNLDNGGPTPGLNFFRDTPDFRVLACGGDGTVGWILDCIDKANFAKHPPVAVLPLGTGNDLARCLRWGGGYEGGSLTKILKDIEQSPLVMLDRWHLEVIPREEVENGDQVPYSIMNNYFSIGVDASIAHRFHVMREKHPEKFNSRMKNKLWYFEFGTSETFAATCKKLHDHIELECDGVGVDLSNIFLEGIAILNIPSMYGGTNLWGENKKNRAVIRESRKGVTDPKELKFCVQDLSDQLLEVVGLEGAMEMGQIYTGLKSAGRRLAQCASVTIRTNKLLPMQVDGEPWMQPCCTIKITHKNQAPMMMGPPQKSSFFSLRRKSRSKD

SEQ ID NO: 62 - protein, 832 aa, Homo sapiens
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRSLQERIKSLNLSLKEITTKVCMSEKFCSTLRKKVNDIETQLPALLEAKMHAISGNHFWTAKDLTEEIRSLTSEREGLEGLLSKLLVLSSRNVKKLGSVKEDYNRLRREVEHQETAYETSVKENTMKYMETLKNKLCSCKCPLLGKVWEADLEACRLLIQSLQLQEARGSLSVEDERQMDDLEGAAPPIPPRLHSEDKRKTPLKESYILSAELGEKCEDIGKKLLYLEDQLHTAIHSHDEDLIQSLRRELQMVKETLQAMILQLQPAKEAGEREAAASCMTAGVHEAQA

SEQ ID NO: 63 - protein, 678 aa, Homo sapiens
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRSLQERIKSLNLSLKEITTKVCMSEKFCSTLRKKVNDIETQLPALLEAKMHAISGNHFWTAKDLTEEIRSLTSEREGLEGLLSKLLVLSSRNVKKLGSVKEDYNRLRREVEHQETAYGYKYCDAESWTQRSQQLA

SEQ ID NO: 64 - protein, 854 aa, Homo sapiens
MPGGGPQGAPAAAGGGGVSHRAGSRDCLPPAACFRRRRLARRPGYMRSSTGPGIGFLSPAVGTLFRFPGGVSGEESHHSESRARQCGLDSRGLLVRSPVSKSAAAPTVTSVRGTSAHFGIQLRGGTRLPDRLSWPCGPGSAGWQQEFAAMDSSETLDASWEAACSDGARRVRAAGSLPSAELSSNSCSPGCGPEVPPTPPGSHSAFTSSFSFIRLSLGSAGERGEAEGCPPSREAESHCQSPQEMGAKAASLDGPHEDPRCLSRPFSLLATRVSADLAQAARNSSRPERDMHSLPDMDPGSSSSLDPSLAGCGGDGSSGSGDAHSWDTLLRKWEPVLRDCLLRNRRQMEVISLRLKLQKLQEDAVENDDYDKAETLQQRLEDLEQEKISLHFQLPSRQPALSSFLGHLAAQVQAALRRGATQQASGDDTHTPLRMEPRLLEPTAQDSLHVSITRRDWLLQEKQQLQKEIEALQARMFVLEAKDQQLRREIEEQEQQLQWQGCDLTPLVGQLSLGQLQEVSKALQDTLASAGQIPFHAEPPETIRSLQERIKSLNLSLKEITTKVCMSEKFCSTLRKKVNDIETQLPALLEAKMHAISGNHFWTAKDLTEEIRSLTSEREGLEGLLSKLLVLSSRNVKKLGSVKEDYNRLRREVEHQETAYETSVKENTMKYMETLKNKLCSCKCPLLGKVWEADLEACRLLIQSLQLQEARGSLSVEDERQMDDLEGAAPPIPPRLHSEDKRKTPLKVLEEWKTHLIPSLHCAGGEQKEESYILSAELGEKCEDIGKKLLYLEDQLHTAIHSHDEDLIQSLRRELQMVKETLQAMILQLQPAKEAGEREAAASCMTAGVHEAQA

SEQ ID NO: 65 - protein, 536 aa, Homo sapiens
MATPDAGLPGAEGVEPAPWAQLEAPARLLLQALQAGPEGARRGLGVLRALGSRGWEPFDWGRLLEALCREEPVVQGPDGRLELKPLLLRLPRICQRNLMSLLMAVRPSLPESGLLSVLQIAQQDLAPDPDAWLRALGELLRRDLGVGTSMEGASPLSERCQRQLQSLCRGLGLGGRRLKSPQAPDPEEEENRDSQQPGKRRKDSEEEAASPEGKRVPKRLRCWEEEEDHEKERPEHKSLESLADGGSASPIKDQPVMAVKTGEDGSNLDDAKGLAESLELPKAIQDQLPRLQQLLKTLEEGLEGLEDAPPVELQLLHECSPSQMDLLCAQLQLPQLSDLGLLRLCTWLLALSPDLSLSNATVLTRSLFLGRILSLTSSASRLLTTALTSFCAKYTYPVCSALLDPVLQAPGTGPAQTELLCCLVKMESLEPDAQVLMLGQILELPWKEETFLVLQSLLERQVEMTPEKFSVLMEKLCKKGLAATTSMAYAKLMLTVMTKYQANITETQRLGLAMALEPNTTFLRKSLKAALKHLGP

SEQ ID NO: 66 - protein, 680 aa, Homo sapiens
MMVESASETIRSAPSGQNGVGSLSGQADGSSGGATGTTASGTGREVTTGADSNGEMSPAELLHFQQQQALQVARQFLLQQASGLSSPGNNDSKQSASAVQVPVSVAMMSPQMLTPQQMQQILSPPQLQALLQQQQALMLQQLQEYYKKQQEQLHLQLLTQQQAGKPQPKEALGNKQLAFQQQLLQMQQLQQQHLLNLQRQGLVSLQPNQASGPLQTLPQAAVCPTDLPQLWKGEGAPGQPAEDSVKQEGLDLTGTAATATSFAAPPKVSPPLSHHTLPNGQPTVLTSRRDSSSHEETPGSHPLYGHGECKWPGCETLCEDLGQFIKHLNTEHALDDRSTAQCRVQMQVVQQLEIQLAKESERLQAMMAHLHMRPSEPKPFSQPLNPVPGSSSFSKVTVSAADSFPDGLVHPPTSAAAPVTPLRPPGLGSASLHGGGPARRRSSDKFCSPISSELAQNHEFYKNADVRPPFTYASLIRQAILETPDRQLTLNEIYNWFTRMFAYFRRNTATWKNAVRHNLSLHKCFVRVENVKGAVWTVDEREYQKRRPPKMTGSPTLVKNMISGLSYGALNASYQAALAESSFPLLNSPGMLNPGSASSLLPLSHDDVGAPVEPLPSNGSSSPPRLSPPQYSHQVQVKEEPAEAEEDRQPGPPLGAPNPSASGPPEDRDLEEELPGEELS

SEQ ID NO: 67 - protein, 678 aa, Homo sapiens
MMVESASETIRSAPSGQNGVGSLSGQADGSSGGATGTTASGTGREVTTGADSNGEMSPAELLHFQQQQALQVARQFLLQQASGLSSPGNNDSKQSASAVQVPVSVAMMSPQMLTPQQMQQILSPPQLQALLQQQQALMLQQEYYKKQQEQLHLQLLTQQQAGKPQPKEALGNKQLAFQQQLLQMQQLQQQHLLNLQRQGLVSLQPNQASGPLQTLPQAAVCPTDLPQLWKGEGAPGQPAEDSVKQEGLDLTGTAATATSFAAPPKVSPPLSHHTLPNGQPTVLTSRRDSSSHEETPGSHPLYGHGECKWPGCETLCEDLGQFIKHLNTEHALDDRSTAQCRVQMQVVQQLEIQLAKESERLQAMMAHLHMRPSEPKPFSQPLNPVPGSSSFSKVTVSAADSFPDGLVHPPTSAAAPVTPLRPPGLGSASLHGGGPARRRSSDKFCSPISSELAQNHEFYKNADVRPPFTYASLIRQAILETPDRQLTLNEIYNWFTRMFAYFRRNTATWKNAVRHNLSLHKCFVRVENVKGAVWTVDEREYQKRRPPKMTGSPTLVKNMISGLSYGALNASYQAALAESSFPLLNSPGMLNPGSASSLLPLSHDDVGAPVEPLPSNGSSSPPRLSPPQYSHQVQVKEEPAEAEEDRQPGPPLGAPNPSASGPPEDRDLEEELPGEELS

SEQ ID NO: 68 - protein, 667 aa, Homo sapiens
MMVESASETIRSAPSGQNGVGSLSGQADGSSGGATGTTASGTGREVTTGADSNGEMSPAELLHFQQQQALQVARQFLLQQASGLSSPGNNDSKQSASAVQVPVSVAMMSPQMLTPQQMQQILSPPQLQALLQQQQALMLQQLQEYYKKQQEQLHLQLLTQQQAGKPQPKEALGNKQLAFQQQLLQMQQLQQQHLLNLQRQGLVSLQPNQASGPLQTLPQAVCPTDLPQLWKGEGAPGQPAEDSVKQEGLDLTGTAATATSFAAPPKVSPPLSHHTLPNGQPTVLTSRRDSSSHEETPGSHPLYGHGECKWPGCETLCEDLGQFIKHLNTEHALDDRSTAQCRVQMQVVQQLEIQLAKESERLQAMMAHLHMRPSEPKPFSQPVTVSAADSFPDGLVHPPTSAAAPVTPLRPPGLGSASLHGGGPARRRSSDKFCSPISSELAQNHEFYKNADVRPPFTYASLIRQAILETPDRQLTLNEIYNWFTRMFAYFRRNTATWKNAVRHNLSLHKCFVRVENVKGAVWTVDEREYQKRRPPKMTGSPTLVKNMISGLSYGALNASYQAALAESSFPLLNSPGMLNPGSASSLLPLSHDDVGAPVEPLPSNGSSSPPRLSPPQYSHQVQVKEEPAEAEEDRQPGPPLGAPNPSASGPPEDRDLEEELPGEELS

SEQ ID NO: 69 - protein, 230 aa, Homo sapiens
MKLIVGIGGMTNGGKTTLTNSLLRALPNCCVIHQDDFFKPQDQIAVGEDGFKQWDVLESLDMEAMLDTVQAWLSSPQKFARAHGVSVQPEASDTHILLLEGFLLYSYKPLVDLYSRRYFLTVPYEECKWRRSTRNYTVPDPPGLFDGHVWPMYQKYRQEMEANGVEVVYLDGMKSREELFREVLEDIQNSLLNRSQESAPSPARPARTQGPGRGCGHRTARPAASQQDSM

SEQ ID NO: 70 - protein, 575 aa, Homo sapiens
MDPFHACSILKQLKTMYDEGQLTDIVVEVDHGKTFSCHRNVLAAISPYFRSMFTSGLTESTQKEVRIVGVEAESMDLVLNYAYTSRVILTEANVQALFTAASIFQIPSIQDQCAKYMISHLDPQNSIGVFIFADHYGHQELGDRSKEYIRKKFLCVTKEQEFLQLTKDQLISILDSDDLNVDREEHVYESIIRWFEHEQNEREVHLPEIFAKCIRFPLMEDTFIEKIPPQFAQAIAKSCVEKGPSNTNGCTQRLGMTASEMIICFDAAHKHSGKKQTVPCLDIVTGRVFKLCKPPNDLREVGILVSPDNDIYIAGGYRPSSSEVSIDHKAENDFWMYDHSTNRWLSKPSLLRARIGCKLVYCCGKMYAIGGRVYEGDGRNSLKSVECYDSRENCWTTVCAMPVAMEFHNAVEYKEKIYVLQGEFFLFYEPQKDYWGFLTPMTVPRIQGLAAVYKDSIYYIAGTCGNHQRMFTVEAYDIELNKWTRKKDFPCDQSINPYLKLVLFQNKLHLFVRATQVTVEEHVFRTSRKNSLYQYDDIADQWMKVYETPDRLWDLGRHFECAVAKLYPQCLQKVL

SEQ ID NO: 71 - protein, 2579 aa, Homo sapiens
MAEAVKPQRRAKAKASRTKTKEKKKYETPQREESSEVSLPKTSREQEIPSLACEFKGDHLKVVTDSQLQDDASGQNESEMFDVPLTSLTISNEESLTCNTEPPKEGGEARPCVGDSAVTPKVHPGDNVGTKVETPKNFTEVEENMSVQGGLSESAPQSNFSYTQPAMENIQVRETQNSKEDKQGLVCSSEVPQNVGLQSSCPAKHGFQTPRVKKLYPQLPAEIAGEAPALVAVKPLLRSERLYPELPSQLELVPFTKEQLKILEPGSWLENVESYLEEFDSMAHQDRHEFYELLLNYSRCRKQLLLAEAELLTLTSDCQNAKSRLWQFKEEQMSVQGICADQVKVFSYHRYQRVEMNENALVELKKLFDAKSEHLHQTLALHSYTSVLSRLQVESYIYALLSSSAVLRSSAIHQQGRASKQTESIPSDLCQLKECISVLFMFTRRVNEDTQFHDDILLWLQKLVSVLQRVGCPGDHLFLLNHILRCPAGVSKWAVPFIQIKVLHNPSGVFHFMQSLALLMSPVKNRAEFMCHMKPSERKPSSSGPGSGTWTLVDEGGEEDEDPETSWILLNEDDLVTILAQFPFHELFQHLLGFKAKGDYLPETTRPQEMMKIFAFANSLVELLAVGLETFNRARYRQFVKRIGYMIRMTLGYVSDHWAQYVSHNQGSGLAQQPYSMEKLQVEFDELFLRAVLHVLKAKRLGIWLFMSEMPFGTLSVQMLWKLFYLMHQVESENLQQLSSSLQPAQCKQQLQDPEHFTNFEKCLSSMNSSEEICLLTTFAQMAQARRTNVDEDFIKIIVLEIYEVSYVTLSTRETFSKVGRELLGTITAVHPEIISVLLDRVQETIDQVGMVSLYLFKELPLYLWQPSASEIAVIRDWLLNYNLTVVKNKLACVILEGLNWGFAKQATLHLDQAVHAEVALMVLEAYQKYLAQKPYAGILSESMKQVSYLASIVRYGETPETSFNQWAWNLILRLKLHKNDYGIQPNCPAVPFSVTVPDMTESPTFHPLLKAVKAGMPIGCYLALSMTAVGHSIEKFCAEGIPLLGILVQSRHLRTVVHVLDKILPLFYPCQYYLLKNEQFLSHLLLFLHLDSGVPQGVTQQVTHKVAQHLTGASHGDNVKLLNSMIQAHISVSTQPNEVGPVAVLEFWVQALISQHLWYREQPILFLMDHLCKAAFQLMQEDCIQKLLYQQHKNALGYHCDRSLLSSLVSWIVAGNITPSFVEGLATPTQVWFAWTVLNMESIFEEDSQLRRVIEGELVINSAFTPDQALKKAQTQLKLPIVPSLQRLLIYRWAHQALVTPSDHPLLPLIWQKFFLLYLHRPGPQYGLPIDGCIGRRFFQSPAHINLLKEMKRRLTEVADFHHAASKALRVPAEGSEGLPESHSGTPGYLTSPELHKELVRLFNVYILWLEDENFQKGDTYIPSLPKHYDIHRLAKVMQNQQDLWMEYLNMERIYHEFQETVGLWTQAKLESHSTPCSLSVQLDFTDPLLAKERVLSNLRKHEAPQPPLALHPTKPPVPVISSAVLLSQKDATQLVCTDLNLLQQQARTAALRESQQVALDGELLDTMPKQYVNREEQTTLHLECRGSSGKKCQGAAVVTVQFEGMHKNEAISQQLHVLRKEVKQLQAEAAKPPSLNIVEAAVHAENLITALVNAYKLQPTPGIQKVGISLFFTIVDYVSDETQRHPPTRQFFTSCIEILGQVFISGIKSECRKVLETILKNSRLCSLLSPFFTPNAAPAEFIQLYEQVVKFLSEDNSDMIFMLLTKFDLKQWLSATKPPLSDRTRLLESIHLALTAWGLEPDEDILMPFNLFCKHWTYLLLYQFPDQYSDILRLLMQSSAEQLLSPECWKATLRALGCCAPSCQQGAASTEGAVLPSSSDALLSDKQVMETIQWLSDFFYKLRLSKMDFKSFGLFSKWSPYMADVKTFLGYLVKRLIDLEMTCLAQDPTASRKTVLKSLHSVIIQLFKPWILVLEDNESSQQRHYPWLESDTVVASSIVQLFTDCIDSLHESFKDKLLPGDAGALWLHLMHYCEACTAPKMPEFILYAFHSTYRKLPWKDLHPDQMLMEAFFKVERGSPKSCFLFLGSVLCEVNWVSVLSDAWNSSPHPETRSMIVCLLFMMILLAKEVQLVDQTDSPLLSLLGQTSSLSWHLVDIVSYQSVLSYFSSHYPPSIILAKESYAELIMKLLKVSAGLSIPTDSQKHLDAVPKCQAFTHQMVQFLSTLEQNGKITLAVLEQEMSKLLDDIIVFNPPDMDSQTRHMALSSLFMEVLMMMNNATIPTAEFLRGSIRTWIGQKMHGLVVLPLLTAACQSLASVRHMAETTEACITAYFKESPLNQNSGWGPILVSLQVPELTMEEFLQECLTLGSYLTLYVYLLQCLNSEQTLRNEMKVLLILSKWLEQVYPSSVEEEAKLFLWWHQVLQLSLIQTEQNDSVLTESVIRILLLVQSRQNLVAEERLSSGILGAIGFGRKSPLSNRFRVVARSMAAFLSVQVPMEDQIRLRPGSELHLTPKAQQALNALESMASSKQYVEYQDQILQATQFIRHPGHCLQDGKSFLALLVNCLYPEVHYLDHIR

SEQ ID NO: 72 - protein, 402 aa, Homo sapiens
MNIHMKRKTIKNINTFENRMLMLDGMPAVRVKTELLESEQGSPNVHNYPDMEAVPLLLNNVKGEPPEDSLSVDHFQTQTEPVDLSINKARTSPTAVSSSPVSMTASASSPSSTSTSSSSSSRLASSPTVITSVSSASSSSTVLTPGPLVASASGVGGQQFLHIIHPVPPSSPMNLQSNKLSHVHRIPVVVQSVPVVYTAVRSPGNVNNTIVVPLLEDGRGHGKAQMDPRGLSPRQSKSDSDDDDLPNVTLDSVNETGSTALSIARAVQEVHPSPVSRVRGNRMNNQKFPCSISPFSIESTRRQRRSESPDSRKRRIHRCDFEGCNKVYTKSSHLKAHRRTHTGEKPYKCTWEGCTWKFARSDELTRHYRKHTGVKPFKCADCDRSFSRSDHLALHRRRHMLV

SEQ ID NO: 73 - protein, 175 aa, Homo sapiens
MSYNCCSGNFSSRSCGDYLRYPASSRGFSYPSNLVYSTDLCSPSTCQLGSSLYRGCQEICWEPTSCQTSYVESSPCQTSCYRPRTSLLCSPCKTTYSGSLGFGSSSCRSLGYGSRSCYSVGCGSSGVRSLGYGSCGFPSLGYGSGFCRPTYLASRSCQSPCYRPAYGSTFCRSTC

SEQ ID NO: 74 - protein, 254 aa, Homo sapiens
MPAGSMSTTGYPGVCSTTSYRTHCYIPVTSSVTLSSSDLSPTFGHCLPSSYQGNLWLLDYCQESYGEAPTCKSPSCEPKTCSTTGCDPSNSSVPCNSPSAGQVFSVCETTNVSPSPSCSPSTQTNGYVCNCHIPTRNASKACQTLRNGSNCFGQLNCLSKSFQTLNHCRLSTLGYKSYQNPCFIPSYVSPLCYISNSCQPQSYLVRNYHYSSYRPTSCRPLSYLSRSFRSLSYIPSTFPPLRYLCSGSRPLKCY

SEQ ID NO: 75 - protein, 210 aa, Homo sapiens
MSCPNYCSGNSNSGSLRTSRHIPLTSIDLCPTSVSCGDVLYLPTSSQDHTWVTDNCQETCGEPTSCQPVHCETGNLETSCGSSTAYYVPRPCQGSSFLPASFFSSSCLPVSCRPQRYVSSGCRPLRPLLNSYQPIGDCVPNAYRPQFCLSKSCQPQNLLTSGCQPSSCLAYRPQSLHVVSSSLRPLGPLFSGCQPLTHVFSTCRPSCSGL

SEQ ID NO: 76 - protein, 1150 aa, Homo sapiens
MKLKKQVTVCGAAIFCVAVFSLYLMLDRVQHDPTRHQNGGNFPRSQISVLQNRIEQLEQLLEENHEIISHIKDSVLELTANAEGPPAMLPYYTVNGSWVVPPEPRPSFFSISPQDCQFALGGRGQKPELQMLTVSEELPFDNVDGGVWRQGFDISYDPHDWDAEDLQVFVVPHSHNDPGWIKTFDKYYTEQTQHILNSMVSKLQEDPRRRFLWAEVSFFAKWWDNINVQKRAAVRRLVGNGQLEIATGGWVMPDEANSHYFALIDQLIEGHQWLERNLGATPRSGWAVDPFGYSSTMPYLLRRANLTSMLIQRVHYAIKKHFAATHSLEFMWRQTWDSDSSTDIFCHMMPFYSYDVPHTCGPDPKICCQFDFKRLPGGRINCPWKVPPRAITEANVAERAALLLDQYRKKSQLFRSNVLLVPLGDDFRYDKPQEWDAQFFNYQRLFDFFNSRPNLHVQAQFGTLSDYFDALYKRTGVEPGARPPGFPVLSGDFFSYADREDHYWTGYYTSRPFYKSLDRVLEAHLRGAEVLYSLAAAHARRSGLAGRYPLSDFTLLTEARRTLGLFQHHDAITGTAKEAVVVDYGVRLLRSLVNLKQVIIHAAHYLVLGDKETYHFDPEAPFLQVDDTRLSHDALPERTVIQLDSSPRFVVLFNPLEQERFSMVSLLVNSPRVRVLSEEGQPLAVQISAHWSSATEAVPDVYQVSVPVRLPALGLGVLQLQLGLDGHRTLPSSVRIYLHGRQLSVSRHEAFPLRVIDSGTSDFALSNRYMQVWFSGLTGLLKSIRRVDEEHEQQVDMQVLVYGTRTSKDKSGAYLFLPDGEAKPYVPKEPPVLRVTEGPFFSEVVAYYEHIHQAVRLYNLPGVEGLSLDISSLVDIRDYVNKELALHIHTDIDSQGIFFTDLNGFQVQPRRYLKKLPLQANFYPMPVMAYIQDAQKRLTLHTAQALGVSSLKDGQLEVILDRRLMQDDNRGLGQGLKDNKRTCNRFRLLLERRTVGSEVQDSHSTSYPSLLSHLTSMYLNAPALALPVARMQLPGPGLRSFHPLASSLPCDFHLLNLRTLQAEEDTLPSAETALILHRKGFDCGLEAKNLGFNCTTSQGKVALGSLFHGLDVVFLQPTSLTLLYPLASPSNSTDVYLEPMEIATFRLRLG

SEQ ID NO: 77 - protein, 651 aa, Homo sapiens
MKDYDELLKYYELHETIGTGGFAKVKLACHILTGEMVAIKIMDKNTLGSDLPRIKTEIEALKNLRHQHICQLYHVLETANKIFMVLEYCPGGELFDYIISQDRLSEEETRVVFRQIVSAVAYVHSQGYAHRDLKPENLLFDEYHKLKLIDFGLCAKPKGNKDYHLQTCCGSLAYAAPELIQGKSYLGSEADVWSMGILLYVLMCGFLPFDDDNVMALYKKIMRGKYDVPKWLSPSSILLLQQMLQVDPKKRISMKNLLNHPWIMQDYNYPVEWQSKNPFIHLDDDCVTELSVHHRNNRQTMEDLISLWQYDHLTATYLLLLAKKARGKPVRLRLSSFSCGQASATPFTDIKSNNWSLEDVTASDKNYVAGLIDYDWCEDDLSTGAATPRTSQFTKYWTESNGVESKSLTPALCRTPANKLKNKENVYTPKSAVKNEEYFMFPEPKTPVNKNQHKREILTTPNRYTTPSKARNQCLKETPIKIPVNSTGTDKLMTGVISPERRCRSVELDLNQAHMEETPKRKGAKVFGSLERGLDKVITVLTRSKRKGSARDGPRRLKLHYNVTTTRLVNPDQLLNEIMSILPKKHVDFVQKGYTLKCQTQSDFGKVTMQFELEVCQLQKPDVVGIRRQRLKGDAWVYKRLVEDILSSCKV

SEQ ID NO: 78 - protein, 266 aa, Homo sapiens
MQGSTRRMGVMTDVHRRFLQLLMTHGVLEEWDVKRLQTHCYKVHDRNATVDKLEDFINNINSVLESLYIEIKRGVTEDDGRPIYALVNLATTSISKMATDFAENELDLFRKALELIIDSETGFASSTNILNLVDQLKGKKMRKKEAEQVLQKFVQNKWLIEKEGEFTLHGRAILEMEQYIRETYPDAVKICNICHSLLIQGQSCETCGIRMHLPCVAKYFQSNAEPRCPHCNDYWPHEIPKVFDPEKERESGVLKSNKKSLRSRQH

SEQ ID NO: 79 - protein, 329 aa, Homo sapiens
MQLVLLLMFLLVFIGNTAPAFSVTLESMDIPQNITEFFMLGLSQNSEVQRVLFVVFLLIYVVTVCGNMLIVVTITSSPTLASPVYFFLANLSFIDTFYSSSMAPKLIADSLYEGRTISYECCMAQLFGAHFLGGVEIILLTVMAYDRYVAICKPLHNTTIMTRHLCAMLVGVAWLGGFLHSLVQLLLVLWLPFCGPNVINHFACDLYPLLEVACTNTYVIGLLVVANSGLICLLNFLMLAASYIVILYSLRSHSADGRCKALSTCGAHFIVVALFFVPCIFTYVHPFSTLPIDKNMALFYGILTPMLNPLIYTLRNEEVKNAMRKLFTW

SEQ ID NO: 80 - protein, 2022 aa, Homo sapiens
MATGGGPFEDGMNDQDLPNWSNENVDDRLNNMDWGAQQKKANRSSEKNKKKFGVESDKRVTNDISPESSPGVGRRRTKTPHTFPHSRYMSQMSVPEQAELEKLKQRINFSDLDQRSIGSDSQGRATAANNKRQLSENRKPFNFLPMQINTNKSKDASTSPPNRETIGSAQCKELFASALSNDLLQNCQVSEEDGRGEPAMESSQIVSRLVQIRDYITKASSMREDLVEKNERSANVERLTHLIDHLKEQEKSYMKFLKKILARDPQQEPMEEIENLKKQHDLLKRMLQQQEQLRALQGRQAALLALQHKAEQAIAVMDDSVVAETAGSLSGVSITSELNEELNDLIQRFHNQLRDSQPPAVPDNRRQAESLSLTREVSQSRKPSASERLPDEKVELFSKMRVLQEKKQKMDKLLGELHTLRDQHLNNSSSSPQRSVDQRSTSAPSASVGLAPVVNGESNSLTSSVPYPTASLVSQNESENEGHLNPSEKLQKLNEVRKRLNELRELVHYYEQTSDMMTDAVNENRKDEETEESEYDSEHENSEPVTNIRNPQVASTWNEVNSHSNAQCVSNNRDGRTVNSNCEINNRSAANIRALNMPPSLDCRYNREGEQEIHVAQGEDDEEEEEEAEEEGVSGASLSSHRSSLVDEHPEDAEFEQKINRLMAAKQKLRQLQDLVAMVQDDDAAQGVISASASNLDDFYPAEEDTKQNSNNTRGNANKTQKDTGVNEKAREKFYEAKLQQQQRELKQLQEERKKLIDIQEKIQALQTACPDLQLSAASVGNCPTKKYMPAVTSTPTVNQHETSTSKSVFEPEDSSIVDNELWSEMRRHEMLREELRQRRKQLEALMAEHQRRQGLAETASPVAVSLRSDGSENLCTPQQSRTEKTMATWGGSTQCALDEEGDEDGYLSEGIVRTDEEEEEEQDASSNDNFSVCPSNSVNHNSYNGKETKNRWKNNCPFSADENYRPLAKTRQQNISMQRQENLRWVSELSYVEEKEQWQEQINQLKKQLDFSVSICQTLMQDQQTLSCLLQTLLTGPYSVMPSNVASPQVHFIMHQLNQCYTQLTWQQNNVQRLKQMLNELMRQQNQHPEKPGGKERGSSASHPPSPSLFCPFSFPTQPVNLFNIPGFTNFSSFAPGMNFSPLFPSNFGDFSQNISTPSEQQQPLAQNSSGKTEYMAFPKPFESSSSIGAEKPRNKKLPEEEVESSRTPWLYEQEGEVEKPFIKTGFSVSVEKSTSSNRKNQLDTNGRRRQFDEESLESFSSMPDPVDPTTVTKTFKTRKASAQASLASKDKTPKSKSKKRNSTQLKSRVKNIRYESASMSSTCEPCKSRNRHSAQTEEPVQAKVFSRKNHEQLEKIIKCNRSTEISSETGSDFSMFEALRDTIYSEVATLISQNESRPHFLIELFHELQLLNTDYLRQRALYALQDIVSRHISESHEKGENVKSVNSGTWIASNSELTPSESLATTDDETFEKNFERETHKISEQNDADNASVLSVSSNFEPFATDDLGNTVIHLDQALARMREYERMKTEAESNSNMRCTCRIIEDGDGAGAGTTVNNLEETPVIENRSSQQPVSEVSTIPCPRIDTQQLDRQIKAIMKEVIPFLKEHMDEVCSSQLLTSVRRMVLTLTQQNDESKEFVKFFHKQLGSILQDSLAKFAGRKLKDCGEDLLVEISEVLFNELAFFKLMQDLDNNSITVKQRCKRKIEATGVIQSCAKEAKRILEDHGSPAGEIDDEDKDKDETETVKQTQTSEVYDGPKNVRSDISDQEEDEESEGCPVSINLSKAETQALTNYGSGEDENEDEEMEEFEEGPVDVQTSLQANTEATEENEHDEQVLQRDFKKTAESKNVPLEREATSKKNNCPVKPCYLNILEDEQPLNSAAHKESPPTVDSTQQPNPLPLRLPEMEPLVPRVKEVKSAQETPESSLAGSPDTESPVLVNDYEAESGNISQKSDEEDFVKVEDLPLKLTIYSEADLRKKMVEEEQKNHLSGEICEMQTEELAGNSETLKEPETVGAQSI

SEQ ID NO: 81 - protein, 441 aa, Homo sapiens
MEQPQEEAPEVREEEEKEEVAEAEGAPELNGGPQHALPSSSYTDLSRSSSPPSLLDQLQMGCDGASCGSLNMECRVCGDKASGFHYGVHACEGCKGFFRRTIRMKLEYEKCERSCKIQKKNRNKCQYCRFQKCLALGMSHNAIRFGRMPEAEKRKLVAGLTANEGSQYNPQVADLKAFSKHIYNAYLKNFNMTKKKARSILTGKASHTAPFVIHDIETLWQAEKGLVWKQLVNGLPPYKEISVHVFYRCQCTTVETVRELTEFAKSIPSFSSLFLNDQVTLLKYGVHEAIFAMLASIVNKDGLLVANGSGFVTREFLRSLRKPFSDIIEPKFEFAVKFNALELDDSDLALFIAAIILCGDRPGLMNVPRVEAIQDTILRALEFHLQANHPDAQYLFPKLLQKMADLRQLVTEHAQMMQRIKKTETETSLHPLLQEIYKDMY

SEQ ID NO: 82 - protein, 264 aa, Homo sapiens
MEAFLGSRSGLWAGGPAPGQFYRIPSTPDSFMDPASALYRGPITRTQNPMVTGTSVLGVKFEGGVVIAADMLGSYGSLARFRNISRIMRVNNSTMLGASGDYADFQYLKQVLGQMVIDEELLGDGHSYSPRAIHSWLTRAMYSRRSKMNPLWNTMVIGGYADGESFLGYVDMLGVAYEAPSLATGYGAYLAQPLLREVLEKQPVLSQTEARDLVERCMRVLYYRDARSYNRFQIATVTEKGVEIEGPLSTETNWDIAHMISGFE

SEQ ID NO: 83 - protein, 2466 aa, Homo sapiens
MHVSLAEALEVRGGPLQEEEIWAVLNQSAESLQELFRKVSLADPAALGFIISPWSLLLLPSGSVSFTDENISNQDLRAFTAPEVLQNQSLTSLSDVEKIHIYSLGMTLYWGADYEVPQSQPIKLGDHLNSILLGMCEDVIYARVSVRTVLDACSAHIRNSNCAPSFSYVKHLVKLVLGNLSGTDQLSCNSEQKPDRSQAIRDRLRGKGLPTGRSSTSDVLDIQKPPLSHQTFLNKGLSKSMGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIERASFRSLNLQAESVRGFNMGRAISTGSLASSTLNKLAVRPLSVQAEILKRLSCSELSLYQPLQNSSKEKNDKASWEEKPREMSKSYHDLSQASLYPHRKNVIVNMEPPPQTVAELVGKPSHQMSRSDAESLAGVTKLNNSKSVASLNRSPERRKHESDSSSIEDPGQAYVLDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKVPSTPVHLTNEMKNYMKKSSYMQDSAIDSSSKDHHWSRGTLRHISENSFGPSGGLREGSLSSQDSRTESASLSQSQVNGFFASHLGDQTWQESQHGSPSPSVISKATEKETFTDSNQSKTKKPGISDVTDYSDRGDSDMDEATYSSSQDHQTPKQESSSSVNTSNKMNFKTFSSSPPKPGDIFEVELAKNDNSLGISVTGGVNTSVRHGGIYVKAVIPQGAAESDGRIHKGDRVLAVNGVSLEGATHKQAVETLRNTGQVVHLLLEKGQSPTSKEHVPVTPQCTLSDQNAQGQGPEKVKKTTQVKDYSFVTEENTFEVKLFKNSSGLGFSFSREDNLIPEQINASIVRVKKLFPGQPAAESGKIDVGDVILKVNGASLKGLSQQEVISALRGTAPEVFLLLCRPPPGVLPEIDTALLTPLQSPAQVLPNSSKDSSQPSCVEQSTSSDENEMSDKSKKQCKSPSRRDSYSDSSGSGEDDLVTAPANISNSTWSSALHQTLSNMVSQAQSHHEAPKSQEDTICTMFYYPQKIPNKPEFEDSNPSPLPPDMAPGQSYQPQSESASSSSMDKYHIHHISEPTRQENWTPLKNDLENHLEDFELEVELLITLIKSEKGSLGFTVTKGNQRIGCYVHDVIQDPAKSDGRLKPGDRLIKVNDTDVTNMTHTDAVNLLRAASKTVRLVIGRVLELPRIPMLPHLLPDITLTCNKEELGFSLCGGHDSLYQVVYISDINPRSVAAIEGNLQLLDVIHYVNGVSTQGMTLEEVNRALDMSLPSLVLKATRNDLPVVPSSKRSAVSAPKSTKGNGSYSVGSCSQPALTPNDSFSTVAGEEINEISYPKGKCSTYQIKGSPNLTLPKESYIQEDDIYDDSQEAEVIQSLLDVVDEEAQNLLNENNAAGYSCGPGTLKMNGKLSEERTEDTDCDGSPLPEYFTEATKMNGCEEYCEEKVKSESLIQKPQEKKTDDDEITWGNDELPIERTNHEDSDKDHSFLTNDELAVLPVVKVLPSGKYTGANLKSVIRVLRGLLDQGIPSKELENLQELKPLDQCLIGQTKENRRKNRYKNILPYDATRVPLGDEGGYINASFIKIPVGKEEFVYIACQGPLPTTVGDFWQMIWEQKSTVIAMMTQEVEGEKIKCQRYWPNILGKTTMVSNRLRLALVRMQQLKGFVVRAMTLEDIQTREVRHISHLNFTAWPDHDTPSQPDDLLTFISYMRHIHRSGPIITHCSAGIGRSGTLICIDVVLGLISQDLDFDISDLVRCMRLQRHGMVQTEDQYIFCYQVILYVLTRLQAEEEQKQQPQLLK

SEQ ID NO: 84 - protein, 2485 aa, Homo sapiens
MHVSLAEALEVRGGPLQEEEIWAVLNQSAESLQELFRKVSLADPAALGFIISPWSLLLLPSGSVSFTDENISNQDLRAFTAPEVLQNQSLTSLSDVEKIHIYSLGMTLYWGADYEVPQSQPIKLGDHLNSILLGMCEDVIYARVSVRTVLDACSAHIRNSNCAPSFSYVKHLVKLVLGNLSGTDQLSCNSEQKPDRSQAIRDRLRGKGLPTGRSSTSDVLDIQKPPLSHQTFLNKGLSKSMGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIERASFRSLNLQAESVRGFNMGRAISTGSLASSTLNKLAVRPLSVQAEILKRLSCSELSLYQPLQNSSKEKNDKASWEEKPREMSKSYHDLSQASLYPHRKNVIVNMEPPPQTVAELVGKPSHQMSRSDAESLAGVTKLNNSKSVASLNRSPERRKHESDSSSIEDPGQAYVLGMTMHSSGNSSSQVPLKENDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKVPSTPVHLTNEMKNYMKKSSYMQDSAIDSSSKDHHWSRGTLRHISENSFGPSGGLREGSLSSQDSRTESASLSQSQVNGFFASHLGDQTWQESQHGSPSPSVISKATEKETFTDSNQSKTKKPGISDVTDYSDRGDSDMDEATYSSSQDHQTPKQESSSSVNTSNKMNFKTFSSSPPKPGDIFEVELAKNDNSLGISVTGGVNTSVRHGGIYVKAVIPQGAAESDGRIHKGDRVLAVNGVSLEGATHKQAVETLRNTGQVVHLLLEKGQSPTSKEHVPVTPQCTLSDQNAQGQGPEKVKKTTQVKDYSFVTEENTFEVKLFKNSSGLGFSFSREDNLIPEQINASIVRVKKLFPGQPAAESGKIDVGDVILKVNGASLKGLSQQEVISALRGTAPEVFLLLCRPPPGVLPEIDTALLTPLQSPAQVLPNSSKDSSQPSCVEQSTSSDENEMSDKSKKQCKSPSRRDSYSDSSGSGEDDLVTAPANISNSTWSSALHQTLSNMVSQAQSHHEAPKSQEDTICTMFYYPQKIPNKPEFEDSNPSPLPPDMAPGQSYQPQSESASSSSMDKYHIHHISEPTRQENWTPLKNDLENHLEDFELEVELLITLIKSEKGSLGFTVTKGNQRIGCYVHDVIQDPAKSDGRLKPGDRLIKVNDTDVTNMTHTDAVNLLRAASKTVRLVIGRVLELPRIPMLPHLLPDITLTCNKEELGFSLCGGHDSLYQVVYISDINPRSVAAIEGNLQLLDVIHYVNGVSTQGMTLEEVNRALDMSLPSLVLKATRNDLPVVPSSKRSAVSAPKSTKGNGSYSVGSCSQPALTPNDSFSTVAGEEINEISYPKGKCSTYQIKGSPNLTLPKESYIQEDDIYDDSQEAEVIQSLLDVVDEEAQNLLNENNAAGYSCGPGTLKMNGKLSEERTEDTDCDGSPLPEYFTEATKMNGCEEYCEEKVKSESLIQKPQEKKTDDDEITWGNDELPIERTNHEDSDKDHSFLTNDELAVLPVVKVLPSGKYTGANLKSVIRVLRGLLDQGIPSKELENLQELKPLDQCLIGQTKENRRKNRYKNILPYDATRVPLGDEGGYINASFIKIPVGKEEFVYIACQGPLPTTVGDFWQMIWEQKSTVIAMMTQEVEGEKIKCQRYWPNILGKTTMVSNRLRLALVRMQQLKGFVVRAMTLEDIQTREVRHISHLNFTAWPDHDTPSQPDDLLTFISYMRHIHRSGPIITHCSAGIGRSGTLICIDVVLGLISQDLDFDISDLVRCMRLQRHGMVQTEDQYIFCYQVILYVLTRLQAEEEQKQQPQLLK

SEQ ID NO: 85 - protein, 2294 aa, Homo sapiens
MHVSLAEALEVRGGPLQEEEIWAVLNQSAESLQELFRKVSLADPAALGFIISPWSLLLLPSGSVSFTDENISNQDLRAFTAPEVLQNQSLTSLSDVEKIHIYSLGMTLYWGADYEVPQSQPIKLGDHLNSILLGMCEDVIYARVSVRTVLDACSAHIRNSNCAPSFSYVKHLVKLVLGNLSGTDQLSCNSEQKPDRSQAIRDRLRGKGLPTGRSSTSDVLDIQKPPLSHQTFLNKGLSKSMGFLSIKDTQDENYFKDILSDNSGREDSENTFSPYQFKTSGPEKKPIPGIDVLSKKKIWASSMDLLCTADRDFSSGETATYRRCHPEAVTVRTSTTPRKKEARYSDGSIALDIFGPQKMDPIYHTRELPTSSAISSALDRIRERQKKLQVLREAMNVEEPVRRYKTYHGDVFSTSSESPSIISSESDFRQVRRSEASKRFESSSGLPGVDETLSQGQSQRPSRQYETPFEGNLINQEIMLKRQEEELMQLQAKMALRQSRLSLYPGDTIKASMLDITRDPLREIALETAMTQRKLRNFFGPEFVKMTIEPFISLDLPRSILTKKGKNEDNRRKVNIMLLNGQRLELTCDTKTICKDVFDMVVAHIGLVEHHLFALATLKDNEYFFVDPDLKLTKVAPEGWKEEPKKKTKATVNFTLFFRIKFFMDDVSLIQHTLTCHQYYLQLRKDILEERMHCDDETSLLLASLALQAEYGDYQPEVHGVSYFRMEHYLPARVMEKLDLSYIKEELPKLHNTYVGASEKETELEFLKVCQRLTEYGVHFHRVHPEKKSQTGILLGVCSKGVLVFEVHNGVRTLVLRFPWRETKKISFSKKKITLQNTSDGIKHGFQTDNSKICQYLLHLCSYQHKFQLQMRARQSNQDAQDIDVLHKRWSIVSSPEREITLVNLKKDAKYGLGFQIIGGEKMGRLDLGIFISSVAPGGPADLDGCLKPGDRLISVNSVSLEGVSHHAAIEILQNAPEDVTLVISQPKEKISKVPSTPVHLTNEMKNYMKKSSYMQDSAIDSSSKDHHWSRGTLRHISENSFGPSGGLREGSLSSQDSRTESASLSQSQVNGFFASHLGDQTWQESQHGSPSPSVISKATEKETFTDSNQSKTKKPGISDVTDYSDRGDSDMDEATYSSSQDHQTPKQESSSSVNTSNKMNFKTFSSSPPKPGDIFEVELAKNDNSLGISVTGGVNTSVRHGGIYVKAVIPQGAAESDGRIHKGDRVLAVNGVSLEGATHKQAVETLRNTGQVVHLLLEKGQSPTSKEHVPVTPQCTLSDQNAQGQGPEKVKKTTQVKDYSFVTEENTFEVKLFKNSSGLGFSFSREDNLIPEQINASIVRVKKLFPGQPAAESGKIDVGDVILKVNGASLKGLSQQEVISALRGTAPEVFLLLCRPPPGVLPEIDTALLTPLQSPAQVLPNSSKDSSQPSCVEQSTSSDENEMSDKSKKQCKSPSRRDSYSDSSGSGEDDLVTAPANISNSTWSSALHQTLSNMVSQAQSHHEAPKSQEDTICTMFYYPQKIPNKPEFEDSNPSPLPPDMAPGQSYQPQSESASSSSMDKYHIHHISEPTRQENWTPLKNDLENHLEDFELEVELLITLIKSEKGSLGFTVTKGNQRIGCYVHDVIQDPAKSDGRLKPGDRLIKVNDTDVTNMTHTDAVNLLRAASKTVRLVIGRVLELPRIPMLPHLLPDITLTCNKEELGFSLCGGHDSLYQVVYISDINPRSVAAIEGNLQLLDVIHYVNGVSTQGMTLEEVNRALDMSLPSLVLKATRNDLPVVPSSKRSAVSAPKSTKGNGSYSVGSCSQPALTPNDSFSTVAGEEINEISYPKGKCSTYQIKGSPNLTLPKESYIQEDDIYDDSQEAEVIQSLLDVVDEEAQNLLNENNAAGYSCGPGTLKMNGKLSEERTEDTDCDGSPLPEYFTEATKMNGCEEYCEEKVKSESLIQKPQEKKTDDDEITWGNDELPIERTNHEDSDKDHSFLTNDELAVLPVVKVLPSGKYTGANLKSVIRVLRGLLDQGIPSKELENLQELKPLDQCLIGQTKENRRKNRYKNILPYDATRVPLGDEGGYINASFIKIPVGKEEFVYIACQGPLPTTVGDFWQMIWEQKSTVIAMMTQEVEGEKIKCQRYWPNILGKTTMVSNRLRLALVRMQQLKGFVVRAMTLEDIQTREVRHISHLNFTAWPDHDTPSQPDDLLTFISYMRHIHRSGPIITHCSAGIGRSGTLICIDVVLGLISQDLDFDISDLVRCMRLQRHGMVQTEDQYIFCYQVILYVLTRLQAEEEQKQQPQLLK

SEQ ID NO: 86 - protein, 415 aa, Homo sapiens
MKLSLTKVVNGCRLGKIKNLGKTGDHTMDIPGCLLYTKTGSAPHLTHHTLHNIHGVPAMAQLTLSSLAEHHEVLTEYKEGVGKFIGMPESLLYCSLHDPVSPCPAGYVTNKSVSVWSVAGRVEMTVSKFMAIQKALQPDWFQCLSDGEVSCKEATSIKRVRKSVDRSLLFLDNCLRLQEESEVLQKSVIIGVIEGGDVMEERLRSARETAKRPVGGFLLDGFQGNPTTLEARLRLLSSVTAELPEDKPRLISGVSRPDEVLECIERGVDLFESFFPYQVTERGCALTFSFDYQPNPEETLLQQNGTQEEIKCMDQIKKIETTGCNQEITSFEINLKEKKYQEDFNPLVRGCSCYCCKNHTRAYIHHLLVTNELLAGVLLMMHNFEHYFGFFHYIREALKSDKLAQLKELIHRQAS

SEQ ID NO: 87 - protein, 754 aa, Homo sapiens
MIVFLVFKHLFSLRLITMFFLLHFIVLINVKDFALTQGSMITPSCQKGYFPCGNLTKCLPRAFHCDGKDDCGNGADEENCGDTSGWATIFGTVHGNANSVALTQECFLKQYPQCCDCKETELECVNGDLKSVPMISNNVTLLSLKKNKIHSLPDKVFIKYTKLKKIFLQHNCIRHISRKAFFGLCNLQILYLNHNCITTLRPGIFKDLHQLTWLILDDNPITRISQRLFTGLNSLFFLSMVNNYLEALPKQMCAQMPQLNWVDLEGNRIKYLTNSTFLSCDSLTVLFLPRNQIGFVPEKTFSSLKNLGELDLSSNTITELSPHLFKDLKLLQKLNLSSNPLMYLHKNQFESLKQLQSLDLERIEIPNINTRMFQPMKNLSHIYFKNFRYCSYAPHVRICMPLTDGISSFEDLLANNILRIFVWVIAFITCFGNLFVIGMRSFIKAENTTHAMSIKILCCADCLMGVYLFFVGIFDIKYRGQYQKYALLWMESVQCRLMGFLAMLSTEVSVLLLTYLTLEKFLVIVFPFSNIRPGKRQTSVILICIWMAGFLIAVIPFWNKDYFGNFYGKNGVCFPLYYDQTEDIGSKGYSLGIFLGVNLLAFLIIVFSYITMFCSIQKTALQTTEVRNCFGREVAVANRFFFIVFSDAICWIPVFVVKILSLFRVEIPDTMTSWIVIFFLPVNSALNPILYTLTTNFFKDKLKQLLHKHQRKSIFKIKKKSLSTSIVWIEDSSSLKLGVLNKITLGDSIMKPVS

SEQ ID NO: 88 - protein, 314 aa, Homo sapiens
MGIGRSEGGRRGAALGVLLALGAALLAVGSASEYDYVSFQSDIGPYQSGRFYTKPPQCVDIPADLRLCHNVGYKKMVLPNLLEHETMAEVKQQASSWVPLLNKNCHAGTQVFLCSLFAPVCLDRPIYPCRWLCEAVRDSCEPVMQFFGFYWPEMLKCDKFPEGDVCIAMTPPNATEASKPQGTTVCPPCDNELKSEAIIEHLCASEFALRMKIKEVKKENGDKKIVPKKKKPLKLGPIKKKDLKKLVLYLKNGADCPCHQLDNLSHHFLIMGRKVKSQYLLTAIHKWDKKNKEFKNFMKKMKNHECPTFQSVFK

SEQ ID NO: 89 - protein, 1214 aa, Homo sapiens
MERFRLEKKLPGPDEEAVVDLGKTSSTVNTKFEKEELESHRAVYIGVHVPFSKESRRRHRHRGHKHHHRRRKDKESDKEDGRESPSYDTPSQRVQFILGTEDDDEEHIPHDLFTEMDELCYRDGEEYEWKETARWLKFEEDVEDGGDRWSKPYVATLSLHSLFELRSCILNGTVMLDMRASTLDEIADMVLDNMIASGQLDESIRENVREALLKRHHHQNEKRFTSRIPLVRSFADIGKKHSDPHLLERNGEGLSASRHSLRTGLSASNLSLRGESPLSLLLGHLLPSSRAGTPAGSRCTTPVPTPQNSPPSSPSISRLTSRSSQKSQRQAPELLVSPASDDIPTVVIHPPEEDLEAALKGEEQKNEENVDLTPGILASPQSAPGNLDNSKSGEIKGNGSGGSRENSTVDFSKVDMNFMRKIPTGAEASNVLVGEVDFLERPIIAFVRLAPAVLLTGLTEVPVPTRFLFLLLGPAGKAPQYHEIGRSIATLMTDEIFHDVAYKAKDRNDLLSGIDEFLDQVTVLPPGEWDPSIRIEPPKSVPSQEKRKIPVFHNGSTPTLGETPKEAAHHAGPELQRTGRLFGGLILDIKRKAPFFLSDFKDALSLQCLASILFLYCACMSPVITFGGLLGEATEGRISAIESLFGASLTGIAYSLFAGQPLTILGSTGPVLVFEKILYKFCRDYQLSYLSLRTSIGLWTSFLCIVLVATDASSLVCYITRFTEEAFAALICIIFIYEALEKLFDLGETYAFNMHNNLDKLTSYSCVCTEPPNPSNETLAQWKKDNITAHNISWRNLTVSECKKLRGVFLGSACGHHGPYIPDVLFWCVILFFTTFFLSSFLKQFKTKRYFPTKVRSTISDFAVFLTIVIMVTIDYLVGVPSPKLHVPEKFEPTHPERGWIISPLGDNPWWTLLIAAIPALLCTILIFMDQQITAVIINRKEHKLKKGAGYHLDLLMVGVMLGVCSVMGLPWFVAATVLSISHVNSLKVESECSAPGEQPKFLGIREQRVTGLMIFILMGLSVFMTSVLKFIPMPVLYGVFLYMGVSSLKGIQLFDRIKLFGMPAKHQPDLIYLRYVPLWKVHIFTVIQLTCLVLLWVIKVSAAAVVFPMMVLALVFVRKLMDLCFTKRELSWLDDLMPESKKKKEDDKKKKEKEEAERMLQDDDDTVHLPFEGGSLLQIPVKALKYSPDKPVSVKISFEDEPRKKYVDAETSL

SEQ ID NO: 90 - protein, 237 aa, Homo sapiens
MAGVSACIKYSMFTFNFLFWLCGILILALAIWVRVSNDSQAIFGSEDVGSSSYVAVDILIAVGAIIMILGFLGCCGAIKESRCMLLLFFIGLLLILLLQVATGILGAVFKSKSDRIVNETLYENTKLLSATGESEKQFQEAIIVFQEEFKCCGLVNGAADWGNNFQHYPELCACLDKQRPCQSYNGKQVYKETCISFIKDFLAKNLIIVIGISFGLAVIEILGLVFSMVLYCQIGNK

SEQ ID NO: 91 - protein, 508 aa, Homo sapiens
MPPKRNEKYKLPIPFPEGKVLDDMEGNQWVLGKKIGSGGFGLIYLAFPTNKPEKDARHVVKVEYQENGPLFSELKFYQRVAKKDCIKKWIERKQLDYLGIPLFYGSGLTEFKGRSYRFMVMERLGIDLQKISGQNGTFKKSTVLQLGIRMLDVLEYIHENEYVHGDIKAANLLLGYKNPDQVYLADYGLSYRYCPNGNHKQYQENPRKGHNGTIEFTSLDAHKGVALSRRSDVEILGYCMLRWLCGKLPWEQNLKDPVAVQTAKTNLLDELPQSVLKWAPSGSSCCEIAQFLVCAHSLAYDEKPNYQALKKILNPHGIPLGPLDFSTKGQSINVHTPNSQKVDSQKAATKQVNKAHNRLIEKKVHSERSAESCATWKVQKEEKLIGLMNNEAAQESTRRRQKYQESQEPLNEVNSFPQKISYTQFPNSFYEPHQDFTSPDIFKKSRSPSWYKYTSTVSTGITDLESSTGLWPTISQFTLSEETNADVYYYRIIIPVLLMLVFLALFFL

SEQ ID NO: 92 - protein, 242 aa, Homo sapiens
MVMMWDLHGSSQPRQQLCGHAMVVTGLAVSPDSSQLCTGSRDNTLLLWDVVTGQSVERASVSRNVVTHLCWVPREPYILQTSEDKTLRLWDSRGLQVAHMFPAKQHIQTYCEVSVDGHKCISCSNGFGGEGCEATLWDLRQTRNRICEYKGHFQTVASCVFLPRALALMPLIATSSHDCKVKIWNQDTGACLFTLSLDGSGPLTSLAVGDAISLLCASFNRGIHLLRMDHSQGLELQEVAAF

SEQ ID NO: 93 - protein, 367 aa, Homo sapiens
MLLLRCQLKQAPPQKVSFRFCVVMGKQQSKLKHSTYKYGRPDEIIEERIQTKAFQEYSPAHMDTVSVVAALNSDLCVSGGKDKTVVAYNWKTGNVVKRFKGHEHEITKVACIPKSSQFFSASRDRMVMMWDLHGSSQPRQQLCGHAMVVTGLAVSPDSSQLCTGSRDNTLLLWDVVTGQSVERASVSRNVVTHLCWVPREPYILQTSEDKTLRLWDSRGLQVAHMFPAKQHIQTYCEVSVDGHKCISCSNGFGGEGCEATLWDLRQTRNRICEYKGHFQTVASCVFLPRALALMPLIATSSHDCKVKIWNQDTGACLFTLSLDGSGPLTSLAVGDAISLLCASFNRGIHLLRMDHSQGLELQEVAAF

SEQ ID NO: 94 - protein, 366 aa, Homo sapiens
MLLLRCQLKQAPPQKVSFRFCVVMGKQQSKLKHSTYKYGPDEIIEERIQTKAFQEYSPAHMDTVSVVAALNSDLCVSGGKDKTVVAYNWKTGNVVKRFKGHEHEITKVACIPKSSQFFSASRDRMVMMWDLHGSSQPRQQLCGHAMVVTGLAVSPDSSQLCTGSRDNTLLLWDVVTGQSVERASVSRNVVTHLCWVPREPYILQTSEDKTLRLWDSRGLQVAHMFPAKQHIQTYCEVSVDGHKCISCSNGFGGEGCEATLWDLRQTRNRICEYKGHFQTVASCVFLPRALALMPLIATSSHDCKVKIWNQDTGACLFTLSLDGSGPLTSLAVGDAISLLCASFNRGIHLLRMDHSQGLELQEVAAF

SEQ ID NO: 95 - protein, 502 aa, Homo sapiens
MAAPCEGQAFAVGVEKNWGAVVRSPEGTPQKIRQLIDEGIAPEEGGVDAKDTSATSQSVNGSPQAEQPSLESTSKEAFFSRVETFSSLKWAGKPFELSPLVCAKYGWVTVECDMLKCSSCQAFLCASLQPAFDFDRYKQRCAELKKALCTAHEKFCFWPDSPSPDRFGMLPLDEPAILVSEFLDRFQSLCHLDLQLPSLRPEDLKTMCLTEDKISLLLHLLEDELDHRTDERKTTIKLGSDIQVHVTACILSVCGWACSSSLESMQLSLITCSQCMRKVGLWGFQQIESSMTDLDASFGLTSSPIPGLEGRPERLPLVPESPRRMMTRSQDATFSPGSEQAEKSPGPIVSRTRSWDSSSPVDRPEPEAASPTTRTRPVTRSMGTGDTPGLEVPSSPLRKAKRARLCSSSSSDTSSRSFFDPTSQHRDWCPWVNITLGKESRENGGTEPDASAPAEPGWKAVLTILLAHKQSSQPAETDSMSLSEKSRKVFRIFRQWESLCSC

SEQ ID NO: 96 - protein, 409 aa, Homo sapiens
MTQKGSMKPVKKKKTEEPELEPLCCCEYIDRNGEKNHVATCLCDCQDLDEGCDRWITCKSLQPETCERIMDTISDRLRIPWLRGAKKVNISIIPPLVLLPVFLHVASWHFLLGVVVLTSLPVLALWYYYLTHRRKEQTLFFLSLGLFSLGYMYYVFLQEVVPKGRVGPVQLAVLTCGLFLILLALHRAKKNPGYLSNPASGDRSLSSSQLECLSRKGQEKTKGFPGADMSGSLNNRTTKDDPKGSSKMPAGSPTKAKEDWCAKCQLVRPARAWHCRICGICVRRMDHHCVWINSCVGESNHQAFILALLIFLLTSVYGITLTLDTICRDRSVFTALFYCPGVYANYSSALSFTCVWYSVIITAGMAYIFLIQLINISYNVTEREVQQALRQKTGRRLLCGLIVDTGLLG

SEQ ID NO: 97 - protein, 595 aa, Homo sapiens
MAALSPTFATSTQDSTCLQDSEFPVSSKDHSCPQNLDLFVCSGLEPHTPSVGSQESVTFQDVAVDFTEKEWPLLDSSQRKLYKDVMLENYSNLTSLGYQVGKPSLISHLEQEEEPRTEERGAHQGACADWETPSKTKWSLLMEDIFGKETPSGVTMERAGLGEKSTEYAHLFEVFGMDPHLTQPMGRHAGKRPYHRRDYGVAFKGRPHLTQHMSMYDGRKMHECHQCQKAFTTSASLTRHRRIHTGEKPYECSDCGKAFNDPSALRSHARTHLKEKPFDCSQCGNAFRTLSALKIHMRVHTGERPYKCDQCGKAYGRSCHLIAHKRTHTGERPYECHDCGKAFQHPSHLKEHVRNHTGEKPYACTQCGKAFRWKSNFNLHKKNHMVEKTYECKECGKSFGDLVSRRKHIRIHIVKKPVECRQCGKTFRNQSILKTHMNSHTGEKPYGCDLCGKAFSASSNLTAHRKIHTQERRYECAACGKVFGDYLSRRRHMSVHLVKKRVECRQCGKAFRNQSTLKTHMRSHTGEKPYECDHCGKAFSIGSNLNVHRRIHTGEKPYECLVCGKAFSDHSSLRSHVKTHRGEKLFVSSVWKRLQ

SEQ ID NO: 98 - protein, 463 aa, Homo sapiens
MAQGLVTFADVAIDFSQEEWACLNSAQRDLYWDVMLENYSNLVSLDLESAYENKSLPTEKNIHEIRASKRNSDRRSKSLGRNWICEGTLERPQRSRGRYVNQMIINYVKRPATREGTPPRTHQRHHKENSFECKDCGKAFSRGYQLSQHQKIHTGEKPYECKECKKAFRWGNQLTQHQKIHTGEKPYECKDCGKAFRWGSSLVIHKRIHTGEKPYECKDCGKAFRRGDELTQHQRFHTGEKDYECKDCGKTFSRVYKLIQHKRIHSGEKPYECKDCGKAFICGSSLIQHKRIHTGEKPYECQECGKAFTRVNYLTQHQKIHTGEKPHECKECGKAFRWGSSLVKHERIHTGEKPYKCTECGKAFNCGYHLTQHERIHTGGTPYKCKECGKAFIYGSSLVKHERIHTGVKPYGCTECGKSFSHGHQLTQHQKTHSGAKSYECKECGKACNHLNHLREHQRIHNS

SEQ ID NO: 99 - protein, 284 aa, Homo sapiens
MGSEKEQSPEPHLPEEGEGGKPWRVDDSEGSWIPPGEKEHGQESLSDELQETHPKKPWQKVTVRARELGDPIAHPRHEADEKPFICAQCGKTFNNTSNLRTHQRIHTGEKPYKCSECGKSFSRSSNRIRHERIHLEEKHYKCPKCQESFRRRSDLTTHQQDHLGKRPYRCDICGKSFSQSATLAVHHRTHLEPAPYICCECGKSFSNSSSFGVHHRTHTGERPYECTECGRTFSDISNFGAHQRTHRGEKPYRCTVCGKHFSRSSNLIRHQKTHLGEQAGKDSS

SEQ ID NO: 100 - protein, 273 aa, Homo sapiens
MSPKRDGLGTGDGLHSQVLQEQVSTGDNLHECDSQGPSKDTLVREGKTYKCKECGSVFNKNSLLVRHQQIHTGVKPYECQECGKAFPEKVDFVRPMRIHTGEKPCKCVECGKVFNRRSHLLCYRQIHTGEKPYECSECGKTFSYHSVFIQHRVTHTGEKLFGCKECGKTFYYNSSLTRHMKIHTGEKPCKCSECGKTFTYRSVFFRHSMTHTAGKPYECKECGKGFYYSYSLTRHTRSHTGEKPYECLEHRKDFGYHSAFAQQSKIHSGGKNL

SEQ ID NO: 101 - protein, 128 aa, Homo sapiens
QRVSWAKRGVQQDGRCVVSQLERSRSKRGNILLFSSPLPSPSANGTCEIWLDFEASNSSLHSQTLLLSLVAALRINLLVTFFNQFLPEKRLGCKDDRNQTSNGFPGAEGRKGFSYSFSSQGIKKRMGS

SEQ ID NO: 102 - protein, 105 aa, Homo sapiens
HPACSGRRLSGWGRFPGIGNKLISLVGLLKHYHKTVRMTDECSSGVNHGNTVKDSDLLLLRACMYMINGWKCRTPRFTSFPFQQNYLRRVKSTGGVTPLFLSVEI

SEQ ID NO: 103 - DNA, 137 bp, Homo sapiens
ttcacgattaactgtgaaatgtacgtcatttgtgcaagaccgtttgtccacttcattttgtataatcacagttgtgttcctgacactcaataaacagtcaytggaaagagtgccagtcagcagtcatgcacgctgat

SEQ ID NO: 104 - DNA, 137 bp, Homo sapiens; identical to SEQ ID NO: 103

SEQ ID NO: 105 - DNA, 182 bp, Homo sapiens
caaatgtagccctgcatcctccagtgttacctggtgtagatttttttttctgtacctttctaaacctctcttccctctgtgatggttttgtgtttaaacartcatcttcttttaaataatatccacctctcctttttgccatttcacttattgattcataaagtgaattttatttaaagcta

SEQ ID NO: 106 - DNA, 201 bp, Homo sapiens
gcccacgccaagccccacaccagtgagaagcatcagcaccgtgaacttgtctgagaatagcagtgttgtcatccccccacccgactacttggaatgcttgrccatgggggcagctgccgacaggagagcagattcggccaggacgacatccacctttaaggccccagcgtccaagcccgagaccgcggctcctaacgatgc

SEQ ID NO: 107 - DNA, 201 bp, Homo sapiens
tggagctgggactggggctgtctgggtggctggtatcctcgtttgatacaggtggagtctgtgtgtctccagtgattgattggttcagaatggttctgtgmtgccttttttccccctggggtcaggggtgtggggaagtggggaaagagggcccctcagggaatcagcagggctgatgggagctactgccggaggcttttg

SEQ ID NO: 108 - DNA, 201 bp, Homo sapiens
tgtggggaagtggggaaagagggcccctcagggaatcagcagggctgatgggagctactgccggaggcttttgtcacaccctgtacacagtctgatcccgytcatctgggccctgcattcatttctaaacagtttctaatgcctattccccaattcctattgagcccgatttgcagtatctgaggggtgtgtgtgtgtgtg

SEQ ID NO: 109 - DNA, 201 bp, Homo sapiens; identical to SEQ ID NO: 107

SEQ ID NO: 110 - DNA, 201 bp, Homo sapiens; identical to SEQ ID NO: 108

SEQ ID NO: 111 - DNA, 161 bp, Homo sapiens
ctgtctcccgccacccacaccagctgtcccactcaccatggagaagatcctgatcctcctycttgtcgccctctctgtggcctatgcagctcctggcccccgggggatcattatcaacctggagaacggtgagctctgcatgaatagtgcccagtgtaaga

SEQ ID NO: 112 - DNA, 201 bp, Homo sapiens
aagtcacatgaatattcaaaagtcacaaattcattatctctttttataccaaaatcaaattcatccaagattgacaccaataaaagtattgctcaagggaraattactcttgacaattgttccaatgatttgcatcagttgccaccaagaaataatgaagtggagtattgcaaccagttactggacagcagcaaaaaattg

SEQ ID NO: 113 - DNA, 201 bp, Homo sapiens
tcacattcaagtattagcaacttgcagtatataaaatagttagataatgagaagttgttaattatctctaaaattggaattaggaagcatatcaccaataytgattaacattctctttggaactaggtaagagtggtctcttcttattgaacaacctcaatttagtttcatcccacctttctcagtataatccatgagagg

SEQ ID NO: 114 - DNA, 201 bp, Homo sapiens
gagatgggggatcctgtgcaggctgatgaggcacccatgagaaaagccgaaaaagcatgcatcttagaaatagcccctcaattccaggagtcaacatgccraagaatgaggctggagacaggtagctccgagggaggacttctggcatgagatctcggcacggcaagcccagcatcgcctcagcccagacaggctccacca

SEQ ID NO: 115 - DNA, 201 bp, Homo sapiens
gaatggacttagggcccatgaggttgtggctggcttaggcagcaacctccacattcccacaggccttgagcagaattttctgagactgaagggaaatcccsctttctttctaccagccctgcaagtttcctcatggacgctcgcgaggagcaggctgcaggtttcctgcctatggtgagatcagatgtggccaagggaagg

SEQ ID NO: 116 - DNA, 201 bp, Homo sapiens
gaaaaaaaaaacataggtagtatgagacagaaagtggtaaggaaaaagaaggttctcactcccccactccaccgtttcattgtcaggacgcatctccctgyggtgatcacaagggttaaggggaatgaaagtagctccctattatgaacgaagagaccgagaactcctattctggatcctcaaaacaagcatgaaagacct

SEQ ID NO: 117 - DNA, 201 bp, Homo sapiens
agagcataatccttggcagggctcagcaggcgcacgttggtttcttggtcgtcctttgagtgacaacttctccgtgaacctgctgaagaggcagaaaggcygtggaaagctgtatttccattcttgggtttctgcgccgtcggtgggcacttgttattttccaggaaccttctcctggtgtctacatgtttgcttagaggc

SEQ ID NO: 118 - DNA, 201 bp, Homo sapiens
aaaaccaggccacctgaagaatatctttaatgatggtattcttggtgatgggaccaacaagctccagaattactacaggtactatcttggaagccacttgwttctgaaactgaggcaggttcaggtttggggtcactgattctaagacatttacagaagttcgtgcatgtgtttcagccatgatccccaagattgaggcta

SEQ ID NO: 119 - DNA, 201 bp, Homo sapiens
ggtttcctgcctatggtgagatcagatgtggccaagggaaggagctctggttccagagaatttgcacaaagttccctctgtacagagacaaaacggcctcyggctctcagagcataatccttggcagggctcagcaggcgcacgttggtttcttggtcgtcctttgagtgacaacttctccgtgaacctgctgaagaggca

SEQ ID NO: 120 - DNA, 201 bp, Homo sapiens
ctgaaaagtgagtccacttggatccaggttgccagggaggaacaaacgtacagcacatgcgtggatgggatatccccacacaagaaaacgagcgcctcatkctgcttcccagaggttctctctgacctgaatggaaaagaagttggtctgagatcgaaggtactaaacagatcatcagactgaactctccacatgtcacct

SEQ ID NO: 121 - DNA, 201 bp, Homo sapiens
ggaattgcacttccagtttggtaaccttagtaaatcttgtgttgttgtttaatcgtgccttgcaaatcatcctttaaacactatgactgtggtttcttgtkgtggagtccctcatcatagtgaccctcatagcaacctctgaggttagcagagaaggtattattatctcgatctcaatgaggagaacaaggcttaatgagg

SEQ ID NO: 122 - DNA, 201 bp, Homo sapiens
gccgaggctgttggaacccactgctcaggacagcttgcacgtgtccatcacgagacgagactggcttcttcaggaaaagcagcagctacagaaagaaatcyaagctctccaagcaaggatgtttgtgctggaagccaaagatcaacagctgagaagggaaatagaggagcaagagcagcaactccagtggcagggctgcga

SEQ ID NO: 123 - DNA, 201 bp, Homo sapiens; identical to SEQ ID NO: 122

SEQ ID NO: 124 - DNA, 201 bp, Homo sapiens; identical to SEQ ID NO: 122

SEQ ID NO: 125 - DNA, 201 bp, Homo sapiens
tgggcctggggggcaggaggttgaaatccccccaggctccagaccctgaagaagaggagaacagggactcccagcagcctgggaaacgcagaaaggactcygaggaagaggctgccagtcctgaggggaagagggtccccaaaagattacggtgttgggaagaggaagaagatcatgagaaggagagacccgaacataagt

SEQ ID NO: 126 - DNA, 201 bp, Homo sapiens
caggtaccgctagagcgacatgatggtggaatctgcctcggagacaatcaggtcggctccatctggtcagaatggcgtgggcagcctctctgggcaagccmatggcagcagcggcggggccacagggacaactgcaagtggcacgggcagggaagtgaccacgggtgcagacagcaatggtgagatgagtcccgcagagct

SEQ ID NO: 127 - DNA, 201 bp, Homo sapiens; identical to SEQ ID NO: 126

SEQ ID NO: 128 - DNA, 201 bp, Homo sapiens; identical to SEQ ID NO: 126

SEQ ID NO: 129 - DNA, 201 bp, Homo sapiens
cagcgtccagccagaggcctcggacacccacatcctcctcctggaaggcttcctgctctacagctacaagcccctggtggacttgtacagccgccggtacytcctgaccgtcccgtatgaagagtgcaagtggaggagaagtacccgcaactacacagtccctgatccccccggcctcttcgatggccacgtgtggcccat

SEQ ID NO: 130 - DNA, 201 bp, Homo sapiens
gggtactacagaattaaaatgtaggtctaacataatgccagttccactttaactttgtttttgcatttgaagaatgtatgtagcactttcctatatatttktcacacattgaaaactggactgggtataactatgttataggaaagtagaaattgtattctttattttccatctttgttttctgttctacaaagttgatgc

SEQ ID NO: 131 - DNA, 201 bp, Homo sapiens
tgaacagaaccatagctttctaggtactaaagcattttttgcatttaactgatgaaatttctaacaatcatcagttaggaatattaacatgaaggataaaycaacttatttgtatacctaaggcaggcatttggatcagtaacatgttttactaagcctagagtaattcgtaaagggtataagcataggacagattttgcc

SEQ ID NO: 132 - DNA, 201 bp, Homo sapiens
tattgctgtggtaaaatgtatgcaatcggaggtcgtgtttatgaaggtgatgggagaaactcactaaaatctgttgagtgctacgacagtagagagaattyttggacgactgtttgcgcgatgccagttgcaatggaatttcataatgctgtggagtacaaagagaagatctatgttttacagggagaattttttctcttc

SEQ ID NO: 133 - DNA, 201 bp, Homo sapiens
cgatgactttttcaagtgctaacactgtctcttttgtgaaaatctggaaaagtgctcatattcacaggtggctggtgctagtctaacttaattcatgtgtrtaactagatggatttaaatggtctgagcctatgcctatctttcaaattggtgtggatttcatggccatagtactttacctgttgaactcttgtgatttca

SEQ ID NO: 134 - DNA, 167 bp, Homo sapiens
attaaatgtgcaatattcactacttattcattgttccacatttttcatacttgtacaaagggtaagtttttatataatggtgagaaacaggaagaaatgayaactggttaagtaaaattctgcaaataaactagattcgaatttaatttaaaaaaaaaaaaaaaaaa

SEQ ID NO: 135 - DNA, 201 bp, Homo sapiens
gcagtttgtccgtgcagctggacttcactgatcctttgctggctaaagaaagggttttaagtaacttgcggaagcatgaggctccccagcctccccttgcyctgcacccgacgaagcctcctgtgccagttatttcctctgctgtgctattgagtcagaaggacgccacccagctggtgtgcacagacctgaatctgttgc

SEQ ID NO: 136 - DNA, 201 bp, Homo sapiens
catagatggttgtattggaagaaggttttttcaaagtcctgctcatatcaatttgttgaaagaaatgaagagacgtttgaccgaggtggctgacttccacyatgctgcaagcaaggccctccgtgttccagcagagggcagtgaagggctgccagagagccactctggcacccctggttacctgacttcaccagaactgca

SEQ ID NO: 137 - DNA, 201 bp, Homo sapiens
aaaaaggaagatgattgtcaggggaaaaacttacaaaatgctacagtgtttacaaatgccagttccaggtgattagaaaggccgttttcattatggttcaratttggaatagcttatgcaaagattgtgttcatttttatacaattctttttaactttaaattgccatctgtgttttaaacataattctgcactttggaat

SEQ ID NO: 138 - DNA, 201 bp, Homo sapiens
cgccccagaacctccttgctctgcagtccttgcaagacgacttactctgggtctctaggctttggatccagcagctgccgctccctgggctatggatcgasgagctgctactcagtgggctgtgggtccagtggtgtcagatccctgggttatggaagctgtggcttcccttccctcggctatggatctggattctgccgc

SEQ ID NO: 139 - DNA, 201 bp, Homo sapiens
agccccagctgcagcccaagcacccagaccaatgggtatgtatgcaattgccacatacccactcgaaatgcatccaaagcctgccaaaccctccgcaacgrttccaactgctttggacaacttaactgcttatccaagagtttccaaactctaaaccactgcagattgagtactttggggtataaaagctaccaaaatcct

SEQ ID NO: 140 - DNA, 201 bp, Homo sapiens
cagcctgctctcacaacctcactatgtcttgccccaactactgctcgggaaactccaactcaggatctctcagaacctcccgccatattcctctcacctcmatcgacctctgccctaccagcgtgagctgtggagatgtcctctacttacccactagctctcaagaccatacctgggtcacagacaactgccaagagacct

SEQ ID NO: 141 - DNA, 201 bp, Homo sapiens
gcctatgtactgatttgtgggatggtggcaggggtgtggggtccttcaccctgcctgaattctctttggcttctgtgctctgtatgctgctgtccccaagrgctctttcttattatggcagggagtggggattggtcctactttctttctctggaaaggaaagcctccaagactccatgtgcttgggcagcttgagaaggc

SEQ ID NO: 142 - DNA, 201 bp, Homo sapiens
ccttgaaagggggttggataaggttatcactgtgctcaccaggagcaaaaggaagggttctgccagagacgggcccagaagactaaagcttcactataatytgactacaactagattagtgaatccagatcaactgttgaatgaaataatgtctattcttccaaagaagcatgttgactttgtacaaaagggttatacact

SEQ ID NO: 143 - DNA, 201 bp, Homo sapiens
agtccctgcggtccaggcagcattagccatcgtgccctgctgaggggctggctgccttgagtggcctgatcgccacagcccttcttggaagaaaggcgtcygtgtttcaggttccacgcgagtcacctctttcgtcttaatgttcaccgtccacagctttggaataaaccatcctgggaagttgctgcaaaaaaaaaaaaa

SEQ ID NO: 144 - DNA, 201 bp, Homo sapiens
tcagctcctcctggtcctttggttgcccttctgtgggcccaatgtgatcaatcactttgcctgtgacttgtaccctttgctggaagttgcctgcaccaatycgtatgtcattggtctgctggtggttgccaacagtggtttaatctgcctgttgaacttcctcatgctggctgcctcctacattgtcatcctgtactcctt

SEQ ID NO: 145 - DNA, 201 bp, Homo sapiens
agctgctaacaacaaacgtcagcttagtgaaaaccgaaagcccttcaactttttgcctatgcagattaatactaacaagagcaaagatgcatctacaagtyccccaaacagagaaacgattggatcagcacagtgtaaagagttgtttgcttctgctttaagtaatgacctcttgcaaaactgtcaggtgtctgaagaaga

SEQ ID NO: 146 - DNA, 201 bp, Homo sapiens
agtaatgcacagtgtgtttctaataatagagatgggcgaacagttaattctaattgtgaaattaacaacagatctgctgccaacataagggctctaaacargcctccttctttagattgtcgatataatagagaaggggaacaggagattcatgttgcacaaggtgaagatgatgaggaggaggaggaagaagcagaagag

SEQ ID NO: 147 - DNA, 201 bp, Homo sapiens
gcatgcacgtgatactcacacagtggcttctgctcaccaacagatgaagacagatgcaccaacgaggctgatgggaaccaccctgtagaggtccatctgcrttcagacccagacgatgccagagctatgactgggcctgcaggtgtggcgccgaggggagatcagccatggagcagccacaggaggaagcccctgaggtcc

SEQ ID NO: 148 - DNA, 199 bp, Homo sapiens
ttttttctgctaccgtgactaagatggaagcgtttttggggtcgcggtccggactttgggcggggggtccggccccaggacagttttaccgcattccgrccactcccgattccttcatggatccggcgtctgcactttacagaggtccaatcacgcggacccagaaccccatggtgaccgggacctcagtcctcggcgt

SEQ ID NO: 149 - DNA, 201 bp, Homo sapiens
agcagccagtgctaagccagaccgaggcccgcgacttagtagaacgctgcatgcgagtgctgtactaccgagatgcccgttcttacaaccggtttcaaatygccactgtcaccgaaaaaggtgttgaaatagagggaccattgtctacagagaccaactgggatattgcccacatgatcagtggctttgaatgaaatacag

SEQ ID NO: 150 - DNA, 201 bp, Homo sapiens
atcttcctacatgcaagacagtgctatagattcttcttccaaggatcaccactggtcacgtggtaccctgaggcacatctcggagaactcctttgggccarctgggggcctgcgggaaggaagcctgagttctcaagattccaggactgagagtgccagcttgtctcaaagccaggtcaatggtttctttgccagccattt

SEQ ID NO: 151 - DNA, 201 bp, Homo sapiens; identical to SEQ ID NO: 150

SEQ ID NO: 152 - DNA, 201 bp, Homo sapiens; identical to SEQ ID NO: 150

SEQ ID NO: 153 - DNA, 201 bp, Homo sapiens
caaatacaagtctcactcttcacactgagcctgtaccactgttgtaacatgggaagacgtgaagaagaaataatctgagctttaattatttatatttggayataaggtctgcttaaataaagaatctttgtaccaaactgcccacatgagggtgaagagatttcctcaaaagacttaaatgacctggattgatcagagaga

SEQ ID NO: 154 - DNA, 201 bp, Homo sapiens
ggagtatgtttcccactttattatgaccaaacagaagatattggaagcaaagggtattctcttggaattttcctaggtgtgaacttgctggcttttctcarcattgtgttttcctatattactatgttctgttccattcaaaaaaccgccttgcagaccacagaagtaaggaattgttttggaagagaggtggctgttgca

SEQ ID NO: 155 - DNA, 201 bp, Homo sapiens
gaagacattttcttcattaaaaaatttaggagaactggatctgtctagcaatacgataacggaactatcacctcacctttttaaagacttgaagcttctaraaaagctgaacctgtcatccaatcctcttatgtatcttcacaagaaccagtttgaaagtcttaaacaacttcagtctctagacctggaaaggatagagat

SEQ ID NO: 156 - DNA, 201 bp, Homo sapiens
ttcaaaacacatagttaaaaaagaaacaaatgaaaaaaattttagaacagtccagcaaattgctagtcagggtgaattgtgaaattgggtgaagagcttasgattctaatctcatgttttttccttttcacatttttaaaagaacaatgacaaacacccacttatttttcaaggttttaaaacagtctacattgagcattt

SEQ ID NO: 157 - DNA, 201 bp, Homo sapiens
caatagaaactttaataatgatagtttttaacttttatgtttaaattttttttaaatcttaaaaccttcatatctaggtatccattgtgacagacaagtaraattgcaggtgatttgataattaagcacccataccatttataacttctgaatttaaaaagttatacaatgccagtttgcaatagttgattttgatgcctt

SEQ ID NO: 158 - DNA, 201 bp, Homo sapiens
ccatgccaaagctataatggaaaacaagtttacaaagagacctgtatttctttcataaaagacttcttggcaaaaaatttgattatagttattggaatatkatttggactggcagttattgagatactgggtttggtgttttctatggtcctgtattgccagatcgggaacaaatgaatctgtggatgcatcaacctatcg

SEQ ID NO: 159 - DNA, 201 bp, Homo sapiens
aagcaatttttggttctgaagatgtaggctctagctcctacgttgctgtggacatattgattgctgtaggtgccatcatcatgattctgggcttcctgggstgctgcggtgctataaaagaaagtcgctgcatgcttctgttgtttttcataggcttgcttctgatcctgctcctgcaggtggcgacaggtatcctaggag

SEQ ID NO: 160 - DNA, 201 bp, Homo sapiens
gaatatcatttggactggcagttattgagatactgggtttggtgttttctatggtcctgtattgccagatcgggaacaaatgaatctgtggatgcatcaasctatcgtcagtcaaacccctttaaaatgttgctttggctttgtaaatttaaatatgtaagtgctatataagtcaggagcagctgtctttttaaaatgtct

SEQ ID NO: 161 - DNA, 194 bp, Homo sapiens
tcagtgtttccttccagacatttttaaggtaattggctttaaaaagagaacatattttaacaaagtttgtggacactctaaaaaataaaattgctttgtaytagaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 162 - DNA, 201 bp, Homo sapiens
cttataaatacggacagttgtggcctataattggaaaactggaaatgtggtgaaaaggttcaaaggacatgaacatgagatcaccaaggtagcctgtattyccaaatccagccagttcttcagtgcctctcgtgacaggatggtcatgatgtgggacttgcacggttcctcacaaccaaggcagcaattgtgtggccatgc

SEQ ID NO: 163 - DNA, 201 bp, Homo sapiens
gggaaagataagacagttgtggcctataattggaaaactggaaatgtggtgaaaaggttcaaaggacatgaacatgagatcaccaaggtagcctgtattcycaaatccagccagttcttcagtgcctctcgtgacaggatggtcatgatgtgggacttgcacggttcctcacaaccaaggcagcaattgtgtggccatgcc

SEQ ID NO: 164 - DNA, 201 bp, Homo sapiens; identical to SEQ ID NO: 163

SEQ ID NO: 165 - DNA, 201 bp, Homo sapiens
aggatgccactttctccccaggctcagagcaggctgaaaagagccctggtcccattgtctctcgaactcggagctgggactcttccagtcctgttgaccgrcctgagccagaggctgctagccccaccaccagaactcgcccagtgacccgaagcatgggaacaggagacacccctggcctggaggtaccatctagccctc

SEQ ID NO: 166 - DNA, 201 bp, Homo sapiens
tatgttcctgtggatgtctgctgtgactaatataaatttcttgcagaatcagctacacttaattatgttgctgatagacaagcatccacgcttcagctggsactaagtgttttcattgtaggatcagcagcaggttaaagactgaacggttagtgaagacaaatgtcttaagaggctgcgatgtctaggttgggcttgtga

SEQ ID NO: 167 - DNA, 201 bp, Homo sapiens
atgggccaaggaggggtcagcggcgaattctttcggcctgttggggacccctcgtgtccccacgccagactggacctcccgtatgaacttctcttcgcatyggcggcggcttccgtcacctccgctcccccgatcctattcccagtcgtatgccagcttggagagtcacgtgagagcaagagagtagctttctggttgtcc

SEQ ID NO: 168 - DNA, 201 bp, Homo sapiens
atcccttggccgtaactggatatgtgaaggtacgcttgaaagaccacagcgctccagagggaggtatgtcaatcagatgatcatcaattatgtcaaaagarctgctactagagaaggcacccctcctagaacacatcagagacatcataaggagaattcctttgaatgtaaggactgtgggaaggcctttagtcgtggcta

SEQ ID NO: 169 - DNA, 201 bp, Homo sapiens
tttataaattaaactttagatatgtatgtacaggaaaaaatgtagtatatagtatcgtatatatgtacaggaaaaaaacgtactatctgtggtttcaggtrtccactgcgggtcttcaaacgtacccccctcaggtgagaggggactgctgtacaaagaatataggaaggcctctagactacatccattccttcctcaaca

SEQ ID NO: 170 - DNA, 201 bp, Homo sapiens
agatatgtatgtacaggaaaaaatgtagtatatagtatcgtatatatgtacaggaaaaaaacgtactatctgtggtttcaggtgtccactgcgggtcttcraacgtacccccctcaggtgagaggggactgctgtacaaagaatataggaaggcctctagactacatccattccttcctcaacaggaggaaaattcctggt

SEQ ID NO: 171 - DNA, 201 bp, Homo sapiens
ctcgtgttggaaagtcagaagacccagtcttggctttactttcttggggtgaaagagaaatagggtaggctcagaacatgctcatgttattaaggcagcartccccctggcctttgaggaagtacttatgagatgggtgtcactgtctgaaggttctccaaattgtctgtgaactgcttaggtaggagtgcactgcagttt

SEQ ID NO: 172 - DNA, 201 bp, Homo sapiens
aaaccttttactacaactcttccttaacccggcacatgaagattcacactggagagaagccctgcaagtgcagtgagtgcgggaagaccttcacctaccgrtctgttttcttccgacatagtatgacccacactgcaggaaagccctacgagtgcaaagaatgtgggaaaggtttttactacagctattccctcactcgac

SEQ ID NO: 173 - DNA, 201 bp, Homo sapiens
gaagccctgcaagtgcagtgagtgcgggaagaccttcacctaccgctctgttttcttccgacatagtatgacccacactgcaggaaagccctacgagtgcyaagaatgtgggaaaggtttttactacagctattccctcactcgacatacaaggagtcacactggagagaaaccttatgagtgccttgaacatagaaagga

SEQ ID NO: 174 - DNA, 201 bp, Homo sapiens
aagaatgtgggaaaggtttttactacagctattccctcactcgacatacaaggagtcacactggagagaaaccttatgagtgccttgaacatagaaaggamtttggctaccactctgcttttgcccaacagagtaagatccactctggaggaaaaaacctttgagtgcaaatgatgtgggaatttgtgggttttctttttt

SEQ ID NO: 175 - DNA, 128 bp, Homo sapiens
cagcgagtgtcatgggcaaagcgaggamtccagcaggatggacgctgtgtggtttctcagctggagcgcagcaggagcaagcgtggaaacatccttcttttctcttctcccctcccctccccaagtgc

SEQ ID NO: 176 - DNA, 142 bp, Homo sapiens
tctaattttccagagcccctcatataaggaactgtattattggtataatcatcatggtgaagaagttggtatgtgggggagagatgacagaaacagagagwaagtcagagctggctgcctgacagataaaaaggaaatgacc

SEQ ID NO: 177 - DNA, 48537 bp, Homo sapiens
aatagtggcttggaacacagggcaactgctaagagtcttttgtatttaacatgggagtcacaatcacattcttttttgctaccctttcagatcagatttcccaggttagagggttctctgttctgatgtgccttctcctttcacttgccctgacacaggcacctgtgcatcagtagtcacaatggaccctttgtcagattagggttggagccctgtcggccccatctccccaggaatgtcttttgcagggtgccctaggaatctgtgaaaatgaacgcggtgatgggaatagagtaatcctctcactcttccaagtgtgttcactgatgtcatagattcattagctatggtaattactgtttctgagtgtctggggaaaaacgcattctccccactgctgggagtgtgcagtgattcagacattttggaaagcacttcagtagtatcttacaaaataaatgtgcacctaccacatctattctttattgtgtatctgttatctattatataaactgttagatatgtaaacatatgatgttcactgcagcattacttataactacaaagctctgaaaacaaactaaatgtccatcgatatactttggaatccttcaaagcacttaaaaaagatgagaaaaattataaacagtcacatgcaaagagctccatactgttgaatgaaaaacaaaagctacgtgtagtggcacatgcctgtaatcccaacactttgggaagctgaggtgggaggatcacttgaccctaggagttcgagacccgcctgggcaaaatgatgagaccttgtctctacaaaaaaataaaaagaagcagcgcatggtggtgcattcctgtagccccagcaactcagaaggctgaggtgagaggactgcttgcccccaggatgttgaggctgcagtgagccatgattgtgccactgcattccagcctgggtgacagagtgagaccctttctcaaaacaaacagcccgggtgcagtggcttacgcctgtaatcttagcgctttgggaggctgaggtggatggatcacctgaggtcaggaattcaagaccaggctggccaacatggtgaaaccccatctctactaaaaatacaaaaattagttgggcgtggcggcaggtgcctgtaatctcagttacttgggaggctgaggcaagagaatcgcttgaactggggaggcggaggttgcaatgagcccagatcgtgccactgcactccagcctaggtgacagagtgagactccagcgtaggtgacaaagtgagactccatctcaaacacaaacaaacatgaacgcagagccaaacagagaatatgggtaagaggttacctctggggaggggagtggaatttcgaagagtgaagtaaaggggagacttctgtttgttaaatgttttatcaaaaaagataaatatattatttgcatattttaaagaaaattttaagataacctagctcagtggtttttaaatgattgtacctgatgagacagataaagtgtcaggtagctcagagataagatgagctgataaaaacagatctaatggaagcttaaggtgctatctctgcaaacaagtctaagtgaaatcctttattttgccgtacatggttcacataactttactagtcaaaatttaaaattactattaaataaagtttgtagcaatatctaaagcaaagcatgaaaagataagaaaatatttcttctaaataaatttgtcataggcacatagaccaaaggaatagaatagagaacccagaaataaactcaaatacttacagccaactgatcttcaacaaagcaaacaaaaacacagtggggaaaggacacccttttcaacaaatggtgctgggataattggctagccacatgtatgagaatgaaactggatcctcatctctcacctgatagaaaaatcaactcaagttggattaacgacttaaacctaaaacctgaaactataaaaattctagaagacaacattggaaaaacccttctcgacactggcttaggccaggatttcatgatcaaaaacccaaaaacaattgcaataaaaacaaagataaatagctgggacctaattaaactaaagagcttttgcacagcaaaaggaacagtcagcagagtaaacagacaacacacagagtgggagaaaatcttcacaatctatacatctgacagtggactaatatccagaatctccaaccaacccaaacaaatcagtaagaaaagaacaatcctgtcaaaaagtgggctaaggacatgaatagacaattctcaaaagaagatatacacacggccaacaaacatatgaaaaaatactcaacatcactaaagattagggaaatgcaaatcaaaaccacaatgcgataccaccttactcctgcaagaatggtcataatcaaagaatcaaaaatggtagatgttggcatggatgcagtgagcagaaaacacttctacactactggtgggaatgtaaactagtacagccactatggaaaacagtgtggagattccttaaagagctaaaagtagaaccaccatttgatccagcaatcccactactgggtatctactcagaggaaaagaagtcatattcgaaatagatacttgcacacacgtttatagcagcacatttcacaatcgcaaaatcgtggaaccaacccacatgcccatcaatcaacaattggataaagaaactgtggtatgtgtgtgtgtgtgtgtgtgtgtgtgtatatatatatatacacacacacacacacacacacacacatatgatggaatactactcagccataaaaatgaatgagttaacagcatttgcagtgacctggatgagattggagactattattctaagtgaagtaactcaggaatggaaaaccaaacatcatatgttctcgctgatatgtgatagctaagctatgaggatgcaaaggcataagaatgatacaatggactttggggacttggggggaagagtgggaggggggcgagggataagagacaacaaatacagtgcagtatatactgctcgggtgatgggtgcaccaatatctctcaattcaccactaaaaacttatgtaaccaaataccacctgtaccgcaataatttatggaaaaacaaaattaaaattaaaaaaaccttacacttgtattatcactattttggcacatctacagatattttaaaattttaaagtattttatacagaatgatacaccaaataacaattgctttggtcatgattctaataatccactttaatttttttattagcttgtgtatattttatttttttgagacacagtctcgctctgttgcccaggctggagtgcagtggcacaatcttggctcactgcaacctctgccacctgggttcaagcgattctcttgcctcagcctccccagtagctgggattacaggtgcccgccaccacgccaagctaatatttgtattttagtagacatggggtttctccgcgttgcccaggctggtctcgaactcctgagctcaggcgatccacctgcctcggcctgccaaagttaggattacaggcgtgagccaccatgcttggccgctcttgtatatttttaatgctagatttgtcactgttcttacgtagctaagttgaaaaaagaaatgcaagttaactaagcacctgtactcagcccttgaaatcttggatccagaagaacagtctatcaattatatgattaaaaaaaataagaactataataacttttcctaaacaaccacttaagatttttaaaaatccatcatattagcttttagcatattgagaacttaaggagatgatagggaaatatttttaatattattagattattttggctatagcagattttccacatggagaatgattttaaaaatattaatttttatctggtctataagacagtagtattattcaatacatattaatatgatcgctatagatttctatattcttttggttaaaaaacccagtcaaacaacaaagggctgtcaacttttcacagtcccttgtctttgacagccctaaaaattttgcagatatcaaagatctttcatagtgccttacttccttcacattttaaatataggaaaactgagtgccagagacaacaccagaacaagtctcaagttcatcttcccctatatacaccattgctcattggcaatgaatgtaataacttaaaaactactgcatatgtgtctttgacagagacatatacacacacacacatgaatatgtgtgtgtgtatatgtgtgtgtgtgtatatgtctatatattatgaagtcagtacccttgaaagcaaacaagtgaaaactttacacattgttcccacccagcaactgtaacaatcagaaacaaaaatgtaatgaaactcaactactgaaacttgattttctatagtaagacagtaaacttaattctttaataacagagccaatcactgggtgtttgctttaccaaggaatactttttctcagtaactaagatgaaaagtcttacttattccatttggtaatatgtatggtccattgtaccgagcaggtgaaaagcaagaactggtgtatgcatcaagtaatttccccttggttatggctccttggcataaggcgatttcactcacccacacacagccttggacatgcatagccttgcagttgacttcttagaactgctacttcttataatattttgaaataatgctatcaaccctgcctcattatttcatatccacaacatgggaagagcagaatttgtgtaggccactagactatcatagagcataatgtaaatgtctttttttttctttttaattgagacagaatcttgctctgtcacccaggcttgagtgcagtggcgcgatcacagctcaccgcagcctccatctcccaggctcaagtgctcctcccgcctcagcctcctgagtagctgggacacaggtgcatgctgcaaagcctagctagttattttttgatttttagtatacatcaagtctcactatgttgcccaggctggtctcaaacttctggcctcacgtgatgctcctgccttggcctcccaaagagctgggattacaggtgtgagccaccatgcacagccttactatgtttttctgacattcagtgagggttggcattgaactcaggtactatggtttcaaatttaaacatatttactgtaaatctgtgtgtgtgtgtacaaattatatatatatgtgtatatataaattgtatatatgtatgaaactccatctctactaaaatatacatcatattttgtatatgttatacatgtagaaactgtcatttgcagctcacaggccactttggaggcatcttggctacctgcccgtgactgcccaaactgcatgtgctttctgccaagtagagcatcattttgaaatacttgatatgaaagttttgactagatttcacccatgcatgtgtatgactaacaaagactacaatggttctgacgagtccaaccacacctgggtgtcggctgctactggattccctgcgcaactgagacacaatttaaatctagatttatcaagctagaggaatccttagagaaaattggatctaaaccctcattttacaaaggcagatatggggatgcaaggagttaagtcatgtgtcgctggtcacccaggctggtgatgaagcaatggaaacaatgtgagatttgttaccttttggcctgtttgtatgtcccagtacatactgaaaaggatagtgtttgtaaacgagaggggatatatggacttggtgaaaaattcattacattttctttatattaattatgaaatgtctaagtaatgaacagaagataaagcatcaggggagatattacacataaaaatgcaaaactatagacttttttttttttttttttggacagagtttcactttcttgcccaggctggagtggagtggcatgatcttggctcactgcaacttccgcctcctgggttcaagcaattctcgtgcctcagcctcctgagtagctgggattacggacgcccggcaccttgccaagctgattttttgtattttagtagagacagggtttcaccatgttacccaagcttgtcttgaactcccgagttcaggcaatccacccgtctctgcctcccaaagtgctaggattataggcgtgagtcacagagcccggccattttcttaacgtgtttttataacctattttctatttgaaattgttatacacaattcttggccgagactttatgatctcctcaaatttttgaaaaatcattaaggatcaatttgtatgcctaattgagtgataaatttaaagcagtgttgtacaagcattcaagaatttacagaaattggaattatatttgaaaactaatttttatttaactttcattgatacatgtactactaaattatcttgggaagagttttgaattcaatcaaaattgccatatcggccaagcatggtggctcacgcctgtaaccccagcactttgggaggctaaggcgggcggctcacttgaagtcaggagttcgagatcagcctggccaacacggtgaaactccgtctctactaaaaatacaaaatttagctgggcgtggtggtgggtacctgtaatcccagctactctggaggatgaagcaggagaattgcttgcacctgggaggtggaggctgccgtgaggcgagatggcgccactggaccactccagcctgggcaacagagcatgactctgtctcaaaaaaacaaaacaaaacaaaacaaaacaaaaaattccaatgaagtattttaaaataacaatgccctattttgcagaaagcacttgaattgttaacaacagtcataggcagccagctgagatgcctccaaattggcctgtcagctacaaatggacacagtaatcagatacatgtgaagtgaatgtttgggatgctgcctggagctgaatccaccaggagaccgcagtgcctatgcgcctccctcccacctctgcagcagggctgtgtgcggcattctgcgcacctggaacataaactccagttgtgccacaggccgcttgtctgtgagatctgcaggccagctgctattgctcaaccttgcaatgggagcaacaagttccaggtgttattgctgccactgacgaccgggacgaccaagccaagtttgggtcttggtgaaaaacaattgggggggcccccagtgagggctgaatggttaagtttccttatgaggattttgtatttgacagaggcaaaacctagttggcccaggtctcttctggtccacagggccagtgatttttactaactttctccataccttgcatgccccacacctcccttcccagcctgtgagaacacagagggatgcagtctatcccactctgtctgtattagtccgttttcgcactgctaagttataaagtaaagaggtttaatcgactcacagttccgcatggctggggaggcctcaggaaactgacaatcgtggcagaaggcaagagggcgggagacgacgccttcacaaggcaggagagaagcaagtcggagaaccaggaagcaccacactttaaaaccatcagctctcgtgagagctcactagctatcacgagaacagcatgggggaaaccacccccatgctccaatcaactccacctggtccctcccttgacaaatcgagatgagatttgggtgaggacacaggcccaaaccgtatcactgtcccagtctgcccttcaaggagccccagaggaagcccgggctgtgggaggcagcctggaggctggtatgcctagaccctgcccagctgccccaaagctgcggccctgtgaagggcctgagattttaccctgcttgcaagctaatgacctagcctgccacagcttcctggatgctggcagactcctgggccaaaggcaaaggactgtattgctctgggaatgccatttgccccccaccccaagtcccccaaggaggtgatgtgtgacaacccaatttatgatgtatcatctgtatcacagctgaggaaccccaagctcaggaaacccctcgagttataagatgggctgcttctccaatcaactcatccaacctttgccctacaggtagatgatgatctttattaccgtagtcaggaaacaaatctgtcctctgcctagacaagcatccttgaagatgtccagaactgccacagagaattgcccaacgcacaccagtctagcatcccctgtgccacctggctgggaaacccactttatcaacataagagggacagagtgccctagggaaaaagagaggactgattttcatgtgagctgagcaacctccccaagttgtgaaggttgaggagcccagccacacttccccaggcttgtagacggggccagcatgcagctcggtgtggtctggagcctgctggtcacatctgtcatatgtgaggctaagctggcaagtattttgtaaattgtcaccaataaacaaaaactatgcttcactttgtgagactaacttcaataatgactgtgtgaggttttatagtgactttttataaatttctgaactattcatatttttcacgtactcctgggtcacagccacagaaagactgaggagctcttaacgcattccccacaagctgagcacgattcagactcagggtagtcaaaaacaggtgacctgtcagctcctaacaccaaagggtttctgatccctatgggaacattaataattgacacagaacaagtagaaggcagtgacacagtggtgtccaggctcagcagggtggcctggtccatggcagcagaagtgtgggtctcataggacagagctgtttctcaatcctacttgtaaagtcaagaattcgggtgtcataagagcgcaggagttggacagacctggctaaaaccctggctctaagcccttctgttaatgcaactttcagcaagttacttccatggctggcaagtgtgattacaagtgataccggggtttgctgaggaggtaatctaggtcaagcaccttatcaatcacaaggcctggtacataaatggataagcaagagctctaattaagatgagtgactgaggagctcgatgtgtgaaggaatacaggtaggattcagccttccattcacaatcaaactcccgaaaacttggcagggaaattagatggagcccatggtttggatccaacctggaccttatttttttatagtatttctaaaaatagagtctcattaatgtccaatggctactaagttttgtcctctcaaaattaaaatagcacttgccattatccagtaggaactacagtcagcattttggttaatatcctcccagtcatcttttgatattctagatgtgtatctagttatgcataagtacatatataaagtgttatataaacaggctcatcctgtatatcctattttaaaactgctttaccactaaacaattacttcctaaaatcttaatacctgttatttcttgtaaactttgatttactccggagaaatcggtctgaaacaattagcatctcacctctttactatcaggcatatcaaaggttattacattaacaaaaaaatacatcaagttgacctgacttcatttatgtaagaggtagaaaatctgagtaaagtttttttttcattaattaaatcctattttaatgtaaatcctcttataattcctcgtttcactaaagtaatcttggaatcactaaagttttgtggaagcaccacctatctgggggaaaaactgcctttaaacacctgcaaattgggttgatagtatctggttaagaggtggtatcagtcatgtaagagtaagattgtgaccgtttagtcatatttaataacccacttacataacccttgttatttaattcagatacgatgttcagcttgtatttcttgataataacccccctcctccaaaccaacacagatgtacacacccaatcagcgtgcatgactgctgactggcactctttccagtgactgtttattgagtgtcaggaacacaactgtgattatacaaaatgaagtggacaaacggtcttgcacaaatgacgtacatttcacagttaatcgtgaaggttagaaaggttaacaagttctattagtacttttcataagcagtttgatttctgaaaaatacagtaacataattttagtaactactaaaatttctttaaaactccctatcaatctgaagaacaaactaaaaacctgtttattacatgaatgctacttatgagaatttaaaatatgggttcacttcctattttccacaagtctttgacttgtttatttactaaattaacagaacgtgggatgcagttttttaagttagcaacttccttagggttactgggaagtagagtaattatgaaaaagggaacacttcaattattgtataaaagattgctttgcatactgattacttcttgaaccccaaaaagtgctatttagaggcaagggcccattttgtgcccattaaaagaaatatacaggtgaatgtctgtctcatccctctaatcatatgtaataaaattatatcgctgtcaataacagcaaagataatgatatattaattttaacagcagttagaaccagaaggaaaaggctgttatacagaaaaacatacaaatatgtaggtagaagtgaaaaactgaagaatgtggagtgtttactgtcccgttactcacacagacgtgctggattcaacacccacgctgaatctccatttattccacggaggtggagttcaccatggttcgactgcccaccagatccccaaatgtcaaagtgaaacaaaactcagtgaattctagatgactgttttacttcccctaaagaagttatctgtaaataagaaaaatcaactgatagggggaaaaaaaaaagatctgtcatttgtcaacagatggacgaagacaagctattgactcaaagagaacctgccgcgagtcttagtctttggaaggtcagacagctgcagtgttcggtcacatggagatggtgtcttcatgtctcagaggccgcattctgtaggccagacgtgtgctcaccaacctatacaagggtcagggcagtcccgcaggtaagtttcgaattgacctttggtaacatctatcaaggttgtgtatacggtcagctgaaagaaaagttatttttactttaaggacgttttcaattcagagatgttctgatatatattagcatttctatacttgtagaatttgctttagaagttatttaatattaaataatataacttaatatatgcaaagcatgttatataatgtatatatttatattaatatagtataatcatataaaattagctaaagtctcaccaaataactaaagcaaacaacttcaacaggatcactgtttcaggtaatgaatataaacaggctcaggaaagaatctccagctccttataggagcttattcctgacagcacattgctccacccccaatgctttaagactgccttaaccctccttgacgcacagctggcagtcctgggagacctgccggtgtcctatggagtaaaaaccgtggagctttggctatccctatccttaaagcatttccaatacagtgggggaaactgcaggcacccagatcacaaggcacacacccaaacacaagtcacgagattgtgacttgctcaaagatggtataggcaaaacgcaagtatggcagggcccgtgaactgaaggcaggcttcctgtgagagccagggtgacctggatgctaaaggccggagggatttgtcctggcagggtaaaggcggcatgtttactttagggagagctgtggagaaggaccaagaaaagaaggaacaaatgggaaaattaggggggcatattcagaacgttcagggaatgattgttagcgagtggtgggatgataggaaactttttgcatttttttaaaactacagtgtagggaaaagataaacagatgtagtaaagtttaagggaaacccgaacccaccaagacacagagctctgtctgaaaatggactgcagactttgttttgttgacatttaggtgttagttatatagtgtgagatttttaatagataccaataagagtaaaatgctagccttaattcaaatgctatgtaaataaagctataaacaatattctgacctatcaagcctcagtgatcaatttctttcttgtattccaaaatacagttttagccacacaaaaacattttttaataaaaaatcagtcctaagctgaacacaccttttgtgctcaaactgatcaaagataacagagaaagataaaacatagggccaaattctttccctaaaaggcaaatatacatataacatttaaaataccttgttgaggacaggttttgttgacaggacatcatacatggtttcaaatgagatattctaaaacacaagaaaatagttttgttcagtaagttaaatacagaagccaacagccttatctacacacatgggccaccagaaaccaagacattctttaatcaacctcccctccatccccgcagtggagtttctgtgggagtcactgttagaaacacaggtaacagttttaatggattactttcctctctctccttccccttttttaaattcttgcctgtttgttattcaacttcagagtggtatccagcattagaaccagaaaaggaaagtacagcacaattttgctctttaagttaagaaaacgaaacaaaaaaatcagtggagagtggctagagatactatgaaaaataggacgtttataaattacttgaaggccaaagaaaaatgccagaaccaagggaatctttaatggcaacagtttctttctatagatgaccctgcaaaggtacctcttggctggtgcggttcagacacatctttgcaggcgttctgcgatcatcaaggaagaagggatgtttccaacggtcataatttgtttgtaccacataccatctaccctgcttagcatcgagtctagatacaaaaggagagattccctcttaggctacatgccttaaaactcaaagtatatcagtgtatgcttttgtttctacttcttttgctttaacaaacctacttactcatatacatccaatgattcctttctgtctcgtgtaatcacacaaccttccccagactggttgcctcccaggataaagtaggctggggccaatatcttggtcttggtcaataaattcttggcttcttcataactatatagaaacatttaaaaagaaaaatgaaacttttttttaattttagtaaataacttcatttatttttaaattttactttaagttctgggacacatgtgctgaacgtgcaggtttgttacataggtacacacgtgccatggtggtttgctgcacccatcaacccatcatctaagtttcaagccctacatgcattaggtatttgtcctaatgctctccctcccctttcaccccaccccctgacaggccctggtgcgtgatgttcccctccctgtgttcacgtgttctctttgttcagctctcacttatgagtgagaacatgcagtgttcggttttctgttcctgtgttagtttgctgaggatgatggtgggaaacatttttagatgacttagaacggaaatgtttagctctgtagaaactaaagaaaaacaagtatctaaggaatgtgttatttatttatttctatttttagagatgggctctcactctgttgcccaggctggtctcgaactccttggcacaagcgatactcttgccttcgcctcccaaagtactgggattacaggcatgagccaccatggccagccacaatgtgttttctaaaaaaggatggtgagcaatgcctctgggaaaagcaatccctgaccctgtatggtgaacactgagatgggaagcgggaatcttaggaagcccctctaatctgaaggagaaacaaagtggcctcaagagatcatcttccacccttactgtccatgcctttcactcaacaacagaacaaagggaaataatattacagtatgtaggacttagagaacagaaagtaaaccttcttgaaaattaggactattaaaaattgaagtgggttatcaaagaacactactaacattaaatcttattccctgggaagtattaaaaataggattgatgcccatttatttggacgcagtgctggctgaatgaaggaaaggcagttttgctattgtaagatttctataccaaggcaagatataacttacaggttaatatgtagtacattttgtatttatttattttgtttttttaagacagagtctcactctatcactcagggtgaagtgcagtggactgatcccagctcactgcagtctcgacctccttgggctcaggtgatcctcccacctcagcctcctgagtagctgggactacaggcaggcacgtgtcaccatgcctggctaatttttgtattttttatagagacggggtttcgccatgttgctcagactggtctcaaacccctgggtgcaagtcatctgtctatctcagccacccaaagcgtgaggattacaggcataagccactgtgcctggtctgtactaccatttaaatgaagattttactgtatgactgttcttttgtgtgtgggtcattttttttctgtacaccaaaaatattcataggtgcctttcataatgtcagtatccctagtgctttttaagtaattcatttatttgctataaaacacacagtctgcacgaagaaaacatgagtaattccacatgagtgtcagaggttcacctaagaaattctgcaatagttcctcaaaggattaagctggagcttgacaaatatttttattttttaatatgagtaatttaaaataaatatttaatagtaaagcaacgaaacactttaccttgtgctattttccagaactgttctagtgaggaaccctatccacatgacatctttctttcccagaatccattctagaatacctggaagagatgaacacaatgtcaggaaccggaagaggtgacactatgtaaccagtcaggacccggaagaggctggactatataaccagtcaggaaccagaagaggttagactttgtaaccagtcgggaaccggaagaggttggactttgtaaccagaaggcacagtccagccttcctcataaaaaagctctgagattcccatttcacttgagaatgctctacttacccagataaccaccatttatactgaaacgttcattcagtgtaagactgaacagtccctgagaaaaagacaaagcaacgaagtcagaaacatcaaccatgcgctttaaggccctgtcgctcactgtacttcagagtgggatataaaggcctagcttgggtaatggggaaggcaaaaataaatcaaaaccataaaaggctttttaaaaagttcaaagcatttttgattctagtatgtgagataagtaggtggggtatcactggcaacgctttttggacaggaaactgaagggcagagaatgaacgcctgacttgcctaagtgagcggaagacccaggactagaaatcagattgtgactcccagcccttgacacccagccacatgctctttatcccagaagaggctcagaaacctccgtttcctttctactcttctctaccacgagatctcatacctatgaagtgacaagaagtacaagggggtgaaatggggcttcatattccctttaggtcctcatattcttagatttcaacttttacataacggtaacaggacagaaggctacctgtataattatgtaacaacagactccttactggtttgaatcctgttaacatgcccacatagccagcaaagcttgaagccttgaagacagttttgttgtttctttggaaatccaaattcactgttaaaggttttagttgctcagttatgacccaggtatcattatttatgttccacctataaaagacatgtttcagtgacatttcagaaacacagtgatagtaatgatcaacatgatgatgagggccaggcattacactaggagctttatttaccgagtcaccacgatcaatcctaacaagacctttacaatatggtatatttattctgttttccaaatgataaaattgaggttcagagaagtcaggtaactctctcaatatcacacagcttataaatagtgagcctcagattcaaacatagaatgctaattacaatattcttattttttcagaaaggtcaagatggacacataaaatagaagagcatgtccctcttgtctcagcactcaagcaatccatttatcttcacttatgatcacattttgggtgtgacttgggacttacttatcatcaatataacacaacctactcttcctacagaccaaaacagttctgtgttcttttttttttttttttttttgagatggagtctggctctgtatcccaagctgcagtgcagtggcgcgatctcggctcactgcaacctccgcctcgcaggttcaaaaaagtctctgcctcaggctcccaagtagccgggattacagatgcccaccaccatgcctggctaatttttatgtttttagtagagacggggtttcaccatcttggccaggctggtcttgaactcctgacctcgtgatccacccgtgtcagcctcccaaaaagctgggattacaggcgtgaaccaccatgcctgaccctttgttctttacttacccaagaaatactccaaaatccatgtttctcccatgtattagatgacctatttgaaggtagacagaagagacgtgtaatagcagttaagattctaaatcaaagctggacaattaattttgattaattaatttatttttgagacagagtctcgttctgttggccagactggagtgcagtggtgcgatctcagctcactgcgacctctgcctcccaggttcaagcaattcttgtgcctcagccttccacgtagttgggattacagacatgtgcgaccgcacctggctactttttttttttttttgtatttttcttttagtagagaaggggttttaccatgttggccagtctggtgtcaaactcccaacctcagatgattcgcccgcctcggcctcgcaaagtgctggcattacaggtgtaagccactgtgcctggcctctaattttgattaatttttattcacaactgtttcttcaaacaataagaagtaagaaacatcctaatatcctaagccttcaccagatgggactgttgtcaccgtctatctgccagataaccccacaaaatctgagagcacgggtttccaggtaagatcagaatatgggaaaaggaatcaatggtcatgttttggttcactatcacatggttctaccaggacacagaaatcggagcctcaattactgtgattcatcaaatgtttcccttcaggcatcatcccctagagcaggacatctcaagggtaaggtacaggcagatttatacccagagtataggtcaaagatcagggtgagttagcgaagttgtcctgtgctttgtactctgggaaccagtcaggaaaaatatgggaaagtgaggctggtatccattgggttgcctggctgggaaaggatgggagaatgtgtgttctgggcctcaagaaaaggacagatgtcatgacatacacgaagataaggaagcacctcctgcgagcacttccatcaaagcatgtagatgggtagaagtaaactatgaggaagagaagaatgtttctagccctgcaacatttcttccaggttttttgcatgtctgaaatcaactttaataggcagtacagtagtctgaaaataaggaaaattttcagtacaatcacaaaattttaccaagaaataaaaagctgtatgcaacatacacagaatttacatagcaagcccaaatttcagaagttctaatttcatttagaagatttttctttatgtagtgcttcatgctgcccaccctccctcagcgcacaattaccttttttgtcttctgctactattgaagtacaaatggtaaataattcataaaaaatattgaatgaaataatctctcctatgagaaaagaaaattttgtgttaatatacagaaccatgacaatgggagaaaaatttgttttaagaaaaagtttcagtgttttcattgtgtgagtgtgtgctttggccagtggggctgtgctggaacggccggctggaggtggttttcttccccagcctggactctctagactcaagatgaaacaagtcaccaaggaggcagccttcgggcgagctgaacatctgggcaggttgcaattgttctccaacatcacatccaaaatgtttatcaacatgcttcattttgaattttcttttgggagcgtaaatatgatcatttaatacatctggctcttggctgtttgctggacatatattttgcccagatttttaaagtgtgactaaaatttctaaggtgaaaaaggagattcaagaactattaaaattagtacagagctgccaagaaactccattctagggtattttattttttgaatattttcccaaaatgtataatactgctatttagcatttaattcaaaagtaggcagcacattgtatttctgtcccatttaacattaacatgttaagctcaacatgtttttttcacccaaatccaatgtgtattttatttccattaaatttctaatttggtgaaattctagttattttattatacatttataataatttataataattatataaatttacaccacttatacatcatgttattcttcttaatccataaggtatttctatttggtattgagttgctagagttctttacataataaaggaattagacttgctttccataaaggcagcaagtacatatttccagtatgctatcttttaaatgagttttttaaagaagcagcacacaaaactagccacttttgttgataaatactactgattttcacaaattctcaatcatctcataaaatgaaggtactgttggctatttaaaataatgacactactgctttgctagcttaaagataaaacttttggggtcgtggggaaaatatttttcgttacatgccataaagcttaaattgaaattttaaaaatagcttcccaaaccatcaatatctaagaataattttaacgaatggcatgtgaggtcttctccctgaaaataaaagatactgctcagagaaatcagtaacttaaataaatattgagaaaaacaaagttggaagaattataccacctaatttgaagacttactataaagctttagtaactgaggtgaaatagtattgatataagggaagacaaaaagacaaatatgtaaatgaaacttaattccccaaacaaaacaacatatatacaatcacctgattgtatatacagatacacattgtgtgtgtgtgtgtgtgtgtgtgtgtgtatatatatatgtattgtatatttatatcaaagacaccactgcaatttgctgaggaaaggatagccttttgaattgatgctgtttaactaactggatataccacatgagaaaaacctgaagcttgacccataagtcatagcatatacaaaaataattcaaaatagatgataggcctaaatgtaaaaagtaaacattaaacatctagaagaaaatatataagcatatatatatgactttggggtaggccaagattccttaaatggatacaaaaggcactactcataaaagagaagactgagatattagacttcactaaaattaaaaatttctgttcatcaaaagacaaaagtaagagaataaaaatgaaggtcatagactgggagcagatattcagaatccatatatctgacaaagggcttatattcaaagtatgtaaaaaattccttcaatctaatttttaaaagggcaaaagaccttcacaagcccttctccaaaagaaacaaagaaaaccaaaaaaaaaaaaaaaaagtcaataaactgttcaatctcattaatcatcaaggaaatgcaaattgaaactaaaatgcgatactgcgacactcaacaaaaaggctcaaataaagattgacactaacaaaaaaaaaggaaaaaaaaagactgacactatcgagaggagaattatcaagaggagaaaactgaaactctcatactctgctgattgtcaactgctggaatcactttggaaaactgtttggcagaatctataaggctaaacacacaattactctataacacaacagttcacttcctaggtatatatccagaaaatgagtacccagacacccccaaaatgtactacaatatttataattcctttattgttaatatcacaaatctgaaaaccacccaaataccctgttgatacaatagcacaccacccataatgaaatacaagaaatcacacaggacagttcatattgttcagttctatttatacaaagttcacgaagaggcaaaactaatctatagtgacatcagaatagtgtttactggaggaggcagtattttctgcaaaggggcatgatggagcatcgtggagtgctgggctcttccgtatcttgatctgagtcatggctacatgcatgcatgcatttctgaagcttcactgagctgtatatctaagacctgtgcacctgtgctgtatatctaagacatacagcacctgtgctgtatgtatatcacacctcaatggaaacttgtaaaagaatttaattacttttttttttaaagcttctaagtgaactttacctaaaggtatatcagtaacagcggcaatacccttcatttcctcttcaaaagggccaggaaagttgccaagtaggccaggctggaaaacaaatatattaataaaagcatttaacataataacaataaaaaatatataatataatataaacaaatataataaaagcatgctttgaaatctagttcttggacatataattttttctagatactgctatcataataagtgataggaattattttttaaagcatttttacatcatgtagttataaaaagattctatgtaatactgaatattgggcccctatacagagaccagattctcagattgtttttcctgccttatttttccatcattctccagagaaggcaggaacgagagtaattccacttggatgacctaacctgacccacaccacaaaaacatcataacaagcactccttatctctctgcacgaattcaccctctagccactggcatataccgttcttaccatttccttcccacactcacagagataaacctgcactattctatccatagccctgtgtcatggttaatggctgatcttcagctaagatgaagtaactgcattcttttagcaaaccagagacattgagcaaattcagtggtggacatcatatatttattctcaatggcaactactaacatccagatcacaacttaagttcacggccttttgctgagataatctgcttaaaattcacgaatctcacttttttaaccaacttggtaattacatgtaatgtcacctaaacatattttttttctccctaggaactcaaagcattccccaagtggaatgttccagccatttaacaaacaaatgtgacgtaatgggtatttattaaacacttattacatccaagcactatgctttatacacagtatgtcatttaacccttacaaccaccatatgaaatatatattagtaattattattctccctgatgagaaaactgaggtttcataggttaagaaactttccctaggacacaaggctagtatgtgactgatccagccttaaaacccagtattgtccgattccaaggcgtggcacaaaaactctctgcaatgttgccctccctgataacattcagagtagaggggagattaaggcatacggggaacgtgggggcctcatcctcttttgctcctgccagcatttttttgttttgaggaagtccggtaagtatgaacataaaggatagcctgaaacaaaagctccgagagcatgcacgtgagggataatgggtttggtgcttggcaggtacaagtgtcatagggaggatgtggccacagcactcagccgctagggcaatgattctcgaccacgggagatttggtaacatctaaggacatttttggttgtcacaactgagggggtgttaccagcatccagtgggtaagggccagggacactgctaaacatcctgcaatgcacatgacagccccacaaaaaagagacacccaccccaggccgggcatcctgagctgctaaacatcctgcaatgcacatgacagccccacaaaaaagagacacccaccccaggccgggcatcctggaatgtagacaagcccacgacaaagaaatatccaacccaggccgggcatggcggttcacacctacgatcccaacactttgggagaacactttgggaggttgaggcgggaagatcgcctgagcccaggagttgggagaccagcctgggtgacacagcaagcctccgtctctactaaaaattcagaaaagtagctgggtgtggcggcacgtgactgtagtcccagctactcaggaggctgaggcagaaggatcccttgagcctgggagatcaaggcagctgtgagctatgatcatgccagtgcactccagcctgggctacagagtgagatgaggtctcaaaaaaaaaaaaaaaaaaaaagctgcccaaccccaaatgtcattaatgcccaaaatctgccatcaagagcaatgaggatccctttaacagttctaggggccaggccctaggtgtttcattggttctgcgtcaacaaaaacggggctgagaaatggagtcttcctgcatgatgaggatgaaaatgaaatggtttggtgattgcacagaaacactcagcccaaatgagtttcagggtcagagctactgaggaactctacagaataaggggccaggctgagtatgtcatttgctcatatctacaaaaaaaaaatctctggatgtccctgagacacttaagaaaaaaaaccaagtcttcaatagtgaactcactacataaagggaaggaaataccacactcccagatgaaatatggttatttgcccaatgtcgtaatgtagtcccatccccttttacgaaaccataatttgctatgctgtaaccctaatattaccaattccccaaatttaagtccctctgaagttctgacagtgagctagattcatgcagatttgcccaagtccctgcgaagaggttgctgaattatgcctttaaataaataacagcgcattttctatgtgcttaacatttattgtgagaaataatatctcttaccaatttttcatccaccacctgcataatttttccacttggcacgaatgtatttatcatattcttcagagaattcactataacctttagctgaaaaataaataaaatgcttactaaaagacataatgaaatgctgtcaagattaccttttggcttacccatatgtagctaaaagagagtgctatttgacaatttatatatatattttttaaaacagcatctcgctctgtcacccaggctggagtgcagtagcaccatctcggctcactgcaatctctgcctcccaggttcaagcgattctcctgcctcagcctcccaagtagctgagattacaagtgtgcatcaccattcccagctaatttttgtatttttttttttaagacggagttttgctcttgtcgcccaggccggagtgcaatggcacgatctctgctcaccgcaacctctgcctcccgggttcaagcgattctcttgcctcagcctcccaagtagctgggactacaggcatgcaccaccatgcctggctaatttttgtatttttagtagagacggggtttcaccatcttggccaggctggtctcgaactcctgacctcgtgatccacccgcctcggcctcccaaagtgctgggattacaggcatgagccaccgcgcctggcctaatttttgtatttttaatagagacagggtttcaccatgttggccaggctggtcttgaacttctgatctcaggtgatccgcctgcctcagcctcccaaagtactgggattgattacaggcatgagccaccgtgcctggcctcgattaatacattaatacagtaagtctaattttatctttaaagtgaatttgattcttaattatttacatgaagggagatgacataaagggaaagaaacaaaggtaaagtttacaaaaaagaacaaaggctacagaggaatgacctcttttcctctgctgtcacttaacgtatagggcagaaaggtatcaaaagcacaattttaaactattctgtgggtaatttcatgaagtgttcttttaaaaatacaataatatttaataaagttagaaataaaagatttaatatagaatctccacggtccttggggggaaaataaataaataaaataagaaatatggccgggcatggcggctcatgcctataatcccagcactttgggaggctgaggtgggaggatcactcgaggtcaggagtttgagatcagcttggacaacatggcaaaatcttgtctctactaaaaatacaaaaattagccggcatggtggcaggtgcctgtaattccagctactcgggaagctgaggcagggaaattgctagaacccaggaggcggaggttgcggcgagctgagatcgtgccactgcattccagcctgggtgacagagtgagactctgtctcaaaacaaaaaaaaaatcaatcaataaataaaaataaagaaataaaataaaaaataaaaataaagaaataaaagatttaagcatcatagcataccactggtgccttgtcaagcatcaattcatgccatcttttgtagggtggtaagtcaagatttatggtgtaccatggaactgcacctctgtacctgtaatgagaggtgtatcatcttgaaatgatgaaagggttttttgtgagggtcagttagatacatctataagaatatatgagaggcaaagtcttaacagcagtgtagaatttggttacccaaaccaaaatttggaaagaaagttcattctctacctagtgcttctaggttgagaacacaatcataagcggtcacagaaatcctggaatagaatgatctagtagggaaggttcatgtgaattggttttctatgaaaaaatcaactatggcttaagagctctaacctgattatcactgacgggaaatacctgccattttttttttctcctaaatatctgcaaagatttagtctgggctctagacaattctccaattggtttccagtttcagaattctctctcagagagtgtaacactattgccaaaccaatgtctccagtgttgccttcaggaagatcaccttttaagccccagatggcaacatgtattatcttcccacgatcagcttcaagaaccttcatgattctgtcagccatcctaatcttccctactatatacctcttctcttctcattttcctggacaaagtccaagcccaagctgtattctgtcatatcctccaacttcctactctttaacttacgtgcagcaatttctgaggatatagcaacatccagtcacttatcagtgaagctgggccatatttctggtggatgaattctacaactatttttgttgctataggaacattattttctggccctggttactaaactgaaatagcttttaagggtgtgccagttagtggtttatcagtataaacctatgcctaaaaataaccatcatctgttccactgatctgctcctgagactggcagggtgactctggtatgtgccacaatgataccagtctcctaaatagaaatgttatctagacttatgtccatagctggggatgggttattacctaagtcatgaactgtggttctatttatatttccactatcataaataattacttggttctctaaataatgctgtgtaacttggggccctggtatatgtatgaggttttatgaaactgttaactagcagacattcaggttgtgatttagacagaaaagtatattcgattttggaaatgtacatttaaacaaaatcatagtgaacgaattttgttcttctcaaagcattttcaagttccccattttcttaggagctgatatctacatgaaatgctacaatacttatattctagaaaaaaacttttcatcacaacaaattaattccatttctgacagaccataatttcacatgtaaaattttgtcccacaattcagtaagtaattattgttccccatattatgggcaggtattactagtctcccctctcccttcaactgtgcatttagatttctatgtctagtagcaaagataactcagtggcctgttggagatatgcatctcatccctatgaactccaatcagctgctcctcacctcataacatccaaccaatcccaaatcatgcctctatacccgccataaattcctgattctttttcagcctagagtcctgggtaggttcatggatctcagagacgcgatgagaggggatgaacacaacacaacggacaatgaagggattacaatgaagtggggatgatgagaccccacaaacctctctaccatcaaacctgcactaattagaatttgagagaactggttaatctaataaaccaaattattttaatgactaaagcttagccataattgcacattttacctctcgttaaacagttttctaaaacatttcagtatttaacttgtgcgcctccatttccccataagaataaaagagtatccaccttataacagcagggaagacactatatgaaaaatgcaaaaataaaaaaaacacttagcagcattggtattcaatcaacagtagtcatcacaatttattttcctacttcactgcaaacaagaaatatcatttcatcatttttgagacttagtgtttgcaatgtccatgccattcataatatcagcaacatcacctgaacccacatggctacctaggtggcatggaaactagtccaagtgacacaacacacacatatacaaataagagagcaagtgctaggcatcccgtgagcagtgggaaagaaatgctgaatgggactcagatggactcaggggtgatctggctatcagttcctttatcttcagcattgatttgactagtcatgctggccaaacaggttatctttttcttccctcatatctgcccatggatgctgcccaaatctacgcacttaattgaaaaggatgatctcaaaggaacagaacgtctgtttgtcattcaaaggtacataaataccacagttatctcctaaatctcaagatccattgatagagttgagagaagagaaggataagagcaaagccgaggctttttgtgtaggaaagcaggctagtgagataaaaagaaagctagcgaaaaaatgaaggcaaggaaagaaacatacaagttatgtccatgtatacacgtgtatgtgttttggagtacatatgtatgtatacatgtaggtatgtatgcacataggtagacacacactcacatgcacatggcaataagagtcagtaaaatgcctaatcaggaaaggtttatggtttgcagggcattcaatttatagacacatgtaaagtgcacctaaaagggagtagaaacggcctcaaacatggaaggcacctcattaaatgttcaatgaattggggcagtgagaccaacagagagacataatcaatcagtaaggcagacatgtcactgaaggccagaatgatgccagtgatgacagaaaggaagactttcagacagcaggccattgaagaaagagctggaatgaacactggccccaaacaacatccaaactggttacctctaaattgcttcctgccaaatactggcctctttctacataaaggcgagtaagtcaaaagaacttagtttattacagtttcacgctatctgggacagaggctatttaaaatacatcgtttagacaacaacagtacaacgtaagtaatttggaatgttgcacgaactgaaaatgtcatcttgatatcactagatagagttgtactgtttccccctacaaacagcaggctactttcagcgaaagggcagtgtaggagaaaaagatcaccaccccctatacctgttccttcttttctctgttctgtacactctgaggggtctgtgagctgttattatggctttctcacaggcccatttaaacactgaggatttggaaagaccaaaatctagactaaaaatattaatgttaaacacactgaatcatgacattggtcctcctcttaggtgttccaatcctgttttgtcctcgacagctttgttgtgccaaggtttattttgagaacgtttcacatatgagggcctatgcttttttgttacaatataatttggtggtttatatccaggcaccatagagaatcacaggtcatttcaaatacagcccttacatttgtcaaagatgagaaaaacccttcatggtagacaggagaattgagtggagaatgaaaatcctttcctttttttttttgagacagagtctcactctgtcgcccagactggagtgcagtggtgcgatctcggctcactgcaagctccgcctcccgggttcacgccattctcctgcctcagcctccagagtagctgggactacaggcgcccgccaccacgcctggctaattttttgtatttttagtagagacggggtttcactgttagccagcatggtctcgatctcctgaccttatgatttacccgcctcggcctcccaaagtgctgggattacaggcgtgagccaccgcgtctggctgaaaatccttttctttccgatgattttgatagtctagcgacgggcatttgaatcggaagatattttcatatttgtccaagatctcagccaaatgcataataaacaaatctgagaaacaaacctctgtctcggaatgggaaacatgacttaagattttattcactatcgttcgtttatgagcaattattacatacagaaaaaacttcacaaaggtcaaagggagttttgatcatctgatgtttactcacgttggtcctgaaggaggataggttgattttctgcagtcctctgtccactgaaaagcaaagaaaattaagtttcagaaaataacaaatgcttgccaacggaataagcaatttcaaaagtagttaatctgtgaagacaacatcaagtctgatattgctcttttatacgtttcaatgcctcttaaaataagtcttttctttccaagaaaacttctaaaatcctaaaccattaagtggattttcagtttcaattcaatttgtaaaagtgctaggtgttataatttggctctaatatttcaaatatattgagtaacgaacaaatgtaacaaagtagatggaaaatatttatgttagagaggctgacttagcactaaaagtaaatgacctgataggatgtattatctgcacttaccagccatgtgtgttgcaacctgtcctgggatttgcctcccaaaccagattttcagggcacacagcacagggcccttcatcatctttccatggtaacttaccatcccagcctcatctcctgacactccccttagtatttatagccatacgcaggcacttcctatcatctctcacccttccatgcctgtgtctgtgctattccctcttgctagaatgccttttccccacctggtgaactgctggttctaacttccaagattcagttcaagcattttctttcttgtgaagtcttcatctatcttccatatgaaaatattcataccctcctttcctcccacagcatttgtgcacactctcatcaacatgtttatgacactgctttataatcatctgtttgcgttccttgtcaataccagactctgcgctccttgaggtgaggacggcccccaacactgacgtcactgcctgagacaaggaatgaacagactcttttaggggaagttgtccaagcttagtggcaaaatggaaccttctcctaaacttatcaaaaaaagtccacacagatttatgattcttttgttactcattcaacatatcaagtgtctttatctcctttcctctggagaaccagttctgtgaaagtaaaataattgttttaaaaaagtacaaatccaaaataagataaagtagagtaggtaagaaaactcttggaactgtagcttgagctcagaaaactcttggaactgtagcttgagctcagaaaactcctggaactgtagcttgagctcagaaaactcctggaactgtagcttgagcacagaaaatgtatctgctggacagctgtgtaagaatggaggtctagcaccttgttttaacttttgataacatggggaatatataaagtaggttgacattacctgtgattcaaacattagctgtcaaatttgccttaccacactgtaagtttctcacatatgtctggctttgtctggtaattttgcgttgaattcattaagaaacaatatcaagtctgtagcaaaagctaatttccaaagccattcgtgttcagtaatagtggctgggggcagctcgtttagaaaaacttcagtctcaactgtgaactcaaagactgcaaaactttacagctagcaagctatctaatggctctgtcacaagagacatcaggatatccggcctctatttctgataattcacagaaatgatgacggttatatccacaagagcaaatgaagctcatggtttatattgccggttcaataacacatgtgagattccaatattttccacaaaatatctgaaaaggaatactataataaataaccatgagctttaaacacctcgcatgttcacaagttttgtgaatttgctcaactccgcctttttctactcacaaatatttttactactgtcaatttttatagatcttagcagattccattccaggttatactcaatcattattttctcagcttcttcgaaaacatcctcgcctgtagttgttttatacagatgattcagaggctaactcttcagtcacttcaaacttggcaatgatcatctaataaatatcaacaactgatcagttatcggtatgttgacagtcaagaaaaatcactcaaaaatcacatgctttgttctttaattgatattgatgttcttcccaaagtccaggacaagggttctcaatgacatgtaaaataatttcattttccctggacacaatacttctgctactacaatcgaatacaatttaggtaatccaccattggtaaatggctttccttattttgctaataaatgagctacttagagacttataggggttgcaacttaattttactttgtaaaatttgtaaataagttctgctgtgaggagatactccgctttacattttcttgtttatctgaccattgttttcctatgagttgggaatactgtgatgggtacttaacccaagtgcttaattttatgatcatgttgtggacttaagaccctgctccattagtgacttgtagaaagttacacagctggtgacagaatcagagtcaatggctttccctgttctatcaaacagcttcccacagagataataaaaccaatgcctcaatttaattcctaacagaataatctgcgcgtagttcagggcttctggtgatcactagaatcaactcggcaaattaagtgaaacgtaatgactcctatcccttcctaataatgacatttgcacgccctgggttccaaagccaaaataaacatcaaattacaggcacatttcttactagacaactgtgagcaaagttgaaaatgctctgtctagtattaggagagaatgtgacctgccccagaggtaagaactaaagagcaagctagcaacaatacatgtggagtgagtctgaggttgataacgactcttggtagcaataaacaaacgtgaaattggcatagaacctggctgcaaggaaataggataagtgtgacagaaaataagaaagttggcagctatgagactacagtatttcaggggctcacatggcatgaacgcctaagtcgtttatgcaaaaaggttagttttaggggtagggtggaaaaaagagctacttcctccccctcaaaaaagaattctacagggagacacagcttcaaaacccacgagtagccctaaaacagaattataatgaacttacttaatgttatttaaagttccttactatccccaagtttataaacagtttaataacagacaactctattaaggcaggtaaaaacttaaatagatgataggtaaagattagaaacagatgataagaagagagattatgtggtctggatggtatactatgtacaccctatcacaggaaacaaaatccaacttagaatcaattctctctaaccctctccccacagtacctctctttctctctctctccctgcccttccctacctttctccctgcccctcagtggtctcctaagagtgaagataagtggtaaaaatctgatatttcaatgcatttgaaactctctgggccaggcatggtggctcatgcctgtaattccagcaccttgggaggctgaggtgggtggatcacctgaggtcaggacttcaagaccagcctggccaacatggcgaaatccccgttactactaacaatgcaaaaattagctgggtggcatgtgcctgtaatcctaggtactcggaaggctgaggtaggagaattgcctgaagccgggaggtggaagttgcagtgagacgagatagtgtgactgcactccagcctgggagacagagcaagactccatctcagaaaaaaaaaaaaaacaaaaaactctctggaaagtgcttttaaaagactgtttgggtcagaaaattctctaatttttctggttatttgatagaaacttaagcctctttgaatgtcctccccattcattaagagaaattaattacagagctactgaacacaacattctaaaaaaaacacaaaaatataaagagaacattaaggtctcaatgaaagcgccatacccttaaaaaatggcataacttgtacagctccttaaaatatttgagcccgaaagaattaggagaccctcaatgaaataatgtatgcttctaatagtgaattttaaaagtccagaaagcccttgtgtgcttgtcttattgaaatactcagaaagagacaatgaaggataatctaaaattacatacctcatgtcagttttcatacccaccagaagccaaacaactctagccagacaatttttcattcattcaattcttgaattcatcaacaactattttgcagacaagtttttcctataatgtcctcttatgtacaactcagcagaaacactgaatacaaagaggcatgtttcctacgtgtacaagaattcacatgagcttgaaaatgttttcacttgtcttctgggctttgatgggatggcatcctattaagctactgatatttaggtcaaaggaatgtgaataaaccctccatgagaggaaggacctcatctatctcattggctgacgcattcccagcgtttaggagtctggcacatagtaggcaagcagtatttgttgaataagtgaatggattacacctgtgtgttccctctttgggagaagtagggaaaagcagatgaagtgcaataaattcctaggccagatggggtctatgagatttctggcaactgcgtgaaaatcattgctaaagctgattcaatagctaatgtcaacaatgttgacatacgctgttaactagtatgagaagctgatgcataaaaatgagtttacaagtttactttggcaattaattactaagccattacgtttcatcttcgcacatcttatgaagtgggtcagatttattacgcagagcagccatctctcccctctagttcctttcctgccaatcacacttagcctaccgcaagctgttttctgcccccaacactgctccagtcgaggtgaccaatgacctccagttgcccaacatcataataccactgacatctcaataatattcaacatagttaacctgtcccagtctcttccctgagcttcctgttccacttactctcctatttttttgtttttgttttctgtgacgaagtttcgctcattgtccaggctggagtgcaatggcaggatcttggctcactgcaacctctccctcccaggttcaagcaattctcccgcctcagcctcctgagtagctgggactacaggcgtgagccactatgcccagctaatttttgtatttttagtagagacagggtttctccatgttggccaggctagtctcaaactcctgacctcacgtgatctgcccaccttggcctcccaaagtgctgggattacaggcatgagccaccgcgcccggcctgtcctgttttaactttggcaatttctcctcttcttgacacatacatgtgcaagttacttagcctttgcctagttctcttttcttctctttctctatcctatttctaggtaagttcatctgctccaagggcttcaaatataatatcattatgccagtgactctcagtgtctctcttctgagtgccagtccgagtggcctgctggatgcctctctgccacctgaaatttaacatacaccccaaatgaaaacgatcctcattctttagcccccaagctttcccctccccatgtttcctggaacggatgccaccattcgcccagcgaagcacttcagcaatgtgcaggtcacgctgacacctcactccctcatcctcacccaacgattccttcagctcattcgccctcctgatttttttctagaacatctacttctctccctcacccctggcgccaccatccttcaacgcaccctgttttcttttctggactagtctcctcatatctacccttgctgacctccaatccagactcatctttttaaagtgaaaatgttatcttgtctaaaaccatctaatggcctcccattggctggttccagatcctcccattttttaggataaatttctgaatccttaataagagtctacagaaccctggatgatgtcatctggcgctatctctccagacatttcttgtgccactgtcttcaccatcatctcttaatagactcctaaaaaattcaataatgaagaataactcaggaggaccttcacataggaatattgtgaaaagcctcaaaaacaaacacacaaaaaatccttacagatgttctaaatcaaatgacttgtttccaatttaaagctgcttctcattattcatatttattgaaagtacttttgaaatatcttttgttaccatgaggctatagtttatcatataatgactccagttgaaaaactgcttattcttctcagagaatgaagtcactaaacttctgtaaggttctaaaggtccttcagtgcatggatcccaggattttccaggccagtaaaaaaaaattaatgaggccttggcacaggagggtccaaatttttattctgccaaatggagatgttaaaacaaaacaaattccatgcacataacatctacctctgccgttatttttaagaacacgtttgcaacaatgaaaacttgaagtccatacaatcagagtaaagattaacattctaaattaataattttagttttgcattcttatttttccagtttcattgaaaacctgtgaaaacagcttcccaaagtgacaccagtggccagactagactttgataatcgctgttctagataagaactattatatccattgagaggttgttaattcttcttctgaaaatagctatcaaaatacttttgctagaataaataaagctattgagaaagaagaaaaaacagcctccaacacctgaaactgctctgagtcccacagctatctctcaatattattacaagccgatctgacactcacagccaggtaagctctgttttcctcctggacatcaacaatcccacagatacctacgtcggataagattattctgagacatgacacaccaagacaaagcaatgccacttgaagattttctctaagaacagacaaaaacaagggcacctgcaacgcacaaaacaccaaacatccccttctcgtgctaaacagaatggctgttccttctttactcagtcagaattgccccaccttctaacagcattctatctacagcaaagcccggttcctcagtcttaccccaaatcatgcaaccgaagttcaaattctgtaatgggtttttttctataacctaccgtccgtcgctcatggtgtgtggtctcctttgcctcaaagaacactaaacccaatttgttcagcttatggtgtgttcctggtggtctttcaatgaagggccctgacagtatcaaagtatcaaagtctctcccaattcccataaaaccaactaccgtcaagcaaattaattccctacccacaatggagcaattttattttaaggcctttaatcgtgtccacatacatgttctgtgtattttcctattacaggaaaaactgtatatactattctggattctacttttatctgctgaacattatatcaattttaatggctaaatcatatcccaccatgattttaaagaatttctccttacaggtataaaagaagacaatgcacatcttgcttccactttcaataacctacctaaactattcaagaccatcaccatctagcctcaggccagatgcgccaggttcctacttatccgattctgttggcaaagacaaacgcagtctgattgctttataaagaaatgaattatgaaagagtactgggcgtcaagaggctcggacgttacgcatgttcagtaaacaacagtgtaacctctggctaaatattttctcactctaggtctacttcctcttctgtaaaatgaaagagtcacgctcgtccctcactgtctcttgcagttaggaagtccgtagccctgtgacttgctcgtgggaaagagccacgggacaggcgatcccatgacttgggtgcaaaaggccacagggggccctttggggcctgctctgggctgctcgcaccgcccaagcttgggaccactcagcgtttcccacggccctgcagtatcctgggctgaactcctgaacttcttcgggagaaagcacctgaccatcaggcagtctgtccttgattgagtaatgcacacaggtccaccggaacattttatttaaacacttcaaaatgcaagggcctggaactggttattcaagtacactcactcaaatctaagaatgtgcgaatcacacccaggtatcctgcagagactaggatttcctttaaaggagttctagttgcaggtagcaccgaatctaccgaggacggggttcgccagcccgctctgcacccacacccctgtgcacgaaaccacagacccccgtaaagaagctgcccagcacgaggtgttccttgtacccgctcgcgccgccacacctgcgcctccatccgcgcccgcacctgcacgcccctctctgcgcctcggctcaagctcactcaccggcggcgcgtgctgcgcgacggcacagctgacggcggcagccaggaggactaaggcgacgcaactccggcccggcatcgctctagcagccaacgccactccccggactccagcagaggcaaagaagagccggctgggccgggggcaggccacgccccctccgccgcgtgacccgcgacctgggaccgcaccattccaggcagtagggggaacgctcggaggaggcgggactgggaggagaggacggggcttttcagtgccacgaaaagggtggcgtagagaaagagagagagccttccaggctacctgcagaaggagagtcgcgatcgcctttggcgcgtggcgtgatccatccccctcccccaccgcgggcaatagtcggaccgagccggagccccgccccgtaggtggggccgggagcttcacccgtggcgcctcgatggggcgcctctagcaggcgggtgcagcctgtcccgcgtacccaggcgtcctcggtacccacgaaacggatccaaagagtctcaacactaatgtaacatcccaccctgacccatctttgccctctgagaaaagcggcccgaaatgagttgagttattcatccccaccgcggagtcagggacaaggagcagttgagtggccgaggagtgagagagaatcgaatccactcgggtcctccaagctgttggttacccacttgggctttcacagcaaagctgccaaatcccagaattgaggcctcggtgaaaagcgcgctgagacttgggtaggaggcccggtgggacccgcgagctttctctcccagcccgatgcagcagttcattaagcggctgtgtttcctcctaactggcgaaggactcaggtgggcggagcagagctcagcttgggaggaggcggacgcgagtagctcggcagggggactcgcttggctttcgtgccatccgtggacacagtcgcgcgggtaggtgaccgggttggatttcaaagtccagcaggaaatcctgccctctgggttgcacttcctggatgagcctctgacgtctcaagcagcattgttttaatgctttgatgaagctcagcacgctgccgaaatctcggcagtattttttcttttctttttgcatgtgagagaaaggacaacaaattgcagttttatccatttgtattatttctttagaaaactcaacactctttttgttggaggtggggaaatgagaaggtgatgttttgttttgctttttttcctattttttttttttaaaggaggagaagatgacagtgttctccctaaggatgaagtttgacttttgaaacatatcacatgcttaaagcacatttgagctcctgcatgaacagtaagctagcagatggtagaaatattctttattaattcaaaaaatatttactgcggacctacaatgtgccaagcatgtctcctgacactggggataagcagtgaacaacaacaaaaagacaaacttcttccaccctgaggcgtatgttctcggtgagaaatgggcaataaacataatacctaagaaaattatacgggatgttagtgacaaatgcagtggaggaaaagggaggccaggggcatcaagtgtggagatcagaagtggtagagttacaattttaaataagagggacagatagacatgattaaggaggtgaagtttgagcagacagttgagggagaccaggaagctagttttgtgtgtgcccaagtaagagtattctaggcagagacagcagctgttaaaaggctttaaatggagaatgtgcctggcatgttcaattacagcagacgtgtgtgggtctggcacagaaagaacaaggggaaaagaagaaagaagtattaatagacaaagtatttagttaaggagagcagggcaaattctgtaaggcattcagagccatttcactccggaaaaaaaatgtgtaatattgaatatacgtgttaaatgttgaatctatggaattaccttggagcttaaaatgagtgtgcgaagaagaggattcccatcttttagttgttattactaaatcaaatagctacttgattggaagatcattcatcttcagtactcttgagagcgatttaaacatgtcaccaagcatatttttttccctactggaggatgttaattggtgattaggtagtctagcaaaatcagattctttatggaaaaaatttgtcaattgacatactattcttaggcaccactttcgcagaactatgcgtctaactttcaaaggtctattatatattattaatactcttttcagataaaatataaatctagttccctaaaattaaaccatttcatgcatgtcttttttttcttacacatatatctttattttgcctacaccattctttaatactagaaatgtacagaaagtcaaggcaaggtgtgtgtaggagactttgcagtggtttttggcatactgatctgttcatagaaaatggtatttaaatgtgcaaatgcatgattatgtccacggaaagggtggttcatactgcacaaaagcatcaagtttaagacttggataacctgtttcgtgtgcaagagtcgggatatgtaatcagattgtttatggaatagctgaagttcttggcaagctgtggacttcctcatctcctacctaacattcctaggttcctgaggtggagccttgatttaaaagggttgcaacttagccaccccaccctaaatgaaacctatcatgtataacatcacattacctggaacaggtttgacttgatttagtaaaaccgaatatacaaaaacgtgtactaaaaggtcaagagatagagaaataatgtttcagtttgagaaataaacatttttttaactttaaatattgacttttttatgaataaggaagctttttattttacaggtctttgtgggaagaaacaaatcacaaaagcaattaagagagctcaaacaatgggtaagaaagagcacctcaacaactgtattgagctagctgaaattttgctcattatgctttgtcaagaactttaattatctctttacagggtttatgccagttacatacaaggatcctgcatatttcagggaccctaaagtttataacatcagatatccggaataaattccatcacattaccaccagtaaacttattttatagtaagtggttgtatgacgccaatactgactcaaaccaacctttggatagaaaagtgtttcaggagtgaggtaaagaatgacacttccccttcataccaatcagtgttcattaagcagatcgcttatttaaaatgttaacactcatcacattttacatatgttgaatgaaagtggttctgggtgatagtcatttatatctggtccacaaatagctcatacaatgtagtacaccattcaactgaatggagttaaaactgctcagaatggttttctaactagcaaatgtaagtatgcctggttaagagatcttccctttgtaggaatgttacactgggatgcatagtgatgctgtcacagcaggacaaaacattcctagacaactctatcctcaaaccagtagtgtcttttacataaaaagatgatttacacctaatagacagtgaatgtgatagacatgtatgtatatatgtatcagttctgagttccaccagcctatcccaaacacactggattaccaggcttgtactgtactcaaaattaaggatttgctaaatttcgtgcaaaggactctaaactaggggagagattattgtttgtgttgcgttatagttgtgtaataattaaggctgccagatttagcaagtacaaatgtaggacaaatttaaattttagatcatgttttgcaaaggtactgcgtgagatccagcattttatctggcaacactagctgtaatgtacttctaaaaaattatcacctaaggataattttaatgactcagataaatttcatataaatttctttccacattgtgaaaataaggctattctagcttttctaatactttttttttttttttaatagagatgggtctcactgtgttgcccaggctggtctctaactcctggcctcaatcattcctgccttgtcttccctaagtgctgggattacagctgtgagccactgtgcctggcctcacttttccaattctaaagaatgtgtgtaagcctttccctcaacaacttattgaaaggcgaaaaaaggtttggaaataaaaggatctgatgtttgaaaaagtactttgtaaaataaatgcactaagacttatctgtggattactgcaaagaggtgaatatagtaaaaacaaatgaacttacctgtattactgcaagtagctcaacctagtaaaaacaatggaaatgtttgactttacccatcagccaaattaaaaaaatctccttttaaggttaaaaggatcaaaatgtaggtgaccgtgaatattcaccaaaaccttcatcttttcaatctcttcatctgtttctgggctgctcattttggatgcttttttattggttactactatcagtatctgttttagatggtttgtcttgtgtgtctaacagccgtgaacactcttttttttttttttttttctcctgagtcgaagtattcctctgtagcccaggctggagtgcagtggcaggatctcagctcactgcaagctccgccttctgggttcacaccattctcctgcctcagcctcccaagcagctgggactacaggcacctgccaccacgccgggctaattttttgtattttaatagagacagggtttcaccatgttagccaggatggtctctgtctcctgacctcctgatccgcccaccttggcctcccaaagtgctgggattatagtcgtgagccaccgcgcccagccaatttttttgtattagagatggggtttcactgtgttagccaggatggtctcgatctcctgacctcgtgatccgtccgccgtcatctcttgaactgccatctgtcagctaagtctaaggttttatgcttaaccatttgtggtgtactagctggactagcttcaggaatgtcagtgttttctaccattaaggtcagattgtctactacatcgagatggtggtggttgttagagctacctttagaaacatgtctgtttttttaaagacataacacatgcatgaagaattcagaatctggaaaaaaggtccataatgtttgacaaagaaaaatgttctcctgagggtcttttttggatgctcttctctcgttctgctggaatctgggctcatctccttttttcaatttctcgttttaatctgtttacatcctttactagtttatctactgcttgttcactgtcttccacttttttgcatatactctttaatttctcttacaatgaagcatacatttcatttatcttatgtacctcctttaaggatccatcttcttcaaaaaatttagagctgtgtgtttgtactgctcggctaaaaccagtggacatacaggaacctgatacagttttataacctagttgttcagacatgcccagattggcaaccactgaaggtaccctgtgaaaaagtccttttcgaggtttatataaggcatgttccagtcgatgagtagagcggctttctgttattatacttggtgttcatagcagaaaaaccaggtcttggtttgaaaaatgctcctgcaagtttttgtgaagcagcctctctctaaatgtcatgatctgatctgaatgacgatggaatttgtaacaacctaccacattttttgtgaatttgataatattttcctcagtgcctgcttatttacttcacctgaagaattataaaaactaaaaaactgatagcatggaatatatttctgaatgtcaattgtataaacaacttcagcatcatctatttgggaatcagtaatgctattcttttttttttttttttgagatggagtctagctctgtcacccaagttggagtgaggtggcccgatcttggctcactgcaacctctgcctcccggattcaagcaattttcctgcctcagcctcccaagtagctgggattacaggcgcccaccaccatgcccagctaattttttgtatttttagtagagacgaggtttcaccatgtcagccaggctggtctcgaactcctgacctcaggtgatccacccgcctcagcctcccaaagtgctggggttacaggcgtgagccaccatgcttggccttgtcttctcccttctaatatgaaagaggaagctaggaatccccattgctgctggcatgcatgctataaacctgaagggagccacctaagatgaaattgatactgtggactacacagtagaaagatggaaagaaactgggtcattgatgacattgtcaagatgctagatcaaccaaccacagatcctgtccaacaactggactcttgatttacatcagccactactctgttattgaatcttggacaagttggtttgcttacaagttaaattattgtatctgagagcatcctaactgatacacacatgaaaatagacatttctcctttgttgagaaggatgtacaacaaatctatgaactttaagttttagtaccttcacttgctcatgccccttcccaaccttttactaaattttatgcttgtaattttgtattcttttccttaaggaggaccacttaaattgcataagattcaggtgtcaccaaacctggatctagcatcagatgttgttggaagaaaatgtccacctttctctgccgtctcctccattcatgtctccctagggaaggagagatgtatgatgtatctaatcagtaaatagttgaaaaggtcacagaacgtgcgtggcctggcctctcttctggcgctttcattcagatctgcctccccacagtagtagatatgcctgcccacactggtaattctactgcagcaagccttgaatgacaacagtggacgtgaaagtagttgctgcctttgaccacatcttcccaaagtggcacgtcaccaacagactttaaaatcatgacgttataacgtaatggctgtgaagatttggaagaaagcactctaaaatgagagctctgagagatgtagagagaaggcagtcaaggaatagcgcctataagcacctcctgcacatccggtccctgcgcctccatcctcaccctgccctcagctcactcccctcctgttagaaattggctgtgcccctgaaaagtcatttgcatttgcctaaagactgagtacacaagctcattccaaagtagaaggtgttgaagttccattttggcctcaggtcaaaattgttttctctatttcagcttaatgagcaagaaagcagaatctaatatgtgtatatttctaacgcctgtgtatatttctcaactgtttcccagctcagaaaggtgaggagtatgacagtcaccctgaaatgacaacagaagccaacaataacaattatagtaataatgtgtgtatagaaagtactaaatgaccattaaatgaagagcagattactaggtgctatggaagatacacatgcagtgaaatacaaattccagatctcagggagtttgcaaccgaaaaagaatataacactaatatatatacaaggggacttcaaaacgttcacctgcaccctccacctcccaggttcaaagatggagttaaaggataaaaagtataaactttatttctttttttttttttttttgtgagatggagtctccctctgtcgcccaggctggagtgcagtggtgcaatctcggctcactgcaagctccccctcccaggttcacgccattctcctgcctcagcctcctgtcataagcaccatcaaggtcaagacacttttgtcagggatgataccagccatttagtccatccttaaaaaaaagagggtcctgggaatttaaccatgtcaatgcagtctttattaactgaagaaaaatgggtgccctttacagattttttaagattaggaaacaaaaagaagtcagaaagatttcctgtggaagctcttgcaaaattgcccttgtttgatgagaggaatgggcaggagcattgtcatggtgaagaaggactctctggtgaatctcctgggcatttttctgataaggctttggctttctcaaaatactctaataataaggagatgttgtcattttttggccctccagaaaatcaacaagcgaaatgccttgagcatcaaaaagaaatgttgccatgatctttgctcttgactgctttgtttgtttgtttttggagacagagtcttgttctctcacccagactggagcgcagtggtgcaatctcggctcactgcacctgcaccctccacctcccaggttcaaacaattctcctgcctcagcctcccgagtagctgagattacagacatgcaccaccactcctgactaattttgtatatttatatttatatttttattttattgttatttcttggagacagagtctcgctctgtcacccaggttggagtgcagtggtgccatctcggctcactgcaacgtctgcctcccaggctcaagtgattctcatgcctcagcctccggagcagctgggattacaggtgcatgccgctacgcccggctaatttttgtatttttagtagagacaggctctcaccgtgttgaccaggagggtctcaaactcctgacctcaaacgatccacctgcctcggcctcccaaagtgctgagattacaggtatgagccatggcgcctggctttatttttgtatttttagtagagatgaggcttcaccatgttggccagactggtctcaaactcctggcctgaagtgacccacctgcactggcctcccaaagtgctgggattacaggtgtaagccaccgcgcctggcctggtctgcttttgctttgactggaccatttgcaattcttggaagccattgctttaatcgtgccttgtgttcaggatcctactggtaaagccatcctgttacagttcttcaaataaatgcttcagcatcctgatctcacttgtttaaaatgttcatttaaaaggtctactcttgactgcagctgatctggatgtaatggttttggcattcattgaggggaaggtttgctcaactataatttttcacttgtaattgtgtaagctgaacaagttgagatgtctatgctgttggctgttatttgtgctgttgttagtcctcttcaattagggcatgaagatgatgaatttttttctcacaacttgatgtaatgatctggcactgtgggtttcatcttcaatgttgtctcatcctttttaaattgacttgtttgtttgtaaactgctgatttctttggggcattgtccccataaactttttgtaaagcattagtgatttcactgttcttctacccaagctttaccataaacttgatattcttgcttcaattttacagaatttgtgttgcttatataggggcttttttctgactgacgatttatccttcctattacctccagctagatcctttgagacatactacagtaacatagtatgagtttattttggtgcaaacaaattttgaaatcatacgtagttattttatagcatgcattttccatggactttttgaagtccccttatatatatagacttataaaggcagctttaactgaagcatattttacacatgttctatttggttgaagatatgaaattaccatttttgtagataaaatgtatttgaatattaacactttcatatagccaacctaattgttaccaacacccgaaacattcacaattacttgacttggaaacttcaacattccagaacattcacaattacttaacttggaaacttcaaattccagaacattcacagttacttgacttggaaactccaacattccagaacattcagaattacttggcttggaaacttcaacattccagagcattcacaattacttgacttagaaatttcaacattccagaacattcacagttacttgacttgccatcacactgtagttatctgtagacctctggggtcccctgcttctcctcactctttgaaggttttgacacctgactcactgtcactcttttaaacctgactcttggcaacattcttggtgatttcaacatccacaaagacaatctttccaatattctggtttcctgacttctgaaaatgttcttggatgccattttacctcaaatacccagttccatggtcatatcttagacattggaatatttacatcattttgcttctggggtaccattctcttgattcttccattactcactggccacattttgaatagcatctgttggtttctcctcatcaactgatctctatatgtaggagtaccctagggcctggtcatcagacgttgtttcttatttatctatgcttaccacttaatgtgacctcattcactctcatgactttagttccatctgaatattgatgacagctatggtttaaatgtgtccctccaaaattcaggtgttgtcagtgtgctggtagtaagaggtgccttctttaaaaggtgataacctcatgagggttcctccctagtgaatggaattaaggcctttatcaaaaaggcctcgcggccgggcacggtggctcacgcctgtaatcccagcactttgggaggccgaggcaggcagatcgcaaggtcaggagttggagaccagcctgcccaatatggtgaaaccctgtctctaaaattacaaacattttgtctctaaaaatacaaaaattagctgggcatggtggcacacacctgtagtcccagctactcgggaggctggggctggagaatcgcttgaacctgggaggcgggagttgtagtgagccaagatcatgccactgcactccagcctgctaacagagcaagattccatctcaaaaaaaaaaaaaaaagaacaaggcttcgcagccatgattctcagcaaactaacacaggaagagaaaaccaaacactgtatgttctcactcataag

SEQ ID NO: 178 - DNA, 212769 bp, Homo sapiens
ccttattaggcttttttgatttacctattttcctggaatatcagtttgtctttaaatagctaagaatctgacttatatgctgtcaatacacacagttagtaatacagcatgaaaatcctaacatgcttttctatactttagccgtgatcattttcatttgaagtcctaaattacaaactgatttaaaagctatatatatatatatatatatatatatatatatatatgccacatccatgaaaccttccttaatcaaatctcaagcttcacttttctcccttcaagctccctgaatacaacattcttcctatgagataattgtagtctactatctattacagtaaatttccaatgcattttatctcactgattagattataaactcaacgtggggatcgtgtcttgtttttatatcctatattgattgccaaagataatgatttgttttgtataaaagtgaatgaataaagtaacacatttgctttatttcagcttctttgcccaaaatgcagtgccaagttgggttccttcaactggtatggtgaacagtgctcttgtggtaggtggataacacctgcttttcaaatacataagaatagagtggatgaaatgaaaatattgcctgttttgggatcacaaacaggaaaaatatgaacatgatattttatagcttgggaagaaacttgcagatgatatgtgctgcctttgcttcttatcattcatggcagattgtttgtgctttcaacatttcatttgaaatgggagaagataaaatcacttgatgtaacctggaaactatgctttacatggcaatcaaagccttttgatcatgtacattttatttgatattaaaatcttttataaccagatactgtctgtgtttcatatatttttaaaagttttgattgttggaatgttatatgatcttaaggtctgtatagacaaaattatgtacaaaaatttgaaactattatatttaaatgggtattcttttatttccagacacataaagcagatttgtttggacatattttggaattatttcactttctttcttttaagggacattagtaaacccatacatgtctggatttttttcttggaaatggaaaggccattagtaaaacgctgattaaaaggcaattttcctattactgttcagtaatcccaattatctatatttttagaaaagtgtttgagatcccttttgaagtgatctacataaagaaatacataaatgttagatgtgtttctaatgatgaagaaaacaaatgtagagttactatatatcaagtcattttgtagcccaatatgtgagtattggaaaaggtaatacgtccagattagttttttaacctgatgtatagaaactagaattattttactcattattaataattacaattggacctaattagatatttgaacatttacaagaatcagaattaactaataaaggccaggtgcagtggcttatgcctatgatcccagcactttgggaggccaaggcaggcagatcatttaaggtcaggagttcaagaccagcctggccaacatggtgaaaccctgtctctactaaaaataaaaaaatcagccaggcatggtggcacacgcctgtagtcccagctgcttgggaggctactccaaaaaagaacaagaattaataaagaaaaatattctttatttttgttgtaaattaagttgtaaattcactagtcatgctccccaccatttgcagggttccaacaatagtacacattgaggcttatatacataaacaccgtagtgggagtaatttttaaatgcaaaaatatgttgtgaataatgatcctcttaataaatgcctagctcagttttttaaaggtataggagtgttatggaaaattcttgagaaaaatcttaacattggacctgaaggctttggcagtttccatgtaataatttttctttctattttttttttttttttttgagatggagttttgttgttgcccaggctggagtgcaatggcatgatctcggttcactgcaacctccactgcccaggttcaagcgattctcctgcctcagcctcccaagtagccaccacatctcgctaattttgcatttttagtagagatggggtttccatatgttggccaggctggtctcaaactcctgacctcaagtgatccacccacttcggcctcccaaagtgctgggactacaggcgtgagccaccgctctctgccataattttttcttttgagaaaaaattactccatttgttttagctttcataaaatctacttttttgcttcatactattattctctattcatatattattctctagaaagttttaacaaacaggttgaggagctcaggtgtggtggctcatgcctgtcccagcactttggaagacaaaggagggtggatcatttgaggccaggagttcaagaccagcctggccaatatgtgaaaaccccgtctctatttaaaaaataataacagtttgcggcacatgaagttaccccttttgtaggtaaaaagtagttacatagctgcagtttaatatgactcaatgcctatccatcatacactgttgatcagattataaaatcaaatagtatggatcaaatgcaatgttaattaagttgtaaattcactagtcatgctccccaccatttgcagggttccaacaatagtacacatcgaggcctatatactatttgtcttaactttgtttttgtttttgtttttgttttttttgagacggaatcttgctctgtcgcccaggctggagtgcagtggcgcaatctcgactcactgcaagctccgcctcccgggttcacgccattctcctgcctctgcctcctgagtagctgggactacaggcgcctgccaccacgcccggctaatttttttgtattttttagtagagacggggtttcaccgtggtctcgatctcctgacctcgtgatccgcccgcctcggcctcccaaagtgctgggattacaggcatgagtgtcttaacttttaaaacataaattggccgggtgcagtggctcacgcttgtaatcccagcactttgggaggccaaggggggtggatcactgcaggtcaggagtttgagaccagcctggccaacatagggaaaccccatctctactaaaaatataaaattagccaggcatggtggtgggcccctgtaatcccagctacttgggaggcggggaggcaggagaattgcttgaacctgggaggcggagtttgcagtgagccgagatcgcgccactgcactccagcctgggcgacagagcaagactctgtcttaaaaaaataaaattataaatcaagctatctgttaaataaaatgttttattctattatcttgacaaatatcccttcataatgacctgtcagaccaggtttgaattcagaattctctgattttatcagattccatgacaaagcatggcaatgcagggagaggtggcccccgcccactgggtgcctcctttatttccccaccccttgatttgttctgcatcatgaagagcctggtgcatatatatatatgtgggtcccccacctatatgtataagatctggctacagccctggtgtataccattagcccatttcactcgtaagaggtatgaggccagagcaagccctggaagccggcttggagctatttgggctatttgggtgttagatgcacttctagaagggggcatctgttctagctgggcacatcacgttggcagtatggattcttatcctgtggggcagagccagaggtcagagtaaagtcttctaaagtgtcggtccagggtaggggctcctcttacctagaccaaagagtggtattgtctctagacataaggttctttttcaaattgtatttctattccaagggtttaagttgaaaatgaatgagtagattcaagaaaaagaattccataacatccaacatttaatgatttaaaaagaaaagcctggtaactagagtggaaggaagcttccttaatcagagcagctgtgaaaaatatatgggaaaaaatcttatttagtggtaaaacttttcaaacattcacattaaaatttagaagtaagttaaaagatgtctagcccctaccttctgtatcgtattagagggcctaaccattgcagtaaaacaaggggctaaacagtttaagacgtaggaaaaaaatctgaactcactaataaatctcgacatctctaaaagtgggacagtatgtatatgccttctgctatgatgcaaggaagtacctatgaagtattcttgcaaaagcaaacaaaaaaccaaaaactaatcaagcctctagatgtcactggcagtttctggaacaaattaagcatcaccatgaagatgtaatcagcagaatcatgaagtgggaaattctataggaccaatgacttagattcttcaacaaatggcaggggggaagaaatggagagggaattgtcatgtgaactaaatgcaatgtgacaatcttgttggatcctgattttaactaactgtggaaggaagggcatttttgagacagaaaactgaacatggaacaggtatcagatgatattaaggaattattaattttgttgggtatgataatgggattatcagtatgttttttaaaaataagaaaaggcaggctaggtgcagtggctcatgcctgtaatcccagcattttgggaggctgaaacggatggatcacaaggtcaagagatcgagaccatcctggccaacatggtgaaaccccatctctactaaaaaaatacaaaaagtagctgggcgtggtggcgcgcgcctgtagtcccagctactcgggaggctgaggcagaagaatcgcttgaacccaggaggcagaggttgcagtgatcacgccactgcactccagcctggcgacagagcaagactccatctcaaaaaaaaaaaaaaggccttgtctcttagagatatacattgaagtatttatgggtgaaataatatatctagatatgctttaaaatactccaggaaggctgggcaaggtggctcacgcctgtaatcccagcactttgggaggccgaggcaggtggatcaccttaggtcaggagttcaagactagcctggccagcttggtgaaaccctatctctactaaaaatacaaaaattagctgggcatggtggcaggcacctgtaattccagctacttgggaggctgaggcaggagaatcgcttgattgtgggaggcagaagttgcagtgagccgagctcacgccattgcactccagcctgggtgacagagagagactccgtctcaaaaaaaaaaaaaaattctgggaaaaacacagaacaaaatgaaaaaagttgtggagaggagaggtaggatagataaaacaagaatggcaaattgtttaagctgaagctggatgataggaacacagggatttattatatcatctcttgtatttgtttgaaaattttcatactaagtttattttacaaattaaaacattaaataaaatagaatttaaaaggttggtgtttgcataatgttctgctaaataaaaaatcctaaagaactttagacaaatttttttaaagtcatttttattttatcacatactagtttccatctaccataatatgatttttttttttagagacagaatcttgctatattgcccaggctagccttgaacacctgggttcaagcaatcctcctgcctcagcctctcaagaagctgggattacaggtgtgtaccactgttcctggcacagacaaaatactagaataacagaattcaacaaggtttttggtacaagattgctgtacaaaaatccacagtgttgctataccccaataatagccaaatagaaaaaaaaagatgtgaaaaacaaaactataaaactatgaaaatgaaaatgaaaatcttagtgacctcaggagagggaaggatttcttaagaaagctacaagtcagctatcataacaacagattgataaatttgactacattgaaattaaaatctagagaacaaatcaccgtaaacaaagacgacaagtgtcaacctgggagaaggtatttataacatataccaagcgttaacttaaaaaagcccaacaatgggctgggtgcggtggctcatgcctgtaatcccagcactttgggaggctgaggcagaaggatagcttgagcctaggagtttgagaccagcccgggcaacaaagcgagactctgtctctctctctcttttaaaaatgtatatattaaaaagccccacaatgaataaatttagaaaagaaggggagactttatggcctgcaaggtggccatcctgcaggctgggaagcgtgcctccagaaacaggcgctttgaaggaggagggcttggagtgtagttcaggctgaacaggttggctaaacctacattttcaccaggttacaggaagagctatgaatattcatgaaagtggtcctgacacatgcgtattgaacaaaaactcatgtaacatatgacccatattcactttgggatggagacttaacttttttgttgttgttgttcagacggagtcttgctctgtcacccaggctggactgcaacgatgtgatctcagctcactgtaacctccacttcccggtttcaagcgatactcctgcctcagcctcctgagtagctgggattacaggaacctgcccccacgcctggctaattttcgtatttttagtagagatggggtttccccatgttggccaggctggtctcaagctcctgacctcgtgatcttcccacctgggcctcccaaagtgctgggattacaggcgtgagccaccacacccagccaagacttaacatttaaatgtattacgagccctatacgtcaaaaggtctttcaggacatgaagccatgcaaatgtgcgacctctgtagaccagccagaaccagtccatggccagtggtcttcttacctggagaaagttactgaaatcaacaaaaagttgtccaatgaaagctgtagctatggctggtggaacggggactgggggtcagtaagtcagcatctcgtggagctgcacattattttaatattgtttatctttaggccagtacttgtttagctgctagagaagaatcttgtggcagttagaacacagtttattctttaagtataggggtgtgggactaaaaccttgcctggaatggctttaggtcttttttataatttggcatcttattgccagagtctgttctgtcagtcttatcatctctgttttaacattaatgctggccagttgttgtgttaaactacaaaagggagggagtataacaaggtgtgtctaacctgtcccatcgtggtctagaactcagttttaaggttttctaggatccccttggccacaagggggcctattctgttggtggcggacttaggagtttagttttactttatacaggtgaatgaatagagcaggctatctaatgacgtacacatcatttgtgaaagaaaactccatagcaaactttataaaaggtaagagtggacagttcacagaagaggaaataaggtttcataagtatggaagaatgcaccactttgttagggaaatgtaaattgcaattttcacagcggtaaaaatggtaagagtctgaccatatcttgtgttggagagaatgtggaacaaagagaactcatcaatgctagtgagggtgtaaactgataaaatagtacatacattatttaagacattcttgaggctgggtgcggtggctcacgcctgtaatctcaacagtttgggaggcagaggcgggcggactgcttgaattcagaagttttgagaccagcctgggcaacatggtgaaatcctgtctctacaaaaaatacaaaaattagtcgggtgtggtggtgggttcccgtagtctcagctattgtggggagaggcatgaggatcgcttaaacctgggaggtcaagctgcagtgagctgagatggctccactgcaatccagcctaggggacaaagtgagcccctgtctcaaaaaaaaaaaaaaaaaaaaaaagagggagagagagagagaaattgagattcattcaaggaaataccatgggtagatccttaatatccaataagaaaaatgatttggagaacattaaagtttacatacattaaaaaaacccaaatgacactaaatgcatgtgtctataaacatgtttaagcaccgtaaaactaaaaataaaagtggactagaattacacttttatttttataaaataaaattttatacccataaaattcatggtagaagtggcctacgccaagggaggaaaatgaagcagggaggaaagaggaattcaattctgtagtatttaatttcttatgaaaaatctgggacaaaaatgaaaaatgttaaatttttaaattcttggtgataggtcacaaatgtttgtttcataattacttgcactttttgaataaaaataaaatcttttggaaattaaaaaaattggcgatttgtcatggtgattttcttaaaagactaaggtgtctagtgggatacagaagactcgatgattttattttattttaggttttttttttttttttttttttgagacgcagtctcgcaatgtcgaccaggctggtgtgcagtggtgcgatctccgctcgctgcaacctctgcctcccgcgttcatgcgattctcctgcctcagcctcccgagtagctgggattacagctacttgcccgccaccacgcctggctaactttttgtatttttagtggagacagggtttcactatgttggccaggctggtctcgaactcctgacctcgtgatccgcccgcctcggcctcccaaagtgctgggattacaggcgtgagccaccgcgcccggccttattttagttttttatgtcaatttttgaatttgtaattgggtgagaattaaagtgttataaatttcaccttaagtgaaaatttattagttttctaatgacaaaagtagttacatctgacgtaaggggatttaattatctttttctgggcttgcgtcccggaacgctgctgcattatgtaatctgtagtaatatacccacgagcagtttggagggttctgggaagcacatttgttttgcttacctaccatgggaaagattccacgtggtcctagaagcatacgtattcgtcggttacagtattttaaatattcactggccgctgaaatttaaaatggatgaaaaagaaattctcttaagtagcgttcttgaaactgctttatcaaactcagttcatattttcagttggagttcgtgatgtatgtgattttcctttaaataaaacccgaatctttagtaatacaaatattgggaacttcgattactgtaggtcttagggtagactcgcttggactttgactaaatactatgctttagaaatttatctttaggagataaatttggggggtttatctttttatatttgctttgtttcaatttatttaaataaaagtagtctttctagaagtatgttttatagtaccacttacctcggttactgtcccagttaagcagttttcacgaatgtggaaaaatagtagtgtttttctttcatacacgcgtatatgaaaaatttttacattgatagagaattattcgtaaaaattaaagtaaatttactgttagtctctaattttgttctgagatagccacgctgtggcattaagaaggataatcaaggaataagccataatgttcagaaaggggctttactttttatttttaatattattgataaactttgtttagtcgaattgatgtctgcgtgtcttcccccgccttccccataaaacagcgggacagaaagtcctgaaaactccaaaagggaaatatttactcagaggtctattcaaatttgcttagtctctgacgttttcctgtgtcgtacaaatccctcgtgcggcaaaagtagtttgtctttactaggccaccgtctcgtcagcgttacggagtattttgtccgcctgccgccgccgtcccagatattaatcacggagttccagggagaaggaacttgtgaaatgggggagccggctggggttgccggcaccatggagtcaccttttagcccgggactctttcacaggctggatgaagattggggtgagtgggatctgagaatgtaccagggtggctcgggttcgcgtctaaaggtttcttcctccctacttccgcccactcgtggtgacaggtgtggaccaaccctgcctggggagtgaggcccctcgtcactcctgttcgtgcccctggaagagtctgggagtatcgttcggcttctgtcctggccacagggagagtagaatattgtctaactggagttaactgtcgtttttcactattcccactggggaagtaccgggtgatctttttgtgtggctaacactggacgtctttaggaggtttagagcaaaatggctgggaccgccaaaaaggctacaagctatttcctgagtgtgaaatgtgggcggtgagcacaatggagtgggtttttgtgtgtttggtgtatatgagagaatgtggttatatacaagaaattctaatcttacagcttttactattggtttaagcctgatgtccgtcttggcagaaaagcaaaacacccaagcacctgacctcgggtccctgcttagctacacctaatacttatggtgtaatcctgactgctctccagatacagctcttaattttcttgttaatggatattttgtttggttttggtggtcaggaagggtggaatgggatgaagtggaaatgagaatgaagaaactttgttatctaagtatttagaggagacttttattctcctcttgattgcaagatataatagtaatattgttcttaggttccaatatgaatttgggattgtgtaggttcccaaatgggcccgctagtgagcctacaccactcatcagccttggaactggggggaacccagtttatctttctcccttggatcagcattctcaatagcaggagtggaaggaatctcaactttttattgaacaaagtcatttaattgtttcaaggacagatgttctctaaaactatattctattggagatttattttaatccttgggtagattttttaagagttgctggaaaacttaagattttttattcccattttcccaagccaaatgcattagtgacagtaaccatttatttagctctttgtgtcagggaccctgttaaactcttgacatgaagtattttgtttaatcctaccaacagtccaatgaggtactgtttattttagagatgaggaaactgaggctaacagaatttgtgctcagattcttagagctagttagtggcagaagaaggatcagaccaggtttttctacctccaaagtctgtacccctagcatctattctataatgctttcctaactcatgtctacagattttattcttcctaagatccctggttattaataagactacttgaatatattgggtagttatgatttattttgtcagctagtcagctattatattttcatgacatttcttttctttacctctttttttgagatggagtttcgcttttgttgcccaggctagagtgtaatggcgcaatcttggctcaccgcaacctccgccactcgggtttgagcgattctcctgcctcagcctcccgagtagctgggattacaggcatgcaccaccacgcccggctaattttgtatttttagtagagacgaggtttctccatgttggttaggctggtctggagctctggacctcaggtgatccgcccacctcggcctcccaaagtgctgggattacgggtgtgagccactgtgcccggccagtgacatttcttaaagtataactgtgggacacttcctggtagcataattttatgtcgtcttctgatacccaggctgcattttccagacttatctgatcacttgacttaatgttctctaacagagcattcagttctttgtagtcagttcaccgactcacttctatcgggtatcctgccctgtccctccctgaatgtgcccatttccattgttttccaggtttcccttttcaaactgttaacagtcttctcttctttgaagactttaatttaattccttaggtgttcagtaagtaggatagattttgttggcaatagagtgaaacactactgtctgatagtgtttcgttctgtgacagttgctgttttggatgttcaagtacttcactgatttacttgattttgttgttgttgttgttgtttcttttagagacagggtcttgctctgtcgcccaggctggagtgcggtgatgcaatcatagttcactgtgacctggaactcctgggctcaagtgatccttccatctgagcctcctgagtcgctaggactacaggtgcacaccgctaccatgcctggttaatttttaatttttgaattttttgtagagacaggggtcttgctgtgttgcccagactggtctccaactggcctcagtcatcctgcctcaacctcccaggtgatgggattacaggctcaagccactgtgtctagccttgatttttttttaatattagacactatctagttaaaatttaaaaatcagattatgtaattagtatgtcctgtgattttaacaactctaaataatttaaataaagtgattaactcagaacagcctgtgagggatgtgctttcctttttctttttaacttaggtaatgaaatttagagcaagagtcttcaaacattttctgtaaaggttcagatagtaaatattttaggctttgtgattacatggtcactgttgcaactactcaagtctgctgtgatagtgcaggagcagccagagacagcataaacaagtgagcatggctgtgtttctataaagctttatagacactgaaatttgaatttcacataattattttaaataataagcctacttttttagtataattatagatttacacaataattgagcagatagtacaaagagtccacatacttccccttcatccccagcttctcctattggtaacatcttgcattagtgtggtacattggttacaattgatgagccagtattgatacattattattaactaagcccatcatttaaagttcactctgttgtacattctatggcagggatccccagccttttggcaccagggactggtttcatgaaagacaatttttccacaggaggtggggacagggaggcacaggaaatgttttcaggatgattcaagtgcattacatttattgtgcactttatttgtattgttattacactgtaatatataatgaaataattatataactcaacataatacagaattagtgggagccctgagcttgttttcctgcaactagatggtctcatctgggggtgatgggagacagtgattagatcatcaggcgttagattctcataaggagcgtgcactctagatccctcacatgtgcagttcacagtagggttcacactcctatgagaatctaatgctgctgctgatctgacaggtcgtggagctcaggcggtaatgcaagtgatggggagtggctgtaaatacagatgaagcttcgctcactcacccacctgctgctcacctcctgctgtgtggcctggttcccaacagggttgggaaccactgttctatgggttttgacaaaggtataatgacatgtatccataattacagtattatatagaatagtttcactgccctaaaaaagccctatgctctacctattttttcctccttcctcttccctacctctggtcaggtaaccactgatcttttcactgtctccatggttttgccttttgcagaatgtcatatagttggaatcatacagtatgtagcatttttgaattggcttctttcacttagcaatatgcacttaaggtccctccatgtcttttcatggcttgatagctcatttcttcttagcactaaatagtattacaaaaatactatttacagtgttacaaaaaatagtatgtatgttctatagcctattagtctgcctaggctgccataagacaacaccacagactgcgtggtttaaacaatggaaatttattttctcccagttctggaggttagagttcaagatcaagatggccgcaccttcaggttctggttagggctctcttcctggcttgcatgcacatggctgccttcttcttgtgtcctcacatggcactgagagagagaatcttcttcttcttataaggccacagtcctatcagattagtgccccactttaatgacctcatttaactttaattacctcctaaagactgtatctctcgatatagtaatatttggggttagggcttcaacatacgaattttggaggacacagtttaggccataaattcacagtttgcttatccacttacctattgaagcacatcttggttgcttccaacttttggcaattatatataaaactgctgaaaacatttgtgtgcaggtttttgtgtggacatgcattttccaattgtttgggtaaatatcaaggagcacaattgctggattgtgtggtaagaacatgttttttgtttgttttgtaagaaattgccaaactgtcttccaaagtggctataccattttgcattcccgctagcaatgaatgagcatttttgatgctccacatccttgctaacatttggtgttgccagtactttggattttagtcattctaataggtgtgtagtggtatgttttaatttgcagtttcctgatgacatatgatgttgagcatcttttcatatgcttatttgccgtctgtatgttttaccctcctctctccttctctcttctcttttactcttgcttgaatttgtgcaaaagctgctttattctgctttcttctttcttccctcctcctcctcctttctcctttctcctttttccttctctttattcttctgtcagctgtacttaagatatgtgtatcaagatcagaagctttcgtctgccactgtggtttcgtttatgtcttcagtctcttctgtgaaggttctcttggctttctagcactaaatcaaaatctggtgctcctggatgacacaacttcccgtaatgccccggtgaacggttgctaattttattctcaaaaccttttcaccatagggcctctgttggtgggataggtgtctccattgtccttcactgctattctcctttcctcctccctaaaaatatctaagttgaaatctcattttgtcacaatatcccatcctctacctctcctgattcctggatcactctctttcacttttctttttttcttttagagatggggtcttgttctcttgcccaggttggagctggagtatgcggtggagcaatcacagctcactgcatcttcagacccctggggtcaaaggatcctcctgcctcagcctcccgagtagctgggactacagacacatgccaccatgcctggcttctttttggctttttgaaaacattttgccactagcttactgttactttcttcaccattacttccatcatgattcttggatgatttcagtatccttagagaagatccttcagatacactgacctgtcattttctggacctcctctttatcactgatcttaccttttacccagtctcagccatttgctttcctgatcataagcctaagtcttgtcactaccaataacatctcactttcaaacatcctgctctgactgccttcgcctgttttaccagcttacttcctttagtattccagtttcaatagttgttcagtccttctgagattttgccatgtttccagtgtctctcattctcttcagttcatcacgtccctcttacccagtttaaataccatggacagtcattgtcactatttccttcctttcacctttcatattcatgtctgtctcttttctggtaggtttctcttggataaacctattagttaaattcagttttgcccacttcatgcctgtcctagtatagctgaatcagctgaagaaaacacttcaactgtcctgactggtctcaatttaagtgttgccagaccaatcatatttccctggtcctctcactgtcccattctgatgattgctttataaagtttcttctatcttcaaacctccaacatctctcccatcctttgaatcagaagagaacttctacagtctcccactacctcatttacccacctatcaacatgtttgctttctcttttgttggtgagaatgagtggcttcttgctcctagctagagccagtccttccatatgtgctttagattcttcctgttttgttcaagaatattgctcaagctattcttcctcctgtttcctgcatcagcatttcccctctctactagatcatctctgtcagtaaatgaacatgttgttgtttctcctagaagtactgtttctatatctagatagtactctagctagagttaaaaaaaaaaaaaacaaaaccaacaaactcaaaactctcttcagatgttacttcacctcttgctgttactgcatttctctactgtatgttacagcagaattccttttaaaaaatgtccacgttcactgactctagttttttatttctccttgtctcttgaacccagtccagtcaggtgccaccactccactgaaactcctgttttttttttttttttttttttgagacagagtcttgctctgttgcccaggctagagtgcaatggcacgatcttggctcactgtaacctccacctcctggattcaagcgattcccgcctcagcttcctgagtagctgagattacaggcgcctgccaccatgcccggctactttttgtatttttttttttttgagacggagtctctctctgttacccaggctggagtgcagtggctcactcggctcactgcaagctccacctcccaggttcacgccattcttctgcctcagccttccgagtagctgggactacaggcacctgctaccacacctggctaaatttttttttgtatttttagtagagacggggtttcaccgtgttagccgggatggtcttgatctcctgacctcatgatccgcctgcccaccttggcctcccaaagtgctgagattacaggcgtcagccactaatttttgtatttttagtagagatggggtttcaccatgctggccaggctggtctcaaactcccgacctcatgtgatccacccgcctcggccttccaaagtgctgggattacaggcgtgagccatcatgcctggcctgaaactgctgtttttaagggcactactgatttccacattgctaaacccagtgactgtgtctgatcttattaaacttataaggagtaaatgaataaataaatgggcaaggtggaggtgaggtgggaaagtttgttgagtacactaaaaatagtaactaccattatttactactgttgagggaaatctaatagtgtgggactggtgcaaaggatatagaaataggcaataggttttaggatactttggggtaactgatgctaacagtttcttatggattcttttggaatgttctataaatatacgagtatatttatcaacccaccttcagttatttttttaaccacagaaaagtcaaaagatcagtacactgataaacgtgcgttttccttatctagatttaccaactgttaacatcgtgccacattcactttatatcttaatattacccacactttcctcctttttcacatctgaaagtgggctgcagataatatgaaactcctaaacacttcaccatgtatttcctaagaatgaggaaatgtttatttttaaaaagcatcaattcattttaatatgctttatacttcaaagctaacatcacagggttctttttcaccttcttgcaccatatgcttgtatttctcttctgccgctatgagaatcctgattcccaataacatcctttgtttttataggctcacttcagcagctctgttggaaataaactgaaagaggggcaagggcagaagcagggagacgttttggaggctgttatagcaatccccatgagttacaatagtagcagtggagtaatgagaagtagttggattatggatatgtacacacacacacacacacacacacacacacatacacacatatatatacatacattttaaaattttgaaatagtttgaaatctatagaaaagttttaagaacagtgcaaagaactcttgcatgccttttacacagactcctcagttgttaaattttactgcatttactcaatttctctctttctccctttcaagagagagagatgtgttgacccatcacctttaaatactgtagtgtatactctctatcctcctgcctcccaaaagaaggccactttcctctattactaccctatatttcttccagtcaggagataaacattgatacaacagtgtcatccaattcaaagacaccattcaaagtttgccatctgtttcaataatgatttgcttttctagtctaggattttacttgcaaacactcattgcttttacttatcatgtctcatcagtgtcctttaatctggaacagttctttagtcttttcctgtctctaatgtccttgacagtcttaaagagtagaagtcttttattcgacaagatgatcctaaaccactaaggggttccttggaaaaatgaccaattccagggctgggaaagtgcagggaaagtgcaaaataagcctggaaaatcttgggccagaaattctcagcaaatgaacatgttaaaaagaacaaaggccccaatatgaatgaactccccgtggtcaaatctgggaaaatttggcatcagaataaaatgagggtatacattatagtgtaaatactatgcgatgttcctatgccatcatatcatcctgtgatatagtcacatgatcacttggtcaagttggtatcttctaggtttcaccactgtaaagccactgcttcccattttgtattttattgctattttgggggagataatctgacataacaccaatatccttttcttattaaacctctaaccacgagccctagcctcattaataaccccaatctatatcagttaccactctaatggttgccaaatggtaactatctaactctatcattctgtctatcattctatcattgttgattgacattgcactataagaaccaacctacctacctaccttccttccttcctttgttccgtgatgaactcattgattccttttttatttggtggttggtaaaccgctactctcattttattctgatgctcagattttcccagatttgaccactgagaattcattcatattggggcctttgttctttttgacatattcctgtcatttgctgagaatttctggcacagcaagatttccaggcttattttgcactttccctgctgcaagccctggaattggttatttctccaaggaaccccttagtggacttctgtttggtggaagatggtatttagtatccaagatctggtcacccagtattttcattgctactgggatgtcattgcttctaggacctcttagcagacagaactaggaaatatatatacatgtgtgtatatatatatatatgtgcatgtgtatatatgtatatatgcataatacaaacatctgcatatgtgtgtacatatatatatacttccacagctatctgtatgtgttatattttaaatgagtttatttactaatacttctagttctaatccaacatcttaggattcttttagtctcccgactctttccatgctcttaaatcctttctcagactgtgagaaatctgactccaattattttagtaaaaggcaaaagattcattcgttctgaagagaaaccagagcattctaattattttagatatattcaaccatttgctcagtcacctaacatatttgttcagtatgaccactctcctaaccactcagcctgcgttttccatctgctactccattccccctcccactgggctggggcatgctggcatctttgctgggcaatagtctctcccacaccatcctatttccttggatatgaggcatattgctggagatgactgtgcacaaaaccccatcacctttgttgccctgcttctttggaagctgacatctctgtgttgggaggggtagggaagaaaaggaaggttgggaagggaaggaagaatgggaggaaaggtaggaagccacattacagatatatattttgagaacagagctgacagaattttctggtagattgattatggagagtgaggaagagaagtaaataattaagtaataatgatcccaaggtttttggcctgagcaactgggaaaatccaattgtcattaactgagatgaggacaaagcagtaggaggtttggtggggttgatgaggagctcattttggatatgttaggtttgacatgccttttaaacatctaagaggagatgtcatactcactgcacatgcatcttgaagtgtgggttggagatgtatatttggaaatccttggtatatagattttatttaaagccgtgagctcagctgagattaccaaggaagtaagatagatagaaacgtttatgctgagcccagggacaaatttgtgttagggagatgaggaagaaccagcaaggtaggtcaaccactgaggtgggaggaaaactgggtaagtgtgatattctggaagtcaagtgaagaaaatgcttcagttaaaatgaaaggatcaactatgttaatgctgttgataggtcaagtaagatgaggactatgagtttaccattgaatttagcaatatggaagtcactggggacattaataattatgtgtatgtggagcggggagcttgattggagcaggtttagaacgaatgggaggaaagaaatgagagagccagatagagaactctttaaaggagtttcagcctatatataagccgcagtcctctgcttatatgtttcttggctctgcacctgagtagtcttttctgagagtcatgtgagtaaccttttgttattactacgtatacatttttttgctaaatactattttgtcttaggcggtgaaatgttactgtaattggtcaggttaataacagactgacagtgcagttcctacacttgtgcactgaggaaatcatcagagcagtttcagcagcataaaataggtagagagtacaaaggaagacctagttttgaaaaactcttcaaagtgcttaaagttttgaaagtgtcagaggaaataggaacttcatagattctatggtgaggagccttcttgggccttggtcaacaccttaacctttctttacaaaaagttttcagtatagtgtattgaagaatgttttctgtatccacatatttcttgatttgtaatgaaacctcattaggaaattggaatatagttagatttgctgaaatgaatttgatggtttagatgaatgaatcctttattgtctagatagaaaattggttgcacccttaacttaaggcatggataacaaatacgcagtgtgtatatactttccacagccctctcctattgcttatgaaccatgtctactttccacagttgtctcctattacttatgaaccacattaactcttcatgctgaacccagatgtagcatcagaattcttgttagtaatgttccataaagccactaccaattagtcttacatgacatatgacataaaaccttttttgatccctggtgtaagaattcagttcacaagataaaaattatgcagaaaacaacacataaattggaaatgagcattgaattgcttattcacattactggagtttatcaataatagtaatggctaatgagaaaccttaatagaggtgacatagggacacagtgcttgtttctttgtcaaataattgaattgacagttcatttctattcttttcctttgtccaaagattctgctctctttgctgaactcggttatttcacagacactgatgagctgcaattggaagcagcaaatgagacgtatgtaagtatttactaaggttgaataatgtgatatttagtctttaaccctaattattgcaagaaagtttcaggacaacaggttcaggctagtaatttaagttacatacttaatggtaaatagcttctaccattaagtatgaaagttagtagccattttgtaatcagtaaatgtaggacagtagaaattgcattgtattgcaattctaggcccacctttggccctagggatgggtgactttggaaaagtcactaatctgcctacctggtttttacagatactttgctacataagggaattggcaggtgactttggaaaagtcactaacctgcctacttcttggtttttacagattctttgcttttaaaaaggaagttggtaagttctgcttgactaagttagtcctttttaaaagttgtgtattcatgtagaaagctctgaaaagtaggtgtatccttacctttgattggttagaggtctgtgtgaaaactattataacactgagtccccgagaatatcttagattttcttttcttgattagtacatataaaactctttgccctatagaactttgattttgtcttattctttaatggatgaggtgctgtttcacttaagaagtaattcaagtgagcagagtaatttgtcaatcaggttgaatatcacatcattttaggctcttattaacttgagtacaaaatatgtaaagattgcttagtgagtttcagacatttcttaaacaatgatttagcagttgtttttaccattaatcgacagaagagaatgaaggacatgatatattttaaaaaatcagtactagggattttaatggtttcatttactccatgagatactttagaatgtggcccattgattaaactgccttttaatattggctatttgaataagcaactgatactcatatttcataacatctagaatcctaaaagaaaatgtttcttttaaactatgtcaagaaactgtgtgctcaattggaaagattaagggaaatatattcctgattttacaactaacattctattattttatgcaaatcactcaatctttcagttccttagtttttctagtatgacatgaagggattgaatctctgagacccctcatgtcattcttcttccaaacggcaatagaatttcccatgctaaatcactgaagagttagagtatataagtgccagtatgtttcattttgcatgaactgggcctgttaaatttctgatgtgataaaatctttatgctgtagaaggtatttgacttatttggctgaagattgagtcagaagtttcctcaagtagatcatgcccttatttaaaagtgttgctggcactcaggcaagcaacattggtaactttacttagattaagaaagtttaaggattttttggttgctaaaacaaggctgcttaatttttttttttaagacagagtcgcactctgttgcccaggctggagtgcagtggtttgatctcggctcactgcaacctctgcctcccaggttcaagcgattctcatgtctcagcctcctgaatagctgggactacaggtgcatgctatcacgcctggctaatttttgtatttttagtagagacggggtttcactacattggccaggctagtctcaaactcctgagctcaagtggtccacccacctcggcctcccaaagtgctgggattacaggcatgagccaccacacctggctaaggctgcttaattttttgatgtgaagatccaaataagagaaaaaagtgaaggagattgattttttaaaaaatggtttttttatgatttaaatacttttttttcatgtgcactttcacatgttctctttatgtaccttgtactaatatttactcagttatgggcatcataagaaaatagtttcccttctgtgtttctgttacattctcaataaaaatgaaccatatagtagtcattttgaaatgataatattcttctagaaattgttaacaaatggtcgttaccaattactagatacatttttactttttttgcctgaggtgtatttttttatttttatttttattttttttttgagacggagtcttgctctgtcgcccaggctggagtgcagtggcgcaatctcggctcactgtaagctccacctcccgggttcacaccattctcctgcctcagcctcctgagtagctgggactccaggcacccgccaccacgcccggctaattttttgtatttttagtagagatggggtttcaccatgttagccaggatggtctcgatctcctgacctcgtgatccacctgcctcggcttcccaaagtgctgggattacaggcgtgagccactgcacccggccgaggtgtattttattgttgctgtttttgttgttgttgttgttttgttttgtttctttgacagggtctggctctgtctcccaggatggagtgcagtggcatgatcttggctcattgcagcctccatcttttggactcaagcgatcttcccaccccagcctccagaatagctgggaccgtaggtgcacgccactatgcccagctagtgtttgtattttttttcttaggtagagatgggttttgccatgttgcccaggctggtcttgaacccctgggctcaagcaatcctattgttgctgttttatcatttgtgacattaagttaatatttactgccttttgactttattgcattatttatgtattaagtttacttttctttttgtctctgtgactccagacacttaatttaaaatagtactgtttggtactaacttgatctcagacttacatgaggactctgaaattatgtgacacttctttattcatgtatatagtataaggtggttatctggatgacccagaatatgcttatattttggttagaaaaaccacctaaatgaaaagaacttaatgcaggctttaagaagtttgctggaccctgttttagaaaattagttttattttataggattaaaaagtggtgttttttttgattcataaaagttttagaaatttaagaagtatagaactgtagaaaaaaggaaaattactcagtgattcataaaagttttagaaatttaggaagtatagaacagtagaaaaaaaagaaaattactcagtggtaactatcctctttatgattcttgcctgtcttttggatatatctatattctttctattgtatatagagattatattatgaatagcatttactttgtcttgtttttcttaatggcaatgggaaaatgtattttgctggatttcccttaagataaaagacacatttttgactcctgtaatggtcattctcatagaaaataatgaagccaactaaatgttttaaatactgaatcccttacctctttcctagttgttgctgctgtgcttcaagtaactgaattgattttatctctaggctatccaagatgtattctcatacaagactgacttagagtattctttttactaggttggctaatagcagttaaattatttgtgccaaattgtgtctcacagtttgattttaagatgtgtatgttttattcttttaatattcttttgctgatttgaaacctacaggaaaacaattttgataatcttgattttgatttggatttgatgccttgggagtcagacatttgggacatcaacaaccaaatctgtacaggtaattatgtgtttcactggtaaaagttttaaaaagatcaattttattttgtagtttggtcatactcaaaattaggtggggttattgggctattctggtaggttaaaagattcctggtgttatgcattctacttctggtatggcaattatgtaaacaaatttcttgccaaaaatggatatgaggagtttcatagttatgtttcagtagtgtaatgaatgaacagttcatatcagaaatagaaatagtgattttgaattatgaataatgtctctgtataagattaacctgagaaccagacagggcttagggaatcaaagggaagagcctgggttaccagaacctaggaacttggtggaggagtcccatgcatttaatacatgtacttctaagaaggggcagcacctggctgatactaatatctttaagggggcctgatgaggtcggggttgagtatactgaaagaagccagaacctggagcaaattgccagtgctgggatacagctgatggtagaatgaagaaaaatcccttctcctcccttctagctttttctagtatcccctattgacaggacctaaaaggatgccagctgggaataatttatatcaccgattatagaaagtggacttagtgctgagagacagtgaataaataaccagcacattctcctatctaaattcctctctacctctgcactacctattcctcttcattttatgtatttacttatactgtttcatgcctgtttgccttcatagaatgtgggatacacaaagtcagtgttctggttttatcgtttgacaaactaaatcttagttgcttaaagcaacaaccattttattagattgctagaatctatgggtcacgaattttgactgggtgcttacgaattttgaccgggtgctccaaggatggcttgtctctgctccatgatgtccagaccacaactggggagatttgaagattgtagtagcttgacatttgggggctagaatcatcttgaggtttcttcactcatatgtgtggcacctggggtggaatgacttgaagactaggactactaaatggagtgcctgcatagggcctctttgtgtggcgtggtgttctcagtcatggtggtctcagggtagtcagacttcaaaggctccaagtatgagtgttccagcacacaaagcagaggctgcatttccagcttcagaattcacatagcattacttctatcttctcttgattgaaggagtcaagcccacctaaattcttggggaggggaaatcgactctacttcttggtgggaaagtggcaagatcacattgtagaagatcatgagggaagatcatgaaggatggtagatatcgtatggctaattttggaaaacacagtctgccatccccaccctattctatctttgacaccaagggatactgcctgggccatagttgctcagtacatttttataggataaattaatagtttaaaagatatgaacattttttatgagtttgaattgtattgtcaaaaatgctttccaaaatatttcctgtttcttatttttttaaattttttgggaagctataatattttgcatatggtaaaatattcaaaaggtacaaaaatctgtatagtagaaaaatgtctcctgcttttattcctcagccaacaagttctattttccagagacaaccactgttaccagtttcttctgtttacccttccagagaattagtgcagatgcaagtgtacacatatatatacacacacacacagacatacatatataccccctccccacatatatatataatttgtaacacaagtggaaacatactagatatattgttttctgcatctttcattttcactcgttatattttggtgaccttagcttccatatctgattgaattttaaaagtagattttaccttctttcttgttcattttattataagtttttattgtccagtgggtaaaacctttcctccatgttttccagttaaagatattaaggcagaacctcagccactttctccagcctcctcaagttattcagtctcgtctcctcggtcagtggactcttattcttcaactcagcatgttcctgtgagtagccagtcttttacaatgattttggttataatatgctatctggaaaatatgtatatggaggaggcagttaacatttattgaatactactatgagttatattgtctcatttattgagggaactgagactcaagaaagagccttgtgggagctagaaagttgttagtgcctttggttttgctctcttttcccctctgttcatgcctccataatttcattgtttcatttgtttcattgcattttaacagtatccagtatttgtttattggcttactgtcctttctcccaccctttctttctcctccctattaggatatacattctttatatatggacatagaagaatgtaagatggtcagtttttatatctctttagtcacagcatctagaatgattgccttagtttgggaatgcctagtgctaccttttgaaggggctcacgtttttatagaagtctggtagctcttttaagaacacttctgctctgtgtccagacaaaagccctgaggccaggaaaaggaagtacctgatttaggtactttttagaatggggaaagggaaagtataagaataaaaaaatcaaataatattttagtatattatatgtgctataaattgtggtatctttgttcctgcaggctctacatttagttactaaatcctggtggttatatgcacatattaattcaaggatttatcttttctgcccctgccaggccatcactatctcacctggattaagtcaataggattttaactggtcagccttacaactcctcaaacctttcttagcagtggaatcttcaaagagaaatctttcagtgtcacaagctttactgtatcagtcatttgcttaaaactttttagtaacttcccagtccttacaaggatgaaatttaaattcccagagtactaggctttccatgatctggcccccatttacttttccagtctcttttcttgctatcccctcctacttccacattccccttaatttgagccctgtgagagttcctctctgagagctcctatgcactctactcattcaaccgctgtgccaggcactgttccagatgctggcagtgaacaacagcagtgagattgctgctgttacagttctaggtttttgcacatcctctttcttctgcctagaatagccccatttttttcttgtcttggaaaactcatccttcaagtcccagttcaaaaactacttcctttatgaagcttttctctgattgctgctattggtagctctctgaggtcccacaatttctccaaatgatttaattttttaaaaaattaataattacaaaaggtagcatactgtataccctgtcctgtaccttgtttttttagcttagcaggataactcttaatttcagagtatataattttcccattatgctacataatgtttcattgcatggccttatcatgcttaatttagtgatttccttattgatgagtatttgtgttgtttttagtcttttccagacccaattaacctgtacataagtcttttccagactcaaataacctatagtaaataacctggtacataagtcactttatatttttaccaggatatttttgggatatatttcaagaggtgggattgttgacaccaaggtaaatacacttgaattttgctagatactgccaaatttctctctataggggttgtaaaattttacatcctcatcagcagtatgtaagagggcctgttttcccatcatcactccacaataggttttgttttatatctcttttattataagtatggttaaataatatctattcatatgttttatatgtttaaggcctatttgcatttctttttaaaaaatgaactgtcatttcaaatttttgttctttttttttttttggagatgaactctctctcttgtctaccaggctggggtgcaatggcatgatctcggctcactgcaacctccgcctcctggcttcaagcaattctcctgcctcctcagcctcccgagtacctgggattacagggattacaggcacctgccaccacacccggctaatttttgtatttttagtagagacagggtttcaccatgttggccaggctggtctcgaacttctgacctcaggttatccacctgcctcggccccccaaagtgcttgggattacaggtgtgagacactgcgcccggccgttcattttttaattgaattgtattggtctttttctctttaatattttaggtgctttattatatattaggattattagtccttagtttgtgaaataagctgcaaatattttttccccaatttttcttttgtctctttgctttatttctggtgtttatttttccccaggtgtactgttttctatagccaaattattgatcttttctttaattgcttttttgttcactcaaaggaaggttttcaccactgagaggttataaaataattcactcatatttttactctttttttttgcttatgttaattttttgtttggaacaatctcaaattcacagaagtgttgtgagtaccttgcaaataacttgttttttccttatgcatttcagagtaagttaccagtccgatgcccctatcactccaatactttagtgtctacttcctacaagcacagatatttcttagccataatacaagcacaaaatcgggaaataaacattaatatgttactataatctaaccttcagctctcgtttaaattgtgccagacatcccagaggtgtcctttagactatcaaaaggacccagttcagaatcaagcattgcatgtggttatcttgtctttttaatcttgttcagtatgaaacagttcttcattaatccttgactttcttcaccttgtcacttttggggattaggagttagttattttgaagagcatttcttagtcgggtttgtctgatgtttctttaggatcatattcaggttttatatctgtggcaggaatgtcacagaagtgctgtctgtgtccaacttttgatgacccaattttgattttttctaatactgattattttcactttgatcccttcatagatgttatctgccaacctattccattgtgaagttgctttttctctctatgccatacatattttgtgagaaagatactttaagactatgtaaaaatatcctgttcatcatcacactttatatttgttcacttatttgttaatatctgtatggattcatcgtttcttattttattcaacagattataatccgttactataattatttattctgattcttacattgttctggatttggccagtgggggtcccttcacaccagctcttatgttcttttaacatgtctcctttgggctctgatgtccttacactaggctgtcttcccatgcggatgccctcctcactctgctgtgactcctcatgccaggccgcctgccatatcagtgccctctctacccttcttggaccctgacattccaccaggctacttctctgcgtggatggtggtcttgctttaccccatctagtggcttaggataaaattattcaggaaggaatattttctaagtgactatgaataagtatttatcatgagatattatttttagtgtttagatctcggatccatttgaaattacccttgtgtattatatgagatacaaatccaattttatgtttttccaaatgactatcaaaatgattattctagtaccatttatcaaaaagttcatctgatttcaattatatgcatgtattttaaatttatgtaaatggcattatagtagatatctttatattatttacttttaaaaatcagcacagtgtttttaagataaattcctattgctctgtgtacatcaaatctgttgcatctaactctgtacaacattcaagtatgcattcactacatttttacctacaccataatgaatattttaaaaaatgttcccttgcggacccatgtgagaaatcctttagaatatatgcctagaattgctgggtagtagaatgtgcaggtatttaatttgacaagtgcttccatatttctctccaggatcatcatagtactctgtgggctggcagcagtgcctgaggatccctgtgacttctctcctgatacttggcattgtctgcctttttaatttttactccatggcacaatgtgtttttttgttgtttgcttttattttgttttactttgtatttctttggttattgttttcaacatttatttacattcttatgagctttttggactttttttcttttatacattgtttattcctgtcctttgccagtttttctactcagttgttgtcttcttgtttatcagcaggaattcctcatatacttgaaatagtaaaactcttgttggatttagacattcaaattgcctatatcttttccctttctattatctattaactttgtagtctttattaagtataaatagttaattttcaattactcaggcttatctttttttttcttttcctttatggcttatttaagaagtccttctatgcttttagagcacagaggtattctgcattttcttttattaaccatatggtttacctttcacatttaggtttcttaatactcttagacaccactttaatatgtggtattatgtagggatctagcactaggtagggatctaattttaattttctctataaaatgaatcagttttcctaactgtattgtctttataatcacttgtaatcactcttttcaacaatattgtatatctctctgtttactgaaatcttttatgccttagttcagttgtgtagttttcttcatatgggtcctgcacattccttagaaaatttctaggtattttgtaattgttattgctattgtgagtgaaatatttatttatttgttttatttaaatcttttttatttttaactttttttgggtacatggtaggcatatatatttgtggggtacatgagatgttttgacacaggcatgcaatgtaaaataattagatcatggaaaatggggtatccatcccctcaagcatttatcctttgtgttataaacaatccagttacatactttttgttattttaaaatgtacaactaagctcttattgagtatagtcaccctgctgtgctattaaataatatgtcttattccttctccttttttttttttttttttttttttttacccattaacaatccccatctcactaccagcttctcagtaccctccccagcctctggtaaccatccttctaccctatgttcatgatttcaattgttttggttttttgatcccacaaataagtgagaacatgtgatgtttgtctttctgtgcctggcttgaaatatttattttttattatgttttctaagtgtatattaatacaatattttcaagtcaaatttttttttcagtggattgttacatgtgcttcaagtatatagcatattaccttgctaaaaggcacgctgtctcttttgttttaatgttttttaaatttcttcttttagtgtaattatactagaattacagaaaaagcaggtatctattttttatcctgactttaattgtaatgcattcagcattggacttggctgtataattactgatagctttttaatgttaagaaagtattcctcggatccttgttttctaggattttattgaggaatacttgtcgaatattatcaaataccttttaagcatcaaaggccgtgaagataatagtctcctcccgtgttaccttgtactctttggtttcttggaaatgtattttaatacactctacatattgctcagcttacatgctgagtaggtgttaaggatgaaggaagatgcaattgtcacttgtcactctcaccagtgagactgagagcatttctttctcccatatcctctcaaggtcatttaaatttttttttatgataaaaaaagtttaaatttgcctttgactaccatttgcgtttccttttcagtgaaatggctgttcctgccttttgtctatttttcgcaaatattttctaccaatatatatcttttaactttgtttatggtctagtttttattgttaaatagtttacttattatttgttcaaatctatttcttcttcctttgtggcttctgtgtgttctgacttaagagggtctgcaacaccctgagagtaaacaagtattctcttaaattttatttttatattataatcttatagattattttgaagatgttatgaagtagagattatgtctattgcgtgatcatgcatgccatcttttctgtctgaattgaattgctacttctatgttgtttctttattctaacaaaatgagatagattcactgaatattaaaagactttgggaaaatgcgaatgttatctttatgtatctcaatcattatgaattcacctactaaattaaagaaaatagcactgttggctgggtggggtggttcacgcctgtaatcccagcacgttgggaggctgaggtgggtggaccatatgaggtcaggagttttagagcagcccagccaacatggtgaaaccccctctctaccagaaatacaaaaacttagcaaggcgtggtggcacacatctgtggttgtagctactcgggaggctaaggcaggagaattgcttgaactggggaggcagaggttgcagtgagctgagattgcgtcactgcactccagcttgggcaacagagtgagactctgtctcaacaacaacaacaacaacaacaacaacaacaacaacaaagcactgctccattcatgcatctttcttttacaacatttggaacaaaggcagtattacaaaatagaaaacagaaaagaatacaaataaaattattttgcttttgatattcttttaagaccaaataagagagattatggagaaaggatattggcattttaactgcaaccttatactgatactgaatgtttgtatgactacgaaccaagttttatatgtgtgtgtgtgtgtgtgtgtctctgtgtgtgtgtgtgtgtctctgtgtgtgtgtgtgtgtgtgtgtgtgtagtttgtaggaagaaatgtagcaacagatcaatgattcatatctttaacaggatggcatagacttactctgcattttgagttatttttcctttggtatagatggatcatgctgatagtcacttattacttaatatatatatacagtttctaatatacctttcctttgaagttaccctgaagtgtttttctgtttatatgtgggtctcctccttttctatgcaatttgctgcttaaggattatactcattaatttttgtttttattatgctacaggaggagttggatttgtcttctagttctcagatgtctcccctttccttatatggtgaaaactctaatagtctctcttcagcggagccactgaaggaagataagcctgtcactggtcctaggaacaagactggtattactctatctcctaacttctgttatttctatttcagattgagcttaggttccatttcttaaaagaaaatgctggattaaatttatgtttattaggctggcttgctgttttttaattggtggacctatattgtttgttgtgagtgattaccgtggagaggaaaggggagaaataatctttggttgtctctgtctttacaggtgaaagatactttaaaatagactcagaccccaccatcttcaggagagatttcaaagtttcagttaaagataactgaatggagctatgacatttgttacctcattaatctctgggtgttatcccgtgattttagcaattctcctttaccagttagtgtgtcccattcccaaaactgcagcttggttagaaaaggaggtaacagtttaagtacttttcttcagttcattcaggtatatgtactgtagctatgcttaaactccagttaaagattgttaatcgaagttaagataatgtgtagagaaaggtgtgtgatagaatctgttttttagggcttgcgtaattgctttcacattgacttgtggtttgtctggtttttctccagaaaatggactgactccaaagaaaaaaattcaggtgaattcaaaaccttcaattcagcccaagcctttattgcttccagcagcacccaagactcaaacaaactccagtgttccagcaaaaaccatcattattcagacagtaccaacgcttatgccattggcaaagcagcaaccaattatcagtttacaacctgcacccactaaaggtacctgagcagaatttaaggctgtgtaaatttatttggagggcagtaagggttgtgtcatatgatttgttttaattcaggttataatttctgagcacgtgctgtttgtcaggaatgtctttggttatgaggacgttgcagagatgactaatgtgtggttcctgtcataacaagggatatagctctccagaccagttacatctgatggttattttgaaaatctgggacactttcttggtgccattttattctggtggataaaatacaggaacacaaattttaagctagttgaaggcagagttcaggtcagccagatttttgtggctgtgaactttttttgttttgaaggaatatttaaaataatagggtccatttcaggtgtgttatagcaatagaatcacacccttaatctctgaggaggctgcatggtttagtaaacagtatattgacctggtcatgaggagacctgaactctgctttcaactagctaagaatttgtgtgtttcgtattttatccaccagatggcctcatacacttgtgattctatgagaggtttatgtcattattgaaagaagttcaagtctgaggatttggtactattcagatatgggagtcatttccgtatggagatctcttaggtagattagtcatcattgtactcatactgatatctgtatacactgggtacaagaaaacttttgcagcattcttatctctggatttagtttgttggcaccagatatgactaggcgataatggggtatgggttgtaaataaacaccaatgttacatttgtactgtatctccaattgtgaataggtagctcgttttttggagcatagttttaatgagggtaaatttgataaatttaatttccagatactcttttagctttgttctattacatggtcatagacaatatgacattgataaaaagaagacctagatgagagaatggatgaatcagtgaaaattcatccatcagtcccaccaaaaataaacagacaaacaaacaaacaaaaaccagtttgaaatgcctgctctctcagtacaaagtcagaactgctgccttttccatctgaaaagtagcattcctatagaataggtattcttgtgatttataaatgtgtattaagggttcatgaactccttgaaacaaaatgcaggatttaatgtatgttcatatgtggattattctagggatagtctccaaaactttcattaggatctcataaggatctgtgccttcccaaaggctaagaatttaaactaatgaagaacctcattgtagttcccataagctattaaaatacgtctatacaaaaagtctgacattaatatgactagcgtataaagcaggggtattcctaagaatttgcccttagcagatcattgactatgtttgagtgatggaagatcttacctataataagaagacaaactgttcttttctgagcagtttatcagttccagaaacctgaattacacattatttgaaacttcaatactttcctgtcatctgaagactatagttatttttttgtgagcatgtgctaatatgaggaactgcaccttgcctgttttttttcttttatttgagacagagtctcgctgtgttgccaggctggagtgcagtggtgtgatcttggctcactgcaacttccacctcctgggttcaagtgattctcctgcttcagcctccagagtagctgggactacaggcacgtgccaccatgcccagctaatttttatatttttagtagagacagggtttcaccatgtcggccaggatggtcttgatctcttgacctcgtaatcgcctgcctcggcctcccaaagtgctgggattacaggtgtgagccaccgcgcctggtgccttgtctgtttttatagtacaatctaaataggtggtattattataataacatacagatttaaagtatgtttttcatttatttgagaatggggaggaagaagggaagtatgggcaagacattatacagttaatcatgttaatactagtagtaaatatgttaccattgaaaaagaagaggtaatttccacaggtttaagactgagattctctagcttggaatgtaaaactcttcacaatttggctctagtttagttttttgtttttttgttattgttgtttgtttgtttttaatagagacaggatctcactatattgctcagtctggtctcgaattcttgggctcaagggatctacccaccttgatctcccaaagctctgggattaaggcgtgagccaccatgcctggcctcctagtttagttttcgaactttataatattactcttttctataaatcccttcttctagctcaactaatctgtcattgtcctttgaattctcttgtttttcctagttttttggctcaccattttctaccaaccagcaacaacttatgcctacttctacttctcagtcctccatgtcctttaagactgttttgagtagtgtagatgagagataatgaaagcctggaatatcaatgaaagtggagaaccaggatgaagagtagagatgttaaaagtgtagaatcttagagattggtaattggattgtgtagaaggaggctgaacgatagagaggaaggtgtctaggatgacttccgtttttctatcttggggctttttgggtagatgatggcgaaaattattgaaatgggagacagaggtaaaatatgttgcccagatcactctgctaataagaagtggagccagaacttgagcccaggtggtctggctcggagtctatgtgaataatcactatactgtatcgccttaaaaaaaaaatgacagatgtattccttgctctcaagaattctacactttaattgggggattaaattcacataaacagttaaataacagtcactgtgataactaataaattaataactcatgcagtgcccttatggaagctattattatatagaaaaggagattaataataataataattgcatttaagttcttactatgtgccagacactcttctaagtgcttaagtgcattatcttatttcaaataatatttacacattatttgaaacttcagtatgtttctatgatttatggtgatgggttgtgatatctccattttttagatgagaacgctaagtacagattatttgccctaagtcacacaccgatgctgtttcagacaaagtaggcattcaataaatgtttgatacatagtttaaaatctttgaagaaagtttaaaagaaagaactatcaaaatcagtgagttacacatagtcaaaaaaatatatggcattgaatccagccatgttccgttaagggggatttgcatgtaatgccagagaggattttgagcatgctaaaatggataaacagcctttggaatgtcctttttaactgtttccacactaggaacagtagtaactatgttcagctgctatttaaggccccaaacaattctttgcattgtagtttgtggcctggtcagcatttaccaagtcaccatgagagttttttgttctttcacttgaacatattgtcatagaaatttagttgtttcccctcattctgtgttgaacccaaacatgcctagaatatttagagtatccctgatttagctgctgggtaatttgaggatagttgggtactctgggatgaaaaggcttgatacaatatgggaaaaaaaggaagcagcagtggcttggtaggactcaagccacatttggccttgccttggtattcttccatctcctttgtgtgatgcggtcgtctcagcaaggagacagtggtaattacacaattggtagtacagatttggattatttttcttaattagtttaagaaatattacaaagccctctgtacatgttatctgctagggctttaaatctgtaactgtagctagaaataggattctttcttataagttgcctaattcattatatttacacctcttctgttctttaaaatagtcccaaagttccctgaacagtgtttaattttggggagggatcttttaatcataattttaaactcagaggatgtagaacatggcttcctataatactcttctcaaagtattggtttaagtcagtggttctcagtctgtatattgtggaccctgggatgtgggtgatgggggtagtagctttatggcattttgcaaagcatctgcaaatccatacttgaagcaagcattttctgtagaccaaataatttatttcatatatctttgtacagctcttcaaatttttatagctatacttctgactaataaactccaagttcattttaaatcttcactaaattcttagcagcctttttccatcatgtattttctcagtacacagaagctgaaaggacaaccttgatggttttgggtgaccaggatattattttatattaaaagagagcccttatattcaggagcctttggggagagactatgggttttctaggtgtagaattatatcatctgtgtgagagatggtttgacttcctctcttcatatttggatgccttttatttctttcttttgcctgattgctctggctatgacttgagcacttgggaattcttgttttttggttttttttttcacattatgataaatatatattttcatagtgccagatttactgtaatttcttattgttattaaaacctaacacttggtcatatgctatttactttatgtgtttctaatttttatttgcgtatttggcctaagcatgtttatatctgcttctgagtaatttctgcattttatatgtttttacttcataaaagatggaggccacctcaaaacaaattaggcatcaaaggaacatacctcaaaataataagaaccatctatagcaagtccacagccaacattgtaatgagtgggcaagagctggaagtacattccctttgagaaccagaacaagacaaggatgtccctctcaccactcatattcaacatagtgctggaagttgtagccatagcagtcaggcaagagaaagaaataaaaggcatccaaataggaagagaggaagtcaaactacctctcttcacagacgatatgattctatacctggaaaacccatagtctcagcccaagactcctagatctgataaacaacttcagcaaagttttaggatacaaaatcaatgtacaaaagtcagcagcatttctataccccagtaatgtccaagctgagagccaaatcaagaatgcagtctcattcacgatagccaaaaaaagaatataaagtacctgggaatacagcaagctggggaggtgaaagatctctacaatgagttacaaaacactgctgaaagaaatcagagatcacacaaacaaatggaaaaacattccatgctcatggataggaagaatcgatagtgttaaaatggccatactgctcaaagcaatttacagatttaatgctattcctatcaaactatcaatgacatttttcacacaattaggaaaaactattctaaagttcacatggaactgaaaaagagcctaaatagccaaagcagccctaagcaaaaagaacaaagccagaggcatcaagctacctgatttcaaactgtactacaagactacagtaaccaaaacagcatgatactggtataaaaacaggcacatagaccgatggattagattagagaacccagaaataaagctgcacccctgcaaccatctggtctttaacaaaaacaaacagtggggaaaggactgcctattcaataaatggtggtaagataactggctagccatatgcagaagattgaaactggatcctttcctttcagtgtatacaaaacccaactcaagatggatgaaagacttaaatgtacaggctcaaattataaaaaccctagaagaaaacctaggaaatatggttctggacataggccttgtcaaagatttcatgatgaagactccaaaagcaatcgcaacaaaaacaaaaattgacaaatgggatctaattaaactaaagaggctgggcgtggtggttcacacctgtaatcccagcactttgggaggctgaggggtgcatcacttgagatcaggaattcaagaccaacctggccaatatggtgaaaccccatctctactaaaaatacataaattagccaggcatggtggtacatgcttgtaatcccagttacttgggaggctgaggcaggagaattgcttgaacccaggaggcggcaggtgcagtgagctgagattgtgccactgcactccagcctgggtgacagagctcaaaaatcaataaataaaaatcaactaaagagcttctgcacagcaaaagaaactatcaacagaggaataggacagcctacagaatgggagagaatatttgcaaacagtgtatccaacaaaggtctaatctccagaatctacaagaaacttaacaagcaaaaaacaaccccattaagaagtgggcaaaggatatgaacagacactttcaaaagaagacatagacatggccaataagcatatgaaaaaatgctcaacatcactaatcattagagaaatgtaaatcaaaacaacagtgagataccatctcacatcagtcagaatggctactatcaaaaagttgaaaaatatccgatgctggcaagattgcagagaaaagtgaatgcatatacattgctggtgggaatgtaaattggttcagccactgaacgtagtttgtagatttctcaaataacttaaagtagaactaccatttgacccagcagtcccattactgggtatatacccaagggaatataaagacacacgcacacatatgttcatcacagaactattcacaatagcaaagacatggaatcaacctagatgcccatcagtggtgaactggataaagaaaatgtggtacatatacaccattcaatactacacagccataaaaaagaatgaaatcatgttctttgcagcaacatggatggagctgaaggccattatcctaagataattaatgcaggaacagaaaaccaaatacttcatgttctgtcttataagtgggagttatacattgagtacacatagacataaaaaggggacaatagacaacaggggctacttttgagggtggaggatgcaaggagggtgagaatctaaaaattacctgttgggtactgtgctcattacctgagtgatgaaataatctgtatgccaaacacctgtgacatgcaatttatccatgtaacaaacctgcctgtctaccccctgaacctaaaataaaagttgggggaaagaaaaactgaatccaagggaaaacgagaaggtaaaaatgtttaatgatcatttatgccgaagtattaatacattgtatctactccaaatccatgaaattatttttagatcttcttatctgggataaaatgctgtttattgaaattctgctactttcagtgtgttttttgaggccatctgaaacaagggctttgcttttataagttatcttttttagccaagacagatgttcttgacaaacaggtgttctgaagctttattttgatttttagttttccccgatcctttgaaatattgagctgagttttacatgggtcaacctgtctgaaagcataatgctttttttttcttaaacaaattataaatttacatgatattttagttgccagttattttagtaccttcattttgttagataggctcaagcagctgtggatgttaggcaaggctttcagcaccttataaaaatctgccagatctgaaaggaaacacttagcaggcaagtaaaatttttaatagattagtgttatgagttgtataagtctttaggttaatggtacaggtttagtaccccttaaatgaaatgcttggaaccagaagtgtttcagattttgggtacttttggattttagaatatttgcatatacataatgagatatcttggggacagaacccaagtctaacatgaaattcatttatgtttcatgtatatctcatacacatagcctgaaggtaattttatataatattttaaataattctctgcatgaaaccaagtttgcatacagtgaaccatcagaaagcacagttgtcactatctcctgtggacaatctgtagttgtttggcaccaccatcattcctggctctgaattcatatgctactgacaagcaatcattttcttacacttattcacaaattcacacctaagaacttaacaaaaattatgacataccattaatacagtgaaaaaataatgtgtgcagagtaacaaggcaggacagtagaatcaccagaataccagtgtcagctactacacaacagcaacaacaaaaaatggcagctttcagtctctgcctttgatgctgttttcattaaaagcctactgtaccctctattttatgtcttcaggtgagaagaaacatcagaagcagttgagagactggaagtgggtcctctagggatgaggaggcattctgctggatgacttctaaaaatgttttctatggagtcatctgcctcattaacaagtttttgttttagaagtctctttttgattttgtaaactgacatgatttctttttctgttatgactgtatgctgctttagtccttcactaggcccatcacacatttttaccatgtcatctataggcactttttctgcagcgttaacagcatcatcttcattgtcattattatagattgagtatcccttatccaaaatacttaggaccagaagtgtggagttttccacttgtgaagttgtgtcagcactcaaaaagttttggattttggagcattttggattttgggtttttggattaaggatgttcaacctctaataattctcgtcagattagcataaatttaaaataatgatacctctgaatactcagaaaagaattgaaggccatttttgggggaagagggaaagggctggtatcatctacagactattttgaatcacagatttatgtttaccgtgattgttagctaagatttaatctcaaatggttttaagttttttggtatttgtagtctttttttttttttttttttttttgtcctttttagggatctgcctgcctcagcctcctgagtagctaagactcgaggcacataccaccatacctggctaatttttaaatttttttttgtagagacaggctatcactatgttgccttggctggtctcaaactgctggcctcccaaagcactgggattacaggtgtaagccacagtgcatggcctgtagctccttcttcttctaatattgagttactaagtttatgttcagatatttttggtattgtatgcatttgtaaatcctattaatttagaatacatgactctccatattcagtgtaaaagatttgttatttataataagacaaatccttttagcactaataaatttcagaggttaattcttagaaatctagggattacagcaaatttgatagctgtttagttgagaaagataaataagaaagtatattaaagtatattgttaatgataactcaaagagatgaatttagttggtcacattaaaaacataacaaagtcaccataagcgtgtgctgctattgatccaatgttttaattgatggtgtccaatcccttggtgttgatcttacccattacgtctgcagaaaagacctaattataagctgcttcccctgccacagtagttgtgtaccctttgattccttttcttttttctaacgcaggccagacggttttgctgtctcagcctactgtggtacaacttcaagcacctggagttctgccctctgctcagccagtccttgctgttgctgggggagtcacacagctccctaatcacgtggtgaatgtggtaccagccccttcagcgaatagcccagtgaatggaaaactttccgtgactaaacctgtcctacaaagtaccatgagaaatgtcggttcagatgtaagttttgaaacttagtgcttctcttaatgcctgatttaaaaaccaacaaaaaaacaccttttgcttttgttgccttgtttttgttttttttagagtttcttatattgcatcaaataaaagagtgtgctgaattgcacatctagtctttggaggaaaattagggtaaggcttactacgttagaatctaagtgaaaaggtttttgaaagtgaagtggtttgatgaaaagcaaagtatgcatacctccctcttctttactccttctttagaaccaaccctcttattattctcttcaagcccttacaccctcaacccagtcatccactaatattttacagattcaacgtttcctgattgaaatgttttagcgatcttcagataagagtctatagattactttttaggtaggttttatatttagctttcttccttgccgttttgaagtattttcaccacttcataatgatgactagctactcttaggaattctgtctcttagtgattatttggtactttcccatttttgcaaacctttaaattttctagcatgttgtagggatttcttataatttataaatcacatagtttcctaagacctgtcactctctaaagccagttactgcacttgccaactaactcttgctttctttcaaaatgattggaaataacttatgtattaaattgaacatcttggtcctaaaatttaatgaatgttaaagctatatagtcaaacagtggattctctaaagttacgattgggaaagcaaagtgtgtatgttttctttaaaataaaaatggatactactagttgttaatattactacttcatcctttctttaggtagaatgcatttgaaaagtaattttaaaatcctgtgggttatgcaaggttgtttatcagactactgtctgatctgtctgccagaatttattaaccagcatgtcagtgacccatttaattataaaattgctccacagttgcataaacagtaatctcagccagcaatattgtaaaaattcataacaaaggaatattgtctggtgaaagtagaacatccagtttctagaataagagtcccatcgtttgtataggtattgaaaacaatgcatgtcaagacatggaataggaaaattagtgttgctatgagactagagaccatggacagtacaggattaggcttgactgttatgttggtttgttttgaggactagaagaggtaagcacaatgcttatggcataataggctctaatacatagcgtgtgtttcagttgaagatgaaacaatgttgctgggatgggaaggtggtgagcacaggatagaggcaactggattggcaaaatgttgataatgatggaagctgggtgtttatttttctatccttttggtgcatggaaaaatttctacaatatgttaaaaaaatgacaataacaaaaatccaaaagctttctgtgatattttcaattaaaaagttgtgtgaccaataagaaaagagtatgattttcatgggagaccaaccaggttaagaatgatgaaaaaggatttttaaaaataatgctttgaaatttctttttttttgttttattatactttaagttttaggatacatgtgcacaatgtgcaggttagttacatatgtatacatgtgacatgctggtgcgctgcacccactaactcgtcatctagcattaggtatgtctcccagtgctatccctcccccctccccccaccccacaacagtccccagagtgtgatgttccccttcctgtgtccatgtgttctcattgttcaattcccacctatgagtgagaatatgcagtgtttggttttttgttcttgcgatagtttactgagaatgatgatttccttttaatactcttttaaattatgaacttgaatgtttcttatataatacccccaaatgaaacttataatagaaaatatccaaagttgcctttatgtaatatgttaggacatttaaaatatttttatgaaatattttagacatgaaaaaaagataaagactaattagaactttaaaaatacataggtcaacagtatatcactgttgttaaaaaatattaacaatattaatctaagtcatcccaaacatggaaaagtccagaaaagcatagctaggatggggagagtatctagaaaccatggggtagaggagtgggttaaaggttggaatgattcagtaaactgaagaagagaggatggaaagtagacctgggagccatcttccaggaaaggaaggttgttatgtggaaaatagaattgttctgcttgttccagaagagttatctggaacaggtgcaggaaaaatatagaaaggtttcttctaaacataaggttttttgatacaatcattgtatttaaaaaccagaagagcaacccccctgcctttttttttttctacttttaggcttactatctgaataatgagcatcttaatgttgacaatcatcactgtatgccattgacccattttataatctctaaacatattccaattaattatatgttggtctattagtcagacatcctttattagttctctggtgtgaaagactgtgtctgttcagcttttgtactcttaagggggatctgtaaatttaaagtatttttaatgaaatattttagacatgaaaaaagataaagactaattagaagttaaaaaatatataggtcaagagtatgtcactgctaaaaatatgagaaaatgtagaaccaataaatactgctagaaacaaaagctaatacttattggttctatgttttctcatctcacacatcccccagttcttcaacgttaattgagactttgtcagcaaagtctcaatgtatgaatgtctacatttattgtatgaatgtatattcagatgaggttaatttttttaacaatgatataccgttgacctacatatttttaaagttctaattagtctttatcttttttcatgtctaaaatatttcattaaaaatactttaaatttacagagcccccttaagagtacaaaagccaaacagacacagtctttttgaagtttagaattgacaggattataaagaaagattcaaacactttatgtttaatgcaaagagacctaaggacaattagaataattttctagtcaacctgcattgaggtttttgtgcttatttttacttggccagcacatcgagacgtgagccaagcctttcaatatgagtttttttggtagaaattttgactgaatgtttatttcaagtaaagaagcattagtctgtcctagcagcaggccaacccactcaggaacccaaagtaaatctgttccagaaggagttgcagagaagaactttgatcagcttgtatagccttctgtgttagtaacttggttgacctcagtattacatgtgtctgttaaaacacaagtcctattaaattaggataaattaatataaattcctaatttaaaatgatcaaaaaaatattttttatcatataccttttgtgcctttaaaccaaaagtatggtgaaagaattgtaatccaccaaaaaaaaaaaaatcatatcagtttttttgtggctttgtaatgctgacatggcttctttttctaccttttttagttcttttgtttggctggtttcactctccagaggcctgctacagccataagtagcgtttttagcataccatattctgcaaactgcattaaatgccacattttctgttatgaaacagtttgcctggttcaaattatatcttactcttcctgtcttttgctggtaaatctgttttgtttaactcttggagacctcacctaagttttcaagaaatatggtttgtttttggctgtgatcctgatggaaaaaatgaacatgatctctcatttcagtgtagaagttctctgtgcagtttcttagtaaatggcaatcttggaactacaaagttgactttataggacagcatgcttatctttctttaaagggctatttagtgttgccacacatcaaaccaagggcttaaaaacaagcagtctgtttaaatctgcattacactcactacttccacctacccatcataatcgcataaactttatgaaacattactgcccttgttttaaggttataggaattacattgttttagttattggaacaaaagaccagaaaaacaagtggtaaaattctacatcttccacagtgggccacattggagcaaatactcttagtggaaatcagtaggtgggaataatggaaagaaaagtatccagaactgatatagaactataaataacctcagatgtgaggttgatgaagggatacaaactactgttaggagtctccttccttccggctcagtcaccccactgaatatcttccaaactctgtatcaccttttaccctgtttctaaatcctatagttaggaaacttgatcccttccatcccaaaatgacttccctttgggagtccctgtcttgggttcctagagtcatcatgagaaggtaggtgctggggggaatcctttgctactggtttgcaggtattagaaatggtgcgaaggggattctcctgtcataccaaattagaactttgtatttcctttctctagaattggtgtacagttaatttagggatttcaggtatttttagtattgttctatgggagtgatgtgacatgggcctagatggatgccctgcacacagtgttcctctcttgcagtggaggaacatgagcttggagaatctaccatgtgtatagcaagcagaaagcaagcctcctcattgtctagagggagattttatctcatccttcaaggttgcttgttggaaactgaaccttgagaatggcctgggaaaagagtggtccggaccttgcattctttgcatacccaataagacgtgtaggagcaaaactcataagagactccctggaggtgtgtttctcaagaaaaatatgtctataataatctatttgcaatgcatagcaactcagaaaaacagagactgcctatgttctatttcagaaaaaaagcaaaacttcaatagacgttgaagttgcttatctgtaacatccaagaataggacgctggttaggtcaaaatgtgagctgaatctccttaaattatgtggctagcttagatctcagaagataaataatgaataggcacttcttaataacttctaacaacaaacaagttgagatcatgatatttctttaggctgcaaagtagaggaatctatcagaacaaatccaataggaaggatttggagagctggagttatccagggtttagtaaaaaaattacttctgtgctgactgcattgtggctttgctgctaccagggactctgcaaataaaagaaaatatgctttgtttaaatatttgcagtatctctttaaatgtaggtttggagcttctaaaaatttatcttgaatagcagttcagtttcatttgaggttacagtagctttggaaggggaagtgaacagcttttttttgttgttgtttatttttccttcctgatgcattgcattaggataaatttatgttgtggcaacctcagcattctttattctgtactttttgtactttttagtttgtcatcttttttttttttttttttttttttttttttttgagacaaagtcttgctctgttgcccaggctggagtacaatggcacgctcttggctcactgcaacctccaccttccaggttcaagcgattctcctgcctcagcctcctgagtagctgggactacagctatgtgccaccacacccagctaatttttgtatttttagtagagatggggtttcaccagtttggccaggctgttctcaaactcctggcctcaagtgatccacctgcctcggcctcccaaagtgctgggattataggcatgagccactgcgcccagcagtttggcatctttataagaataataaataattatttttaaggattctgatttttatcttaataaacaatgaaatacttctctctcctttctctaatttcccttctcaaaaccttgtggggactcattctagggagacagtccttttataccccagagactttcttgcaaatcagtttccttgtctggtagtcattcttactagttttgtgtgcattcttctggagacagttctttaatatgtaagtacttatagttttatttattgacctatttcatagaaaaggtagcatactgtacatgtcatcctgcaacttgcttttctcacttataccttagagatctgttcagatcagtactaaaaacttttctcattccttttttaaatttttatttatttatttatttttttaaagacagtctgttgctctgttgcctaggctggtgtgcagtggcatgatcatagctcactattgccttaaatatctgggcttaagcaatcctcctgcctcaggctcctgagtagctagatgtgtgccacctggctaaattttgatttttttttttgtttttgtagagatgggggtcttgttgtattgcacagggtggtcttgagctcctggcctcaaatgatcctcctgcagtggcctcccaaagtgctgagattacaggcataagccaccatgcctggtctttttcttattcttttaatagctgcattttaatggctacatagtaacctacttcataggggtgccataattattgtaaaattttgcagtccttttcattataaacatttcttcattgaataacttggtacttatttcattttgttcatatacaaatatatctatgggagaaattttattttatttttattatactttaagttctagggtacatgtgcacaacgtgcaggtttgttacatatgtatatatgtgccatgttggtgtgttgcacccattaactcgtgatttacattaggtatatctcctaatgctatccctcccacctcccccaaccccacgacaggccctggtgtgtgatgttccccttcctgtgtccaagtgttctcattgttcaattcccacctatgagtgagaacatgtgtgttcggttttttgtccttgtggtagtttgctgagaatgatggtttccagcttcatccatgtccctacaaaggacatgaacttatccttttttatggctgcatagtattccatggtgtatatgtgccacatttttttaatccagtctgtcattcatggacatttgggttggttccaagtctttgctattgtgaatagtgctgcaataaacataagtgtgcatgtgtctttatagcagcatgatttataatcctttgggtatatacccagtaatgggatggttgggtcaaatggtatttctagttctagatccttgaggaattgccacactgtcttccacaatggttgaactagtttacagtcctactaacagtgtaaaagtgttcctgtttcactactttgtaatgattgcctgtttcctgactttgtaatgattgccattctaactggtgtgagatggtatctcattgtggttttgatttgcatttctctgatggccagtgatgatgagcattttttcatgtgtctgttggctgcataaatgtcttcttttgagaagtgtctgttcatatctttcgcccactttttgatggggttgtttttttcttgtaaatttgagttctttgtagattctggatattagccctttgtcagatgagtagattgcaaaaattttgtgggagaaatttttagaattggatttgctgggccagaaggtatgtacttgttcagttttgataggttttaccaaatggtcctccattgaggtagttctaattgagaagtcagtcacagggcttaatggagtccttgggtgggtttcagtgtttccataatcagcatcctatattagtcagttctcacacttctataaagaaatacctgaaactgagtgatttataaagaaaagaggtttaattgtctcatggttctgcaggctgtacaggaaacatggctggggaagcctcaggaaacttacaatcatgactgtgggtgagggggaagctggcacatcttacatggctagagcaggagaaagagagaaaagagggaagtgctacacacttttaaacaaccagatcttatgagaacttactatcatgagaacagcaaggtggaaatctgcctccatgatcgaatcacctttcaccaggctcctcccccaacattggggattacaattcgacatgagatttgggtagagacacaaatctagatcatatcacacccctttaccccacctcacctcatccctcatatagttgttagcaatgtgcaagtgcatttgtctggggagtccataagctcttttgttgtctttttttttttaacagcttcattgagataaaatgcacattacataaggatcacccttttgaactgtacaatttagtggtaccatcactgctgtctaattccagaatatttttgtcaccctaaaaagaaaaccccatagtcattagccatagtctttcctcatttctcactccctgcagcccctggtagccatttaatctgttttctgtgtggagttgtcccagacatttcatatgagtggaatcatacactatgtgcccttttgtgtatggcgtctttcacttaccatatttttttcaagcttcagccatgttgaagcatgtgtcagtgtttattcttttttatgactgaataatattctattatatggatataccacatttttgataatccattcatcagttggtagacatttggcttgtctccactttttgtctgttatgagtaatgccactttgaacactcatgtacattttcacagtcttttaagaacgatttttaatatatagagtataaatcagtgagaaaaatgcaaattaattcaaccatcaatggacaatatatacgaatagataattcacgaagaagagtggtaaattttaaaaatgaaagtatcaatggctgtgtattcctgaagggatattccctctgaaagattactattttataactatgtgaaagaatattaattgttagcaggagagatcttgtggctggttacaggtagttcgagaatgatattcaagaatttaaagtgttatggttagacttttctgtggctcttacctcccttgagtatgagatctaaaggaaaatgtcttatggcttcttataacttcccagtgtgtatacactgcggttgtgtgtgtgtgctgacacatgttaaactttggttattgtatgggtacacatgttaaactttatatttagttataattttaaatttcaaaaagtacaaaaacaaaaaatagtacagagaacacccaggtattcttcagccagattcacctgttgttaacattttacccaatttgcttgcttattctttatctacctacctacccatccatccatccatccactatccatccatccatccatccatccactatccatccatccatccacccacccatccacccaccatccaaccatccatccatccatccatccatccatccatatacacacacaatttttttcctgaactattttagggtaagttacatacctcacagtattttacccctaattttttcagtgtgcattttctaagactaggtacattcttttattaacttcaataatttacattaataaaatagttcaatcacctgtcaatattacaattctgtcagtcgaccaaatatttactggattttcacaaagtctttgtgaaggggacattatttattcccattttactactgaaggaatcaactagctaagtgattcaacaaatgtcatattgctaagatggctaatattaataaagtactatgtgccaggcacttttctaagtgcataacttgtaaatactctctttaaatcttataacagctctttgaaatgaatcagggccctgaggaatacagagtaaggaacagacagagtgctcagaggaatgttaagttttaggctctttttctgcttctttagtgattaaataacatttcatgctttgtgtgtgtgtgtgtgtgtgtgtgttttaattttaaaacttaaaatctgaaaatgggagctggaatgggagcaggtattttctttttttttttttttttttttttttttttttttttttttgagacggagtctcgctctgtcgcccaggctggagtgcagtggcgggatctcggctcactgcaagctccgcctcccgggttcacgccattctcctgcctcagcctcccaagtagctgggactacaggcgcccgccactacgcccggctaatttttgtatttttagtagagacggggtttcaccgtttttagccgggatggtctcgatctcctgacctcgtgatccacccgcctcggcctcccaaagtgctgggatcacaggcgtgagccaccgcgcccggccaggagcaggtattttcaatattgctttagttgcatggtatatcagagcagctgtgaggtacattgttgatggaagtaataattttgcctcctctgtgtgtgtgtgtgtgtgtgtgtgtgtgtgtgtcacataattttcctgaaagccatatttgtatggtacattatagcttacagagaaccttcatgtctgttacacagttgattctcaccccaatcatttgaccacttataattgagttaggattcaagcctagctcaattataactggtcttctcctaatccagtggtgtcatcattactctgtgctccattaatagagcctttactttcaaggtagtcctgatgcagctcagactttaaattacccacgtcctttgcttacaactttatgggaaaagaaaaaagaaaaaaaaagaacaaattacccaagtctcgaaacttgctgataccttttttctccctttacaaatgttttttcttaatttataaaaattaagatagttttaagatttaatttttaaaaattaaggtagcagatagttttaagtcatgagggacaaaggtttagaaagattgaccttatttgaataatttggtggtatcaaatgaaacctgtagcaaaaataatcagatccatatttcattatatagtagtcattattgtgctatgtcgttgtgccaattaaattaagtgtatctatttagcatcagccccagaattattttgtttttggattggatgagacctttagaggactaatgaagtggctttaaacttttttgtacacagtccacagtaagaaatgtatttaacctctctttctctcttatactcaatctcatgaaacaactcttactaaatataatgcaccctttttcttttattctgtcctgtgcttttctgtcaaattgtttttgaaggctgtggtgatttactaaattgataaacctgatattgggttataataatgtcataagcactattctggtctaactctctctttttactaatatgtaaatacaccctacaaggtgacgtgatttatttttatttttatttttagattttccaattaattcattgcaatgctgggccaagaattaaggactcctaacttccaattttgtattttcatttaatgacttaaattactattacttttatttagttgcatcaagtatttcttttctttctttttttttttttgagatggagtttcacttttgttgcccaggctggagtgcaatggtgtgatctcggctcaccacaacctctgcctcccaggttcaagcaattctcctgcctcagcctcccgagtagctgggattacaggcatgcaccaccactcccagctaatttttttgtatttttagtagagatgggttttttccatgttgaggctggtctcgaactcctgacctcaggtgatccgcccgccttggcctcccaaagtgctgggattacaggcgtgagccaccgcgcccggcctccatcaagtatttctgaagacacgtgaagcagtggagtcattaactgaaataacaggaaaccattttgaggctcctttgaagatccctgtgttcaggacttgggtccctctattcttcaagaggctgtgcccatggtgtggctttgctgagagcatctggtgcatacttctgcttttacctctcttttggttgttctttatcttcattcagaagatgagattggtagggtttccccatcctataacctagcagggactttgtctattatctgttctcattctggaaactatactacatatcagaaggcattcttcattttaaaaaatagaaggaaatagtttgcaggatgaagattatttccttgataatctgccaaataaatggttcaggttgccagtatgaagcttctttaatttttggcaaatgggagctggttatatgcatacatacacacaaaacttaatagaaagagtaaaataaaattttgactgtcatgagattgagaagagtagagatagtgaaagtctaaattttctctttttttctgctttaaacaatttaatgagaaaaataagtgtacgtaagattcttaacaaaaatcaaattaagttttttaatgtatttgaatatttaaagtaggattgccacaaattaaatttgccaatgattttaactatgtgtgttttttaagaatgtatctataaatatgtttactgcaatacatatgcaataatgtatgttatgtaatttttatttaattgaaagattgtatttttatttttggtcagttacagtgaagaggttaatcagtaatggcttccactttatctatcagtttagagggcaagattcagccaaatgagaataagaactgttagaaagatgtgcagcaagtcaatgattaccatgtgattcatccataggttatcaatacttgatctgacttgagtttacatgagatattcgaatgtatttcttagcataaaaatcccattttaatttttttttttttttttttttttttgagataggctcttactctgtcacccaggctggagaacagtgatgcgatcatggctcactgcagcctcaacctcctgagctcaagtgatcctcctgcctcagcctctagggtagctaggactacaattgtgcaccacgatgcccagctaattttttaattttagcagagacgaggtcttcctatgtttcccaggctgttctcaaactcctggcctcaagcgttcctcctgcctcgacctaccaaagtgttgggattacaggtgtgagccaccactactggctcctatctagtattatatctaatttaatttatggtcattgagctcatttcttagcaacatcacagaaacaaggctttagtcaattttattaataaaaagagactataataacttacagtgtttatcaatcaataaggtttttagttttaaaaaccttattgattgataattaaattgataattaaattaaaacaagctgggccagcactttgagaggctgaagcaggaggattgtttgagcccaggagttcaagaccagcctgggcaacatagagagatcctatctctacaaaaaaataaactagccaggcacggtagcatgcacctgtagtcccagctactggggagcctgaggctggaggatctgttgaacctgtgaggttgaggctgcagtaagctgcaattgtgccactgcactccagcctgggtgacagagtgagattctttctcaaaaaattaaattaaattaaactaaaaacaaaatgtggacgtacttgaaactttgactcttacattgattcaaccttcaaaggaacttgtccatttgtgaaagttttccttttatataagtctttcttacagtcaaataagtgtttactaagtgaaatactacattttatagtgcagtggcactcaaaggaaactattttgcagctgtagagttttttcttttgtcctttttactttttccaaggcaagatgcctggtgggagagttgtctggaggcaggatgatcagaagcaggacctggccagctgttcgcttatttcagtctgtatgaaatcatctgatatgcccataagagagatgtgtcaattggctaatgggtcagagtattgattttatgttttcagattgctgacagagagattaggcttccagatacaagcagttccacaagtctctgttttcagacaggcacataattaaagtaaccacacagttctctgaggttagagttccatgctgtgatgcaagcctctctatttggtatttaaaagcagtttgaagctgttgtgtaagtatcactggacttggagtcaactgacctaagttctagccttggcccttctactgtcttaacagtggattaaatgatgaggcttattttaaagaatcttgaaaactatagtaatttcaacaagaggagattaattgaatatattatgaaacatcaagataattgaaaatctgtgctgccattattgcatgtcaaaggtcattttgatacactgtatgtgcaaaagcagtttaccaaacagaattacatacagtgtaatcctttttttcttatataggaaaatacccacttccccccacttaaaaaaataccaaacaccacaatgtgtgtatgtttagcctacaaatcatattttttttgcctaggaagtattgaataatttaaatattttatattcagatagctaaagatggcttgctgagataaaacattggagccctgtgtttggtgatagccgtgggtttcatttatttttactgtctttatcctctgtatttattgatagtattgaatatttattttcagaactattatagtgtatctgtttctatgggaagaaatgaatatttgaccacagatggttttcatttttttagtatggggcacgtggattgacagcctttgaaacttgaatgctgtgtaatattcaggtgcttttattgtttatagaaatgcctaatccttgtttgaaatttattaaatggtatgccatctgtaagcccctctaaattccacagattaattagcctttaaagtaaggttgccttttgtctaacttttagtataaactcttccatctgggaactttcacttttatgtccctgttcagtgttctgtgtacttcagcactctagtattaattatggacactggcattctaagtaacatgaagaacactaaaaataaaagtagactgaacaaagtggcaatgtccggagaatagtttgcatttggtgaataatcaatccatcatggctttgccattgctctttgtatgtgcgtgcgtgtgtgtgtgtgtgagtgtgtgtgcatgtgcgtgtttagcattacttaagagtgagatagttattcttcagggaaatttttacagatgatggtttcacaaaaatcagcctttttgtagtttaaataaaaaaacaccctttttgacatttcatgtaacatttccttgtgggttctgatttaaaggttgttgaaaatatttggtgttggcagatcacttggttggctttggcatacttctctttctaggaaatgtagtatcagggtgggaattgtgttgttgttttaaaagaaatagattacaggctggcacggtggctcacacttgtaatcccagcactttgggaggccgaggcgggcggatcaggaggtcaggagattgagaccatcctggctaacacggtgaaaccctgtctctaccaaaaatacacaaacaaaattagccaggcgtggtggtgggcacctgtagtcccagctactcgggaggctgaggagggagaatggtgtgaacctgggaggcggagcttgcagcgggccgagatctccccaccgtactccagcctgggcaacagagcaagactccatctcaaaaaaaaaaaaaaaaaggaaatagattacattctttaactttatttactggtctcagtaagagttattgaacactctagagtgtttactttttaaagtccattgcaaaatatatagaaattagtaattcaaccatctgtgtactcatactaatcaatgtaatataggttggcgctttttatgcacttaattttgccacctctctcacttccccaaagaaattagactaatgtataacaataggcttcataacttaatttagaaaacataacaaaaataatttcgctcagtaagtttctgttgtagtagatattgttggtattaaacaaaaaagtaggatcagatgtggtttggctttcaaggtataaaatctaggtggggaaagagagagagagttaacattcttgaaacaattgagagcattagagtgttccagtatatcctccaaattctaagggtataagatgttcagagaaaataaaaaatcagggtgggttagaataattgagttcaaatggaccttggaattaggttagtggaggagatagcattccaaatggaaataaacaatgcgaataaggaaacatgttagacatgtatggagattatgaagtagccttaaatgataagattggaggagtgtggcttgaatagctgtagatttagggcagaaggtctggttaggccgtgggaggtcacaatatggaagaccttaaaagaaaagatgggtagcagggatacatgactagcttgtttttgcaattgagtagtaagataaaaatattttcttaggagaagttatcttagaaatggtggacaggatgagatggaacacaattgaaataggagtctgttgcagtagtatagggatgagttaatgagtgcctgtattaggagagtggaagagggaatagagagaaagtaattactgagacacattttcactggaataaatttggtcattagtatatacttttaacatattcaatgagtgaatgagggattgagaaggactgaatatagtgaataaagtaaaataatagttactattgatagaaaatggatagatttttaaacaatctagttagagggagatagttcagtttgcacataatgaatttgaagtggtaataactgtaagaagtggccttataattaattgaatatatggttctggggcatagccatttaagggccagagatacagatttaagatgtatgtatatatgcatatatatttaaagatactttctgagggagtttctaaggggaaaattggaagattaataaacgagccttagaaaacataagaagaaattatttaacatttgggttttagaaggccttatttaatcatttgattttaacttatttagtttgagcagtgtgttttcaaacctcttttgaaacaactagtaacctatgctttgaaaaaattgttggttaaaataattgtaaaaatgagtatattctgatctattttgatctgattttaaaaccagggtattctgattcattataactttttctagattgctgtgctaaggagacagcaacgtatgataaaaaatcgagaatccgcttgtcagtctcgcaagaagaagaaagaatatatgctagggttagaggcgagattaaaggctgccctctcagaaaacgagcaactgaagaaagaaaatggaacactgaagcggcagctggatgaagttgtgtcagaggtaagtgttagtaatacggctgagtcgagatgggctaaagtatcctctggattaataaatagagaaacttttacattttaaattaaattatgtaaaataatagtgctaggaaaaggagggtataataagtcctaaaacatttgcagtaaggataaagcatttgaaggggaccctttgaattgtactccccaatctacatagaaaagttgtctccttttcctaggtttctcctcattcattgccttagcaccctcttttctggctaagtgaatcacactgaggcttctaaagtgccctgccatattttcccttttaaaaaagaaaacaatataaaagtgtttttattttttctcagtccacctaacaactaatgtgatttttgcattctgttactatgctgactccaagaggttttaatctcctcagttctattcgggaaatttgctgttttcagaatttctcactgcagtgctgaaccatatagatgcctactgaatggggcttcttacactctttttctcttggccctgagtacatgggaatactcctatattttactgaaaacaatgatttaaaaggttagggaggcaaactatagaagtgactcaaaattctttggggatccgtaaaaatataaaaaatgttgaattctggtcgggcgtggtggctcacgcctgtaattccagcactttgggacgctgaggcaggcggatcacaaggtcaggagatcaagaccatcctggccaacatagtgaaaccccatctctactaaaaatacaaaagttagctgggtgtagtgcacacctgtaatcccagctactcgggaggctgaggcagcagaatcgcttgaacctgggaggcggagattgcggtgatccgagatgatgccactgcactccagcttggcgacaaagtgacactccgtctcaaaaaaatatatatacatatatatattgaattctttcctcttgggtgaagaggcaactgcaatggagtggctgctgtgtttttttctcttctgcttctctccttttctctccctgctggaaaagggaacctggaagtctctgctctagtcttgaaaagtgttatttcctcacctttgattttttttttttttttaaataagacaaggtatttgtaagacaagagatttacgtaaccggtaaagaggaaaattctaatcttaagcgttgctttttctgaaatcgatgttagtttaattgtatttaatgtggtcatttcctttagaaccagaggcttaaagtccctagtccaaagcgaagagttgtctgtgtgatgatagtattggcatttataatactgaactatggacctatgaggtaagtgaatagatatttattttggacactaatgctaaaaacttaaattctcattattctttagcttttgtcataaactagagaaaaaatgatttgtttttcaagatgtgtaaagagtaatgagacaggagccatgccttcaaagatctcatgatccagctgggaggagagacaagtagaaggatgactatggtataatgtgatgaacataataataacagtgtgaatgagtcctaacataatatagagtacgagttccttgaggtgaaggttcttgtcgtattgatgggtactcgatacattttttgttgagtgactgagttataagggagatacctacgaaggaagctgaacattgaactgtaatatcagtttgccatgtgcaaagtatgagaaaggcatgccaggcaaagggaacagcatgtttaaaggcacagttatgaaatggcatgacatgttcataaaaaagtgaaaagttcagtgtatcttgtatatgtggggagtgtgcctgaggctagatatatggttagaagtataggtgctgctgtgtacaatgaggcatccctagcttttaggtggagggtaacataatcagctttgcatattaggaagaggactttgtgtgttgtattgagtatagactgcagtgaggagaaactattggcagagaaagcattagaagactattgaggtgtttcaggtaataaatgagagtctgaacttacactatggttataaaaaggatgagcaatcttagggtacctctctgatgtagcttttgtgggatttgttaactggtataatgtgggacatgaggaagaaaagagggaagttaaggataattcaaaaatttctaccttgagggaccgaatggtggtgctgtcatcggaggaagcaaacatagacagatggatagttttatgaagaaagacaatagtttttattttaagtataggaagtttgtggcactgactagatattgagaattaacattatagataggtaggtagactgacagacagataatgttagtggtgtagatgagattatccaaggagaacaagtagaggaaggaaagtaacaagaatctgggggacaccagtatgaatagtagatagccttgggaaaagaaactcacagcatattaggggcagaactgaaagaaagtagctttttgaagccaaagtaaaaagagcttcaagcaggtcttgggcagtggtatcacatgctgctgagagcttgggagatgtagaaagctgaatttggcaattatcaggtcagttgtaatcttggaaagcagatttagtaggggtaggcatgaagtctgtattaaaattggttgagaaattgaaaggagttaaaattgaatgatctcttttttaaaaaaaaacattttttatgaagattttcaaacatataggaaatttgagaaaataatatgatcaaccccttgctctcatgaaatttataatctaatataggtgacatatactaatcaaaatgatcacacaaataaatgcaaaattgtaacaatgttaggtgccatgaaggaaaggtacatgatatcatgaggccacataatagggtcacttgacctagttagggaagtaaggcaaggtttctctgagaaagaggtgattgtgttaacatctaaaagaagattaggaattatttaggtaagatacaggaagaacatttcatatagaatatataaacatctattcccacatttgtgttgtgtctttgtgtttatatgtatttagtttaaaaattttggttttacatgaaacaattatatacaaattgtgctttctttaaaatatgtgaatacattattctcttttaatactacatagttttttgtagtgtaaatgtgccataatttagcaattctctttaggtcttgggaacccctttgtacccttaaaagttaccaaggatcccaaataatttttgattttgtggtttatatatactgatatttattatatgagaaattaaaactttaaaaataaaaaatttttaattcatttaaaaataataaaccgtaaaccattactttacatgttaacataaataacatgttaatgaagaataattatatctcccaaacctccaaaaatttagtgagatacagaagagtggtactactttatagttttgtaaaaatattttttttggggggaagctcaaatacatcagttttagtttttctctatatacacatttatttgctactaaaaattgaaatagcatattgaaatttccttttgttgcaatccaaaattttgaaaaccagaaaaccaaattaattattattatgctgtggccagactactcagtattttctttacattctttcctccaagttactttccttcaaattcttaatgttgggttttatctcactgacttcaggcttctaaaacacatggggatacttgagacctattgttgcttctttaggtcaaatcaatagtttcataaaaatctttgatgtccgacttaacaggatctggcaggattatctgttttttcatgtaatctgttatgatatattgtttgggttgaaataaatgaagaaaatttagactcacatcggtatgcagttggaaaagggagaactttgcagactttgaaagacttttaggatccccagagttccttggactgcttaaaaccccagtgcacacttgcccaactgctgccgtaatttatttaaccatcttttgataggcagctagggtatttccagttacttgttgatatgtgtacataaaatgtatttccatatatttatgtgtctgtatgtgtatgatagaatctagactagagctagaggttacgattatctgaaattgtgatagagtttgccaaattgccttccaaaaagactgtatccgtttacattcccactagcaggagagaggagtatccattttctcgcatttcctaacactggatattgtatttttaaaattcttgcctatcttgtggatcaaaaatgttattgttagcctgtcacattggcctgtgtgctcttcctcaaacactctaagcctgctagcacttcatggtcttcactttcattcccactgccggcagtgcccttccctcagagattctttctgtcaggtgttaagctcaaataccatgtacccctgagcttcaaataaaagttttaaaaaagtgattaaaaaacatcaagtttttttggtcaaaattaaaaaaaaaaaaaaaagctcaaatgccacccctgtgaggctttcctggactaccttttctaaatgtctatcccagctcctgccattgcattccctatcgcctttctttcttcatttttctacatagcacctctccccttcaagtatgctatgtaacttatttattttctttctctccctggaggtatttttatctcttttgttttccagtgcttagaacagtggctggcacatagtagttactcaataaatacttgtagtatgaatgaatgtctccctcacccaattagtaggaattatatatgttcataaactatttctcaaaaaactgtgtgttcttttagttcctcatttcttatctggtatacgtggtacttatttatttagtcagacatacagcaaatatttatagagcacttaatgtttgccaggtactgagcaaggaatcaaggatgcaaatatgaataaaagtacagtctagtaagagaatcagatatgtaaacaactgttgtatgagaaagaattatatggatgtcatataaacatataggcattaaaaaaatgaaaaactttttgtttacacacttctgacaccagatatgtggattttctacactgagcaattctccaattctctggacaccaactggatgtcctacaatttgactcaattcttttttaaattttaattgtaaaatattttttattgagacagggtcttgctctgttgcccaggctggagtgcagtggtgtgatcgtagctcactgcagcctccatcttccaggcttaagcaatcccccgatcctcagtctcctaagtagctgggactacaggtgcacctcaccacacctggcaaagttgctcaggctggtcttgaactcctaagttcaaatgattctccttccttggccttccgaagtgctgggattacaggtgtgagccattatatctggccaatttaagtcatttctgacactacctggagctagcacaggctcccacaggttaagggctgagtatccaaagactgcccctgacttcagtcaccagttgcaagtcccaggttgtgacctgtaacttctgactaagtggctataagttgagggttcccacaattccctcttgaggtttgataattttctagaatggctcacagaactcaggaaaacactctatttactattactggttttattataaaggatatgtggggcaagctaaatgggagagacgcatagggtaaggtataggggaagagtgcagagctttcatgccctctccaggtgcaccaccctcctagtacctccttgtgtttgctaacctggaagctctccaaattccattgttaggggtttttatggagcttcattaggtaggtgtgattgattaaaccattggccattggtgattgcacttaaactccagccccctctcccctacttggaggttgagggatgggactgaaaatcccaacccactaattatgtggttggtttctctggcaatcagcctccatcatccaagagtcacctcattagcataaactcaggtccagctggaaggggcttattacggataacaaaagatgctcttcttaccccctatcactcaggaaattccaagggttttaggagctctgtgacaggaaccagaataaaaaccaaatatattatttcttattatatcgcaaattcacaggcatattcttgagggaacatagaagtaaccagtaacgctgctagtggcaatcatgggaggctttatgcagtagtactcgatgaaggaataaagaggattagattatgctacaggaagtgacagtggggttaggggggacatctcattgtggaagccctcatgaatcaatagaattttaggaaagaaaagactggaacaaaaaaaattttttgagtgcccccacccaccagacaaaaaatttttaaaaatgaattaatgatcttcacagctgctgaagtaaaggtggggatggatctcatttccatggtagattgattgattatgaaaggaagagatgatggtccctattttatcaagaagtggtttgtgttcaaaaaggagttagtagaaagaggggattaaaaatcggagaaagcttaaatatttgaaaatcttgaggatcaatcagttaagatctgtatctttctctgtgtgatgctttaggaacagccagcgaagaagtagtgggaatattaggaactattcaagttaaaaaaacatgttaaaaggcttaacttgaagaaaagcatcaaggagaaaagctggaaggaatgaggaagtgtaggaaagtatcttaacaagtcagaatatctttgacaccaacaaggaaatatggaggaaactggctgtgaaatttataaaaaccaagaactatttcttgtagacaaaatttggcatgaacagtgaaatattaaagcccagagaacaacagtgatttgaaagactgaaatttgtccctgaatcaaatgttgggaattgagatgtttcatcatttgtgttattcaaaagaattttttgattggccccattttttttttttttttttgagatggagtctcagtctgttccccaggctggagtgcagtggtgcgatcttggctcactgcaacctctgcctcccaggttcaagcgattctcctgcctcagcctcccgagtagctgggattacaggcacctgccactatgcccagctaattttttgtatttttagtagagacagggtttcaccatgttggtcaggctggtctcgaactcctgaccttgtgatctgcccacctcagcctcccaaaatgctgggattacaggtgtgagccactgcgcctggcctgttttcagtctttttactgcaaggctatgatcttctctggtccgggagtctgccagaggagcaggaacttcccagttgaaccttattagtaaccacctggaagatatttattgaacaagtgtcacatctgtagtcttgtgtatctagaaaccttaagcatgcattattatgttttaattggaaaatgcataggctttaaaaaaaaagattgtgagctctatctgaacttttgttaagtaccacaaaattaagtttgtcagacaaatagacatttgaatcagagatttccaaagtattttaaatttaggaacctaaactcttttagaacagatcacattaccgagtaaagtgattaatgtggtttcagatgttcagcgtagaactgaatgtttgtgccttattggtatgggccaaatgaaaaaaaaaaaataaaacacacaagtttgccaaatattggtatgccttaaacatttcctgaaggcatttggtgatgaaatataaatatatctaatgtataaagtaagagagttttgtcaaaggtaatatgcagcaaagctgactagtttgaagaggtttgggttactgaatagacgtcacacaggaaaaaaaaataaactaaatggacttataagggttaatttttctgaccttatcgatattttgtggatagtaaagaagtcatctagctatttttggcataggattcaaggagctggcccactctgggtggtctataaatagtaactctaggtagcagggactggctaaacaggacaaatgtgaattggttaaaaagaaaatcctcttcttattactcattggggttaattctatgattattagtcatattttattgttgagaacctgaaatttaacccaggttttttttcttttttttaaattatcactacagactctgccttttctactatgctgtaaagtgttactttattttattttttctaccttaaggttaaggaaccttaaccttttgtttttggcaatatggtaggctaaaggtacaggaaactcattgcagtttagcacactaaaaaatgatggattgaaaaaataaatcaaaactcttatttcctggctccactggagacaaagtaagggcttctcagaggccagaaataataaaagataagatgagtctataatgataagctagcattggaagtggtgcttgttctggatatagttcctgatccttgcggcgtagtgtctggggatgggaaagaaagctgtggacccaagtgaggtgggaagtcacaactgaggcctcccttttcctctacccaaataaagccagaacttccaaagaatgacactcttggttgccaaaagaggggaacaaaagttgccctaccactcagggagactgttattaagtacctatcttggttttggctttagttagagtggaaacaaatgaaaagtctttcctgataattctttactcaaagcccctacctaatcaggttagagcctaaatttatactactagtgtgatccccccaaaatcaagacaaaaatgcagtttaggtgggcttatgttggtggtgcctgtaggcacctgagggaattgaatgcaaattcttctcagaagagacactttataaaagaaagtgtccatcctagaaaaactggagacccatctcatatgcagagacacacacaggctcaaaataaagggatggaggaagatctaccaagcaaatggaaaacaaaaggcaggggttgcaatcctagtctctgataaaacagactttaaaccagcagagatcaaaagagacaaagaaggccattacataatggtaaggggatcaattcaacaagaagagctaactatcgtaaatatatatgcatccaatgcgggagcacccagattcataaagcaagtccttagagacctacaaagagacttagactcccacacaatcataatgggagactttttttttttttttttttttttttggtgagacggagtctagctttgttgcccaggctggagtgcagtggcgcgatctcagctcactgcaagctccgcctcccgggttcatgcataatgggagactttaacaccccactgtcaacattagacagatcaacgagacagaaagttaacagggatatccaggaattgaactcagctctgcaccaagcagacctaatatacatctacagaactctccaccccaaatcaacagaatatacattcttctcagcaccacatcgcacttattccaaaattgaccacatagttggaagtaaagtagaccaatatccctgatgaacatcgatgaaaaaatcctcaataaaatactggcaaactgaatctagcaacatatcaaaaagcttatccaccatgatcaagtgggcttcatccctgggatgcaaggctggttcaacatacacaaatcaataaatgtaatccagcatataaacagaaccaaagacaaaaaccacataattatctcaatagatgcagaaaaggcctttgacaaaattcaacagcccttcatgctaaaaactctcaataaactaggtattgatggaacatatctcaaaataaaagagctatttatgacaaacccacagccaatatcatactgaatgggcaaaaactggaagcattccctttgaaaactggcacaagacagggatgccctctctcaccactcctattcaacatagtgttggaagttctggccagggcaatcaggcaggagaaagaaataaagggtattcaattaggaaaagaggaagtcaaattgtttgcagatgacatgattgtatatttagaaaaccccattatcttagcccaaaatctccttaagctgataagcaacttcagcaaagtctcaggatacaaaatcaatgtgcaaaaatcacaagcattcttatacaccaatagcagacaaacagagagccaaatcatgagtgaactcccattcacaattgcttcaaagagaataaaatacttaggaatccaacttaaagggatgtgaaggacctcttcaaggacaactacaaaccactgctcaatgaaataaaagaggacacaaacaaatggaagaacattccatgctcatggataggaagaatcaatatcgtggaaatggccatactgcccaaggtaatttatagattcaatgccatctccatcaagctaccaatgactttcttcacagaattggaaaaaactactttgaagttcatatggaaccaaaaaagagcctgcatcgccaagtcaatcctaagccaaaagaacaaagctggaggcatcatgctacctgacttcaaactatactacaaggctacagtaaccaaaacagcatggtactggtaccaaaacagagatatagaccaatggaacagaacagagccctcagaaataataccacacgtctacaaccatctgatctttgacaaacctgacaaaaccaagcaatggggaaaggattccctaagtaataaatggtgctgggaaaactggctagccatatgtagaaagctgaaactggatccgttccttacaccttatacaaaaattaattcaagatggatcaaagacttaaatgttagacctaaaaccataaaaaccctacaagaaaacctaggcaataccattcaggacataggcaagggcaacgacttcatgtctaaaacaccaaaagcaatggcaacaaaagccaaaattgacaaatgggatctaattaaactaaagagcttctgcacagcaaaagaaactaccgtcagagtgaacaggcaacctacagaatgggagaaaatttttgcaatctactcgtctgacaaagggctgatatccagaatctacaaagaactcaaacaaatttacaagaaaaaaacaaccccatcaaaaagtgggtgaaggatatgaacagacacttctcaaaagaagacatttatgcagccaaaagacacatgaaaaaatgctcatcatcactggccatcagagaaatgcaaatcaaaaccacaatgagataccatctcacaccagttaaaatggcagtcattacaaagtcaggaagcaacaggtgctgtagaggatgtggagaaataggaacacttttacactgttggtgggactgtaaattagttcaaacattgtggaagacagtgtggcaattcctcaaggatctagaactagaaatgccatttgacccagccatcccattactgggtatatacccaaaggattataaatcatgctgctataaagacacatgcacacatatgtttattgtggcactattcacaatagcaaagacttggaaccaacccaaatgtccaacaatgatagactggattaagaaaatgtgtcacatatacaccatggaatactatgcagccataaaaaatgatgagttcatgtcctttgtagggacatggatgaatctggaaaccatcattctcagcaaactatcacaaggacaaaaaaccaaacaccacatgttctcactcataggtgggaactgaacagtgagagcagttggatacaggagggggaacatcacacactggggcctgtggtggggtcgggggaggggggagggatagcattcagagatacacctaatgtaaatggcgagttaatgggtgcagcacaccaatgtggcacatatgtatatatgtaacaaacctgcacgttgtgcacatgtaccctagaacttaaagtataataaaaaaaaaaaaagaaagaaaaatttccagagatacagagccagttgaacatgagcacatgtctgcttctttccctcaaaagtcattaaacacaccaggaaaccataccaccatgaataagagttagaaaaaataaactacagaatcacactctgaaagactatagatatttgaattatcagatagagaatataaaatatattaaaagacagaattaaagtctggtaaaggaacaaaagactaccagaattggccagaacattttgaaaaaaaatctggaaataaaaatttaagttaaaattataaaaacaatgaccaggttaagacagcaaaataggtatacttggaataggaacagctccagtctacagctcccagcgtgagcaatgcagaagatgggtgatttctgcatttccaactgaggtacagggttcatctcactggggagtgccagacagtgggtgcaggacagtgggtgcagcgcaccgtgcatgagctgaagcagggtgaggcattgcctcacccaggaagtgcaaggggtcaggtagttccctttcctagtcaaagaaaggggtgacagacggcacctggaaaatcgggtcactaccaccctaatactgtgctcttccaacgggcttaacaaacagcacacgaggagattatatccagcacctgacttggagggtcctacacccacagagcctcgctcattgctagcacagcagtctgagatcaaactgcaaggcggcagcgaggctgggggaggggcacctgccattgcccaggcttgagcaggtaaacaaagcagctgggaagcttgaactgggtggagcccaccacagctcaaggaggccttcctgcctctgtaggctccacctctaggggcagggcacagacaaacaaaagacagcaataacctctgcagacttaaatgtccctgtctgacagctttgaagagagtagtggttctcccagcatgcagcttgagatctgagaacgggcaggctgcctcctcaagtgggtccctaacccccgagcagcctaactgggaggcaccccccagtaggggcggactgacacctcacacagctgggtactcctctgagacaaaacttccagaggaacgatcaggcagcagcatttgcagttcaccaatatccgctgttctgcagccaccgctgctgatacccaggcaaacagggtctggagtggacctccagtaaactccaacagacctgaagctgagggtcctgactgttagaaggaaaactaacaaacagaaaggacatccacaccaaaaacccatctgtacgtcaccatcatcaaagaccaaagatagataaaaccacaaagatggggaaaaaacagagcagaaaaaccagaaactctaaaaatcagagcgcctctcctcctccaaaggaacgcagctcctcacccgcaacagaacaaagctggacggagaatgactttgacgagttgagagaagaaggcttcagaagatcaaactactccgagctaaaggaggaagttcgaaccaatggcaaaaaagttaaaaactttgaaaaaaaaattagatgaatggataactagaataaccaatgcagagaagtccttaaaggacctgatgtagctgaaaaccatggcacgagaactatgtgacgaatgcacaagcctcagtaaccaatgcgatcaactggaagaaagggtatcagcgatggaagacgaagtgaatgaaatgaagcatgaagagaagtttagagaaaaaagaataaaaagaaacgaacaaagcctccaagaaatatgggactatgtgaaaagaccaaatctacgtctaattggtgcgcctgaaagtgatggggagaatggaaccaagttggaaaacactctgcaggatattatccaggagaacttccccaatctagcaaggcaggccaacattcaaattcaggaaatacagagaacgccacaaagatactcctcgagaagagcaactccaagccacataattgtcagattcaccaaagttgaaatgaaggaaaaagtgttaagggcagccagagagaaaggttgggttacccacaaagggaagtccatcagactaacagctgatctctaggcagaaactctgcaagccagaagagagtgggggccaatattcaacattcctaaagaaaagaattttcaacccagaatttcatatccagccaaactaagcttcataagtgaaggagaaataaaatacttcacagacaagcaaatgctgagagattttgtcaccaccaggcctgccctacaagagctccggaaggaagcactaaacatggaaaggatttataatcccaaaggattataaatcatgctgctataaagacacatgcacacgtatgtttattgcggcactattcacaatagcaaagatttggaaccaacccaaatgtccaacaatgatagactggattaagaaaatgtgacacatatacaccatggaatactatgcagccataaaaaagatgaattcatgtcctttgtagggacatggatgaaactggaaactatcattctcagcaaactattgcaaggataaaaaaccaaacaccgcatgttctcactcataggtgggaattgaacaatgagaacacatggacacagaaaggggaacatcacacactggagactgttgtggtgtggggggaggggggagggatagcattaggagatagacctaatgctaaatgacgagttaatgggtgcagcacaccaacatggcacatgtatacatatgtaacaaacctgcacgttgtgcacatgtaccctaaaacctaaagtataataataataataacaaaacaaaaaaatagatatacttgaagaaagaaatagtgaatgggacgatggatctgaagaaattatatagaatgtaacacagggagacagagagatagaaaatgtgagagatattggacaagaggttatgccaccataactaaggaataaagtaacattcccagtcatgagacatattgacatctgcagctcctgatgggatgcactgagaagggcacagtatcacttctatgatgttcttgtcccaaaaaatgtataacctgaattgtctttaattttattttttatttttatttttagagacaggatcttgctttgttttccaggctggagtgcagcagcatgatcatgactcactgcagtcttgaactcctaggctcaagcctcctgagtagttagtactctagatacacaccaccgtacctggctcatttaaaaaagtttttttgaagtgatgacatcttattatgttgctcaggctggtctcgaatttctgggctcaagtgatgctcctgcctcagcctccttaagtgttgggattgcagatgtcagccagcatgcccagccttactctggaatcttaaaaatattgctaactgagccctacccaagacctatgaagtctgatagggtaggtcaaaggcatttgtttgtaaaccaaacatttttcccaggagattctgaagtatgtctagggttgaaaactgttgtgtgtagttttgtatttctttcttcctatacattgttttgtatagttttgtatttctttcttcctatacattagccactatggaaattgtaaaagcacttattcattagattataagataatgtacgtaagggaagtttttattaaaatgtctctagacagacacctctgtatagataggtttgtctcatatacttgaggacatttatggacctctgttttggacagagtaggggccacagcataatctgtgaagggaacttcttcctggcacataggattgcagattatagattcctttgttatgttttcccctttctattttaaaggtcactatagtcatcctcctttgctgcaaatcataaatgaacatactaaggaggttttaaatatgttttagttaggtcttaaaaaaattaacaaatgtttggaattgacagtgcttttaccctgtttttgttctgggttaatgctgcgccctcactaggtctggaatctttatagtttgagacatcagacttggatgaggaagggtaaatcatgctactagtgggccagttactctgtggttttcttatgagactgtgctttaaggaaaaggtaaccacggagcatatggcattgagtttgagtcatgtggaactggttagaagtaaaatgtttctattccagcattctctgagtttgtcagcttttcattattttataggaagaattctagcttcttatcctgagatgagcttgtctccaaatctggttccaattttttgttgttgttgttgagcacatttcgccatatgatatcactattggctgtaggttaaaagttaccgtgtaacttaaacgtcagaattcaaaccaccaagtatacacggttttgttcagccagatttttaaatgaaatctaatttgagtttttggctaaaagtactttccacatttatcaaagtgacacatgaactgaagaaatacaatgtatctgagtaccaggtgttactgaatctggaattgcaggagggtaacagagccaaaggcagtcctttcctcaaatagtcttaacgtattcatgtttgtcaaaaatgtgtctacacaaagtaattggttctcttttctctgtagatttcatcctttgttgaaaaagatgtcttagaacctatcaagtgcagagctgggttttgagggcatggaaaattctgttgatgcttttctctagttttggctttcatgtgagttgtacatagggaggcttataaggagcatcctagtggctttaccttgtatcacttggctactttttccccacacttcattgttgtaatgaagggaaaggcagctgaaaccagaaacctacatcccttgccaacttaagagataaaaggaaatttatctcttctgctttctacctagtgagaaggggtcggtgagaaactaggccaggtgagaaaactactatcagagtttaagttgagtacttcgatatgttcttcagaccatacatcttagttaacataaaacaaggactagtggatagtttgtgtgaaatagcattttcaaccaccattttcagtacttaatatagctgggtggaatcatgctgtgtaagtgctgcagaacataaataataaaggaaataaacatcttaattttgtaacaagtgaaggtctaggctaatattaagggtagtataggatacttttgaagcttttgaatgtacagaagtacatatgtaattattatatattgcttagacttctaggcagtttgccattcatgtcttttttgtctccagattgagctgttttgtcacattagtgagcatttgaaacataattttaagtgtcattctacaaatggttcttaattgatttatgactaatgtcagtatgaactgcaggtgtgtgccgtgcctttggactttttggtgtctgtgtgttctgaacataaattggccttagtatgttatgcacactgtcagtttatcacaatccatggcctctgaggagccagaagtacggaatgtacagacgatctatgtaccttatattattttctgtctcagccctttcccagaattcccaataaagcagatttctcaattacttgcttttatttttcctttctcccatttttttttttttggtaaattaacaatgagagataaatggaaataaggcagttggaagaaaagaggatgaaaacaggtgaagattcttagttgtggaataagctaggttggctatgggttgataccatgtgtgcttgggtagtaaaggtagctagttttttctgcgtgttgtattaagccattatttatcaaatactaattacgttttatgcactaaatactagtccaagtattctatttgatatatggattaattcatttgttcctcctagtgccatgaggcaggtattattattcctgatttacagatgaggaaaccgaagacacagctaatatgtggcagagatcagaatcacaatctgcctctggagccttggcttaatcactgacagagcaacagccactcaggcagagaaaaaggagttggcatttacagttagaggagttaggactttagtaactctgcccgtttccctaaagcttaggattggctgtgataggggaaagtagcttatgaattgactggattgatgtaagtataacagaaaagagagattgtactcaaatttacagccatgttttttgacatttagaataatcagaggatacttttctgtagtgagaaatatacaaagagttgttcacacacacaccttttatattaaacactgactcagtgatgtcagcaatctaattactatagagtatcagttatctaatactgtggaacaaaccaccccaaaacctaaacgcttaagacaacagcagttattattttggtaaagaaatctgcaaattgggcagagttcaggacagacagttcttctttgcctccgtggagtgttagctggggtggcttaggttggaggacccactttcagattggctcattcacatggccagtaagttggtgacggctttcagctgggacctgagcctgggatgtgggccagggttcttggtttttcttcatttggacctctccacagctgcatgggtttcctcacagtttagtgtctgggttccaagaataagcatcatctattagaatagtgcttgctttataattgcttattgaatgaatgaaagaatctcaggttgttttcttgctcatgttggcccatttggcaaatagccactgtaaagtgcaggtttcttcccagagcacggtaatccctggctctgagaactgctatttagagggttcttttatcttgacttgaaggtctatttcttcatttaaccacatttatgtttctaataaattacccccagttactactaggctgcaaaaatcatctctgaaccattcaataaacagagaaaagaaaacctttttaaaatttggaaactaccttgaaaactccccattttttcctccttttagtctcagttgcattgaaagttaacataatgttctgttcctggatctggaaatggtgtaatagtgacttcaccacctgccattcttgagttgtgggttagtttccctaaaatgtagatcttgacaagaggcagatggtgcatgaagtttatttatttgtttattttttgaaaaaggaatacctcttatgaaccaggaactagaacaccccttagcttacattctaacaagaagagagacaataaacataagtaaaatgagaaaattataaattctttggacaaagggataaagtatagtagggtaaatggttttacatgttgaagggtagttgttgggactgtagttttatttacttatttttaattttttttgaggcaaggtcttgccctgttccccaggctgaagtacagcaatgcaatcacggctcactcagccttgacctcctgagctcaagcgattgttccacctcagcctcctgaggagctgggaccacaggcacactccaccacacccagctaattattgtattatgattattattatcgtagagatgaggtttcactgtgttgcccaggctggtctcaaactgctgggctgaagcagtctgcccaccttggcttcacaaaattccgggattacaggtgtgagccactgttccctgccaggactgtagttttaaatggtgatcactgtaaggcaggtgtttgagccaaggcttaaaggagaggagagggttagccatatggatatctgaggaagaacagcattcttggcagaggaaacagccattgcagggatcctggggtggaaatgtgtcttgcatgttcaaggaaaaacaaggtggctttgctaaagagagagtagtaggagatgatgtcagagaggtgagatacagggagaggtcaattgaggtaagacttctgtcgttttaaagatttgggcttttaccatgatagaaatgggaagccatcagaaggttttgagcagaggtgacataataatctgacctagattttaaaaggatcactttagttactatgttgccactagcctgaacctggtaggcaggaagacaagtgtcctgctctgtgtcatctttgggctttataaaccatgttccatctgttgtctcatttgaatctcaggaaaaccttgtgaaatatttgttatttttcatgttttacatgtgaggaattggaggcttagagaagttgaccaagtatcccagacatactcaagtgagcagtctcagagtaacatcttgaacccagatctcctgtctccaaattttgtgctcattccactatttcacattaaaacctgaagatctccctgctcttttcatcttaacgtaatttcagctttttgtgtgtggctctccaagccacagagcagcagcagcttttgaggataagaagcagtttcttttaaggataagaagcagtatggttcttacctggtaagatggcttgaattcaaaattgacctacttgtaccataagaaagcaggtttgcaaggagtagaatagacttggagatatgccattttttgttcagctacttggtatgaagactgagtatctgaaaccacactgtaaggattaagtggcttcataaataatctaaaacagttgttggcttttagaatttaataaatgaaaaagtaaggtaacaattcttataatactttttccagactttcggggaaattgaaatcatttgtgttttattaatccatgcttttcaggaccaatggcccataatgtgagcaaggtttattggtgtaatgattattttgtggcctaaaactactgtgactctttggactagcatgtttctgatcatagagacagctagagacttcttcttttttcttaatatttgtagcttgttttaaacgtactgagtagaacctgatttaagcaattatacaaagtttggttagattgctttattaatattatgaactagaaacagtcaccaaatgcgcattcattatactaatccttactatgattgagtcatttctttgagttcttggaaatctaatttttctaaaattaacaaaaggggacatttgaatgatgcaaaagcactcatggcaagaatctaaaagttcatataaataataattttctcatactcttttatacatttgaccattacaagatctgtcaaattcctttcaatatttgtgatgtcacagtcgtactaaaacaatcttgaattctggcagcgaaatgaagttcttacctgtctttcagatgttaataaaaataagggaaatacaaacctgtagttattcagatggttaaaattagtttctgtgggtcatttcatagagttcaagtatttaaatgtttttttagctgaattggacaatcaacttgtctgtaatttagcttaagagaaattccattttaagacaaaaaaactacagggaatgtaggccaaaaaataataacaaccaaaaacaaacaagtgaaaaacgttaaaagattcttagcagaatttattaatatattacctcttcaaaatatattctagccaatggatagataataaaattgagacccacagactatttggatcctaaattttgtttcatcatgactcccttgttgaaaatactttattgactctgtgtaatgtaaataagataatttttgtgaagctcattgaatgcgtctgagctccttaactcaaaaaaggctaaaagttactgaaatagctatggttaagggtatattgtcattacaatgtgataatcattaccaaagtgggcacttggaaaaatagtgaccacttatgagccaaaccaatcaacattaaaactgatttccagtaagtacagctgccaagtgattatagagcagcctggatacagatgggatagactacaaggatagttaagctcaaagcatttgcctgttaacagccatgaattgtgaggtgaaatgccagtttacatagtgttagtaaaatcattaaaagaacaatgattagtagaagaattctttacaaaccttaaagtatcaatagttctgaattaattcaatttataaattatccataagtcatacaaatagccactttgtactttttcatgtccctccaaactcccccagtccctatttccaaactgtccacttctgttgaatctattgtaaaaatgtgtaccttttagggaactgagataggaaagatgtgaaaaacaggattagtttagaataatggttctcaaacattggtaaagtcacctagactagtacaaccactgcggaaaacagtgtggagattccttaaagaactaaaagtagaactaccatttgatccagcaattccactactgggtttctacccagaggaaaagaggtcgttaaacaaaaaagatatttgctcatgcatatttatagcagcaaaatttgcaattgcaaaaatgtggaaccaacccaaatgcccatcaatcaacaagtggataaagaaactgtggtatatatatatgatggaatactactcagtcataaaaaggaatgaattaatagcattcgcagcaacctggatgggattggagactattctaagtgaagtaactcaggaatggaaaaccaaacagcgttatattctcactcataagtgggagctaagcttgggatataggtgcaccaaaatatcacagatcaccactaaacaacgtactcatctcaccaaatgccacctgttccccaaaaacctatggaaataaaaaattttaaaaaaagataattattaatccagtttttggtgaatcagtgagtgacagtggttatagtagtggtggtttaaatcaaggaataaatgttttcaaagtgaaaggagcacatcctaccacacagttcaaaaacaatcacaaatatggcaggcttgctgagagctttcatacatcatttattgtcatgcacttgtatgattattgtatactgtacacatttttattttacaatgatttgtattttccaatgcgtttattgcagttcagtgtggtagatggctggagcctatcctggtagctcggcgcacaagtcaagaattaaccctggacagggtgccatccctttgaagggtgcactcacgcatgttccgcacactcattcagactggagccatttagacgtgccagttaacttaacatgcacatctttgagatgtgggaggaaactggagtacccacaggaaactcatgcagacttggggagagtatgcaaactccacacagacagtgaccttggctgggaattgactttttttttgtcatcagtgttatcacaaaatgacattgcatgaaccagcattgtttgaagacttgctgtattctgattttttttatctttcatctttgagtcattagcaccaaatatagttcttggaacataataggtatttactacatgaataaattaatggatgaatcattcattctgggaaatgttgtcaacatagtgcagtgatggaattccaatcctgaatccaaatcctgactttcttagttatttagagcataaacttgggcaaactgtttaaactctttgagcttcaacttcctttgagccttcatttccttagtacatagtaggtactcaaaagtggtagctactgttaaaatatactgtatttgcatcttagaagagcatttaacattcttgtgatatctttatggtcaagatgggaaattttgacctaggtggtatttcagttaattcataagtagataaacctacgtttttacagatttagaaggagctttttattttaataacaactcagtacaggatattgatggcatgctgatactttcttggaagaatttcttttgctaatgaggagcctaaaagttcttgattgattagtaggtaagtgtttttaaaggaattgatataaattattcagctggatcctaaaactcagttacacaaattcagagttgaggtgggataggaagagaagcaaaagtaatggttcaaaatcgatttgtgtgaaaggacttagggttttaattacactgggctcaatataaatagagtgtaatataactgccaggaaagcctatgcgatattagactgcatcagtagaacaacagtgtctagaacaaatggaggaattatccttttccattctgtagtggtcatactacctaagaagtactgtggccaattctggacattacctctgagaagcatgtttataggacagtgatcaaatatgctaaaggaacttcagactatgctgtaaagaggagcatgtgaaagaatcaagaaactataatcttgaaaaagaaagcctggggtaagggggatgttagatgtctttggacattagaagaaggcttacttagacttgttctggatagccacagaatccagaactagtatcaaaaggtggaagtttttttgttttttgttttttaaaaaggaagcacatttctagttaaaacaaggggaaactcttaataattagggtggtagagatactggagggatcagggagtgagtacttccaccaaacaggaacattagtatatggatatttcactaataacaatagcggggtcagtaggggttgaattaattgagattctctaaacttaggggaaagttcttaactttgattttattcatagcttactttcataattagaatttttggcaccatgcttgaaagaaaaagtaaacactttttttttaaagttagtttcctaaagaagaaataaaatttcttagttgtcatcacactcttcatttgacttccctcccaaattgctattgttttctgcttctctcatgttttcttaaatactcatcagggtgacttttcttaagtttagacagacattccactaggtctcttacctcatttgtggcaaggtttatattgatgtgtgactgctcaggtaaacctttagtctgaatgatacagctatgacaaaatatagcctcagttgtagcaaaattaaatgttacacaatggctttaattggtggtacacctttgaagagtttgcagtatgcccaagtgctaaagcataccatgtgagaatcactgggtagcaatgatttctgggggtgaagaattgaggagaatggaaaatatattaagggatcagaaaaatattctagagaggtgtgtctgctccccgttttcccccaacactgatttccccaaatttggagacaaactactattatctcaaagaaccgcttttcctttagaaccacaggctccttaactaccctttttcattagccttactttcctcttgcattttatccctccaaatagaatcttttgtgcttctctagggagattccctttgtgttgaattttatgagtagtgtaaattgtgtgggttgcatcataaaacaaagtgcgaacacacacacaaagtcttattgatgagccaagttcctaagcactattaatgagttaaaagtgttaattaaggctgggcgcagtggcttacatctgtaatcccagcactttgggaggccaaggtgggaggatagctttagctcaggagtttgagactagtctgggcaacatagtgagacctcatttctactaaaattaaaaaaaataaaaattagccagatgtggtggcacatgcctatagtctcagctactcagaggggctgaggtgggaggattgcttgagtccaggaggtcaaggcttcagtgagctgtgattgtgccactgcactccagcctgggtgacagagtgagaccctgtctcaaaaaaaaaaaaaaaaaaaagttaagtaggcagtatttgcttatatgtatatattttgttgttttctccaaatgcttatgcctctgaagaggatatacattgatgagtgaagatattagggagggtagggagaaagaatagaagtttttacatataaatacaaatagaagtatttaaaaaatttttttttcttagctttatctgatagcctgccttctggaattgtgaaaggctaacaatgaatttgacttttattcctacttcatttgaagtattctctcattgaaaacaccagtttgcaccatccaggaggccttcttatttcagttattattggagtttaaaatttgtttttaggtgtgtcgtatttatttctacttcatatatacatgtaattatcaagtttttaaaacatatagaacactactattgtttaaacagtttataaataaggtacttttatacttagaaaaattgtttttgatatgtgcaggttaccatgctaaggatttgaacaccttcagtaccctatttgtacttgcgtctatgcctagcatttttgttacgtgcatggatctgcaaaggaattgtggtttgtttcacagctgcatgtagcaggcatatgtgtgacatatttttatttcagctattatttcctgttttttattttcagcatgttggaacaggattccaggagaatgaaccctagtgtgagccctgcaaatcaaaggaggcaccttctaggattttctgctaaagaggcacaggacacatcagatggtattatccagaaaaacagctacaggtaagatggcatgcatctatcttttggcctaagtgatttaatgaagctgaaacaagagaattatctgtagtataacattgcatctaaattgttcgtgtatattttgagtagtagaacacataaattactgaaaccattaatacattttacttttaatattgtaaaattaaatttactttgaaaccttttgtagttttaaaattcctatagagatgtaatcttaaaatctcagtttgtgtgcattaatatacatattgaaatatatacatattatatataatgtctttaataattattttatctatcatgtgtttatacatataatacatctaatatttgttactgtctcacctgtggatggatatgatatggtggaataacatgattgaacctatttgcagtcattaggtaaaatcatttatactcatttattgtgatctttgttgaatccctcccttgttgcaatttaataatgacttgataaatttccatattgcttgtcaatagcaaaaggctttaattgtataaaaatgcaatttctatattatgttaactagaagaaggtatagtggacatttttatagttgtatactttttgataaacatttccctgtgttatttagaatttgtattagagccaaatggagccaggtccttgactaacaaggcaaagggaggtcacagtatggtaactattgcacagtataatgcttgaaaattattacagatttgtttacttttatctctttaaggatttgtaggttgagggcaatctttcttcctgatttttactgtgttacatccatactgttgaaagatgatcaccacaatcctgcaggcttgtctccacttagccttcctgaaaaaactgttatttttgtggagtacagtatgccaagtcagtggaggacccaaaggattttatggcagtagctgcaacgcaacatagcaatgatagatgtcataatgttggaaaacatagcatttcctgcttttttacatgccaaaattcatcatacttcttaaaatattcaccttgatgatctcttaacggtgcccctgaatattggtagagtttaatagtatatttaattttcataagtaatttgtgcaggtttgccctacgtgttctataattttgaattctgttagtgtccacataagatccatcaaaaattaaatttaaatctaatagcctttggatttacgagagttgagatagcgtcttgctaaagaatagaacaagttatggattgaatgcttgaaattacagttcaggtaagctttacaagaatattatttattctgcactaactgcagcaagtagaagccttccacattagcataagataacatggtggctcccagaaagcatagtagtctgatcatactagttcaaactaaaagtctgaatgactttctggctgaaatttatcagctttcagagtagtacatgggatgcaagctattttttccctcccttctccaaagtcaccattgagtgaataatctgggttactggtcttggggaaaaaaaaaaaccaaaaaacaacccaggaaagattatggattcttgattccatgcaagtcctttgaaatatttttcagcaacttgagagatttaaataaatgtcagtccattaatttgatgttcttgattttatcagtataaatactgaataaaagataccaaaaaatgtttgtgaaacatttgaaagcacctaatattactttgttctgtgttctgaactgaattttagatgttttatctattttcagccgtgatacctatacattttttttaatgcagcttactttatgtttctttttctaaggagagctatgagacatggttcaaataaaaaatgagtagattctaatcccatagtttataatattgtattagcctatcatttagtaattaactgcttatattttttcagtcatagaaatgtgtggcatataaatagtatgaccatataatgttctatcaaactgggacactcttaagaaggaaaggtagtgctagtaataattacatcagaataccagtactgctgtcttggataaatgagaaaggatggtcaccctatataagatgtcacccagaactgatctttactccaagaattctcattaactctagctccctagcactgtcctttactttatttactttaatgatttatttgttgaatttttttctcttggcataaaatgtttgcaagcagactcgaactctgactgttcctgggctaatgttggtctaattgtctccagattgtatgttggctgattttctctctcctttaactccacccaatccttgtcctggtatttctcctatcagactttttttttttttttccaaagaatatttttggctgatagaacaaagccagttagcacagatgtgcagaaatcattactagagttcagatcacaaatatattttcaaaagcagttttggacttttctcatggactacagtgtttgtatttttctaagtatgcaggcatgatttttaaaataatgcgtatgtcatagatttataagaagaggtgttaagcagcctcctcttagaggcattcagatttatcaaacacaagacagatactttttttccttctcactcaatgcttcattttaggctgatccttttgtgtttgcattcattacctgtgcaccaacatgtctgttttattccaaacaacttaaacctacttaacccttacagccacaagagaggacattgagaatattcctggtgcaagttgcagggaagaatgttctatatatcctctgctattgtttcttttctctcgtgtgtggcataaatagctatctctaacttttaacttgaagttagccttccactctgccagagttatttctgttaaggggccagtgctttctgccatcttacttgccctttcctcagcatttggctgtgtgggtcatttgctccttgaaagactttccttttgtgttactatggttttttagtttcctttttttattggctgctgcttcacagtaatctttgtgggctctttttttacccaactctcaaggtttggaactgtaaactttttttattttctttctgcctaggtgactcatctataatttcatgcacagttcatatctatatgtcctgatgactctcaaatttatgttttcagtccagacttctcttctgagtctccagagtcacatatccaatagtctctttgacatctctgttttaacatttcaaacttaacatgtgcactgtggaactcagttcctctccctgttttacttccaaccaattttctacaactgtgttttttcctttccattgcttaagccagaaatcctgattcctgtctttcaacaagtgttgttgatactcttccccaaaattgtcttgaattggtccactcctctccgtctctgctgccacaaacctagtccatgccatcatcagttcttgccaggattgccatagctctttcctaatcagtgtctcagcttccccttttgcctccattgagtccatttttggtaccatggcaaggtatgaatgtaaattgaaatatatcacttctttatttgaaacacttttatgacttcttattacatttagtaattccttattatgacctggtcttttattatgaccttattatgattcctttccagcctcatcctgttccctctctacctccccacttgcttgcaactcttcagccagtggtctttttaaagttctttgagcccacctttcccccacctgcctcttttatgcctagaatgctcttaccccagtttctatagaggcggcgtcttctcatcatttaggccttgatgtaactaccatctccttctcggaccattttatctaaagtatatactaccattgcttttccatttcaaccatttgtttgtttctttcatagcacttactagagttcggattattttatgcatttattttcttctatttggtccatcttccccattaaggtctttggggacagaaactttgattctctcattccctactggattctcagcacctagcacaatacctggtgcacagttggtatgcagcaagtatttgttgaatgaataaatgaaaagtgtgagtctcactatgttcagttttatatgtttacatgttttcttttgagatattagcatatctagttttctaaatccagatcatcctatataaagaaattcaagagagatgcaagctttgttagtgagagagattaagattgcagactgaagagcataaataacagtaatatccccatctcaaattctaactttcaactccagttttgctccctacgtcacaccttggatatgaattcacatgatctacatcagtgcgatggctaggaaagtatatatttttgaagcaaatggagtaactagttaatgtcagtcactctgttgttttattagtgattcacattcttccatgatcccatagtttatattcggcttttcaactctttcacttttctcctgccaagcattttatgtctcaccctatccttaacatacacacacacacacacacacacacacacacccctacctgttttacagatactatccagttttatcatagaattgtgtctcaccctatccttaacacacacacacacacacacacacacacacacacacacacacccctacctgttttacagatactatccaattttattatcatagaattgtgaatgacccctaaactttagtctggtcacataataccacttgattttcgcctcaattaccccgttactgtgttactacctctgtaccagcagcattgtgcatgtcttaagctcattgaagatatgatgaaccatgtgttattgtatcgcttattccaaattaattgctcaataaatggtgattagacaaatgtgaattaccatcctgtctctgtagaaaatcagaaaatgacatttcatgtaaaataaggttttgtattttatactttatcttgcagtatattctgtttactatatttttgtttccatgaaaagttaacactaatgatgattttcttatagcaaacttcttaggaatttaagatacaaggaaacaaattttgtgcatccatgtttcagatatgatcattctgtttcaaatgacaaagccctgatggtgctaactgaagaaccattgctttacattcctccacctccttgtcagcccctaattaacacaacagagtctctcaggtgagtgttgtagattattgcagaaacatctgagttggttcccatgtttagttttggaacctagacaagtaattggtcaagttcactaagtgactgagagaatctctgaattatttgtggataactgtaggcatattagttgtccagtttctccaccaacctcatggagatggtgatgggtctattttatgtgatagttgcttacttaaatatgtcttctttaaaaactacagaatgaaattaatattaaaatttcatggtgttaggcttacagttggtaacattcatagcagaaagtacctttttcttccaattaggaagataataatttgtgggtatgtgattctggagatactttaccgttagtacacacttctttatcaatttttcccttgaatttttttttcctgtgattttggaccttacccttaaaacctcaaaaactacctcagattttttgtgatatgtagtaatcaactacagttaaacatagtttaacatcttcacagctgctgtaaaaagtaagcaaaataagggaagttatatatgagctatgcttttatttcgtgtgttgaaaaatttgaatttttttttaccccaggcaattgagttcattctttttcttctcccaaaagagcatgattttcaagaggttttaatgcatctatttgttgttaggggtcctatgacttgttaagttctctacaatgtgtctcaaatgtttgtgtttatatagcccaagaacagaaataggaaatactttttattttgttttgttttattttattttatttttagacagggtcttgctctgttgctcaggctggtgtgcagtggctggatcatagctcaccgcttccccaaactcccaggctcaagtgatcctcttgccttcgcctcctgagtagctgggactacaggcacatgccaccatgcccagttaattttttaaaaaaattttctgtagagacagggtctcactgtgttgcgcaggctgatctcaaactcctgggctcaagcagtcttcccaccccagcctcccaaagtgctaggattacaggtgtaagccactgtgcctggcaaggaaatactttttttggtggaaaaaccttagcatccagtgtttatatttgggaggtatttagctgtagttttctttgaagtttgaatgcatggttgacaggtttaccatgtaaaaatgcatgtcttattaaaaacaacgttaagtgtcaactttttcaaatcaaaaagcaatattgagtcatcaggcacttggaatgctctttggaacctacaaatgattagattcatttccacccacagggtgaaacatccatttctatgtttaattaatttctatgtttaattaattaaactatattttataggttaaatcatgaacttcgaggatgggttcatagacatgaagtagaaaggaccaagtcaagaagaatgacaaataatcaacagaaaacccgtattcttcaggtatgtttctgtttgtctttgaacaatagttggcgtatttgttggaaggcttctcccagctgggttactctcttccctagaaggttggtaaacttgagctttagcctcttcccactgtctcctgctgcttccgatgcagctatcattgccactgaagtcctcctcccaggttttatagcactagtttaggttttatagtattagtagttccctgatcaggcatcgtgctatttcttgctctcaccttcaaatttgctttcaagccaggagttcctatgcatggatatctatatcaaatgtctttgtcacaatggtataataaataatactgcttatctcctcttttcttagagcttttcaaaaagagaatgttaagacctggggcagtttggaaatgaagacatccatttctgaacttagacatttactactatggtttaatgacaggtcttacttagaatctgttaagtgggggttccatctcaatgttgtttgccacaaaacaccattaagtcattccgtcattcatcaaatatttgttgttagaatttagactagcaactggcatctgcaagttcccaataatgagccaaggactgttcttgatcctgaaataaagtaatgggtatgataaagtccctaccttaatggagcttacactctagtgcagagctaaacaataagcaaataaataaatacacaaatacactgaaaattagagctaagttctctaaagaaacacaaagcagcataggaggttagaatttgaattgagaaatgagtgactagactgagtggtcagggaaggcttctctgaagaagttccactttaagacaacattgttaaggtaattaatgctagctgttataacagccccaaaatctcagtagcttaatggaataaaattttttcacttgcacaaaatttgacttcactttctaggattgcttttctccaagcagggagtaagggatccaggttccttctattgtgtagccccaacaacttgaaattctttgcttcttgcttgagatgttagggaagaaagagtttggtggattgtgcaaaatgttttaagaatcaggcctggcttttagccaatgtttagttggctaaaactctgtcactttgcccaaactactgttagaaagactgggatcatgtatctttctgtgtgctcgagaagaagacaagggtttggtgagaacattgcttttgccataggcagaaaagtcactgaaataacaatgtaaagatttaggggaggctgggcgtggtggctcacgcctgtaatcccagcactttgggaagctgaggctggtggatcacgaggtcaggagatcaagaccatcctggctaacacagtgaaaccccatctctactaaaaaatacaaaaagttagccaggcgtggtggcgggtgcctgtagtcccagctacttgggaggctgaggcaggagaatggcatgaacttgggagacggagcttggagtgagccgagatcacgcagtccagcctgggtgacaaagcgagactccgtctaaaaaagaaaaaaaaaaagatttaggggaaaatctggagaaagagcttccagacagagggaacagcaaatgtaaagaccctcaggaaggaacatgaagaagctgagtacgactggaatgcaggggctgaggggagagtggtagatgagattggagaggcagcagatgtaggctcatagcaaacttcataggctttgatgagaactttgggtttcatcatgggtttgaggggatgccattgaaaggtttgagtaggggagtgacttgatatgatttatattttaaaaaattagtagttgctacataaagtggaccatggtggggagtatgactggaagtagggagacaagaagccattttagtgggctaggtgagagaaattgttgtggtccatactggtgtggtagtcgtgaaggtggcagaaagtacctggatgccaaatatattttgaaagtaaagctgatggaaattgttgatataatgataaatcctatgcttaggtactggatgattggtgataccatttactgagaccagtactggggaaggagcagttagaggtggaagtcaagaattttaagtatgttaagtttgttatggctattaggcattcaagtggagaagtcaagtggacaatcaaatatctgggtctggagtttaggagagaggttgaaactggaagtttaatttgtggtgctactagctagagagaaataaagaggaaagaaaacagagtgaggtaccaagttctgggccatctccaacattacaggttgaaagagaaagaggaaccagtacttgaaaaggaagaagagtagctggccagtaaaataggagaaattgtagggatagtggtgtcccaaaattcaagcaaagaaagtttttaaagaaggggatgtaacagttaattacaggggctaagagagctaagagatgctgattcagataaagagtgagaaattacttttggaattgaccatcagaacttgttagtgaccttcgtgaaagttctttcattggagtggtgatggcaaaagccaactgaagtggattcagggaagtaataatagagggggaagtgaagaaaattatttcagggtgatccctatacatgggaatagagaaatggagtagctacaggagtcaagaaagagttttatttttggatgggaaatatttcaccaggtttacatgtttacatgctaatggaaacatcttaaactatttaattatttcctgactaattggaagcagtatgtgttatgttctaaagtacattaaaaggataacaagaaacatgggtttttaaccattatggaactgttttcatacataaaatgagggctagtctaggtgagctcaaactctgacattctgaaattctgtaattatctactgtgtgcttctcttggcctctccaacttttttcacctactatagtaggcaactttattggttgttaatactaatagaggctgcagacagtcattaacaatgtcacatgtaccccaaagtcccaaagctgcttattggcattggtatgtggagcctagtacttcaaaaattcatgtctgccaaagcctacacgtcagctgctaccatggtcagaggaaaaatggaccctctctcccttctgctttccacatctgaagcaagtgcatcttattggcagaatctaaattatatccagagctctggtggcaaaatagtttgagcgatataggtttcaggcttccatcctttgctacacagaggaagagcacaggagtcaggaatagatcattgccagtaggtaatcccacacagctagtataattaacttaatgaaaaattagattaaaattcttgccctaaatgctttttttttggccttatcattagatggaacttgtcatgtttttctttcctagtcattaaatgaatagagcatttactgtggaaggggtgcttggtattctttattcttaaaggaattccaatgcaagaaaaagaattttgttttaattttactgtctttgttcatttggagatgtgtagtttaaagtcttatttcattctgtgctattttgggtacacttctttctgtagggagcttagatatgctcagaaatgtgagaatcttagctactatagaagggaatgatggggaagaatctgtatttgtcagtagtatttgtcagtagtaaagaagttcctggttagaggaaggagaagaattattctgcttttatgctgttgtcaatgccaaagcatatcaagattttaaaaaaattctgtttcttggtgtaaagagcctgtaactgctctcctttttcttttctcatttcaacctttttttcttccggttacctctttcagttgctaagagtatcccaaactcttataaaatattctgtaattttagtgaactgacatttctttgaaatatctgttgtatttaagcattatgtcttataaaatattctgtaattttagtgaactgatttctttgaaatatctgttgtatctaagcattatgtctttgatttgacttgtcctgtttcatagttctaccctcttcctagactttgagtttttagagaaggtaaaggggaaaattaatgaaatatctttcaaaatgaaggcaaaataaggacattttcacatagagaaaaccaagggaatttgtctccagaagacctgtgctataagaaatgctaaagatattttttaaaagacttgggtaaatgataccagatagaaccccagattagcaggaaggaagagcatcagaatgggcaaatatttgggtaaaaagaacaggactttttaaaaagaaactatatttatcttatgtgtgtgtatttaaatgtctttaaaagactattgtctttttaaagcaataataatggcaatttattatggggtttacagcttatatagaagtaaaatataagacaataagaacacaagggggggagggataaatggaataatactcttaataaaatttttatgttgttcgaataatatttcaagattgactgcagtaactgatatcaaagtataatctctagagcaactactaaaagctaacataaagaagtacagctagagccaggcacggtggcttgtgcctataatctcagctactagggaggctgtggcaggaagattgcttgagtccaggagtttgagaagctgcggtgagctgtgatcacatcattgctctcctgcctgggcaacaaagcaagaccctgtgtcttaaaaagaaaagaaaaaatatagctaaaaagacaatgtaagaaataaaaatggaatactaaaaaatatgcagttcagtgaaaagaagacaggaaaagagaaacacataaagaacaaatagaataaattaaaaatgcataccaagatggtagacttaaatccaaccatattagtagttaaattcagtgggctaaacacatcaattaaaaggaagaaattttcaaactagatttttttaaaaaggaaagatccaactatatattgtttataagaaataacactttaaatatgaagacactgacagatggaaaataaaggtgaaaaaggatgtatgccatgcaaacatgaagcattaaaaagctgacatggctatattaatcagaaaaagtagacttccaaacaaagattattctaagagacaacaaaagaaattttttattgataaaaggagcatacaaggaagataaaacaattctaaatgtctaggcccctaataacaaagcttcaacgtacacaaagcaaaaagtgacagaacttgagaaaaagatctacagcataactggagattttaacatcctctcatttctgtgtaaatgcctctcacatttttgtcaattatgatcttttgctaaacccatacagctgaaaatgcaaaagctcatgactagtttttcagaggttccttagttaattggtataaatcttggataggtaaacggaatatctgttttctgtttgcctgatatctctgtaacttggcttttcctaaggcctacccattgctttctgagactagggaaataagtctggcttctttcaaacttctttgctcatttcatatgggccaaagtagcactaatcatttaaaattcaccagttaatctgttcattttcaaccttatatttatcaactagctataatttagttttggttttatttactacttactggataactatgccagtaagtatagtattttattatttaactgtgttcttcttttcattttattggtgatttttttcatttgttgttaaacagagcatttattgaacacctacaatatacaagacccacattagatttttataaaatgagatccttgacttgttacagagccagaagtgggaacccctatattcatctctgcatattggttccatccaccaaacaaaattgtttccttttcttttctcccttaaacttctgtacatgcttctgttttagcgcttatcgcattgtattgttttcctatatctgtcttcccagttaaactgcgagcttcttaaaggcagaagtcaaatatttaattttgtagcttgggcacatgtaggtgctttgattactgaaagatggatatatggacacagtaatgaacaaatgattaaaaaattatttaaaccattgtttgacagggtaagattactttctaatgaaatagaacttggtaatatgcccttgaagtctgataccctgacaaaccgcttctgaaaatcagcttacataactaccagggagaataaaaaggcatagtgcaaagcaaatgctgtgtgaaagacaggtttccagtgtagcatatgtgggccactaatgggtgtagattgaactgttctcttgccaagagtcatcaataagaactctttaatgatggcttagttcatagatgtattttggcatgaagatctctgtgtttaactcagtaaacaataggatctagtttcattatggacttttcatacttcttaggaacttgtcattgggaagataattattttagacaagcagacattgttatatgttcagtaacacttatatagcttggtcataaaatttgtggtgcttggactagcttttgggctctttctttaaacttaatggaaagtgccttaaatgccttaatctccataagacacttctcccagactagaatggacctaaagagttctaatatctgtcagtgtttaattatttgaactgaatatgtcagaaatcttagcaatggaagtttaacaaatttaagtatagaatgaaccagtataggaagatttcatataattttgtgatacagtattaaactttttttttttttaatattccagggtgctctggaacagggctcaaattctcagctgatggctgttcaatacacagaaaccactagtagtatcaggtaagacagtgcagaagctcttggccaaggaatttaaaatagctggtattttaagaaagttgaaattcacacttccctttcaccttaaatttgttctcatctatgagttttatattagtcatatactctaagatatatatatatatgtatatatatatataacatactactgagcagttggaataaagccagataatttcaaaagttcaactctcccaaatcccttaaatacaaatttagtcagaatgctgttccatcataattttgatgaaaatcttgaatacccatagctttcttgcccttgatttgcatctgtttcatgaacctagggaagggaatgttattttttgagtgctctgtaccaggtgtcctgctgagtgttttacatgtattttatctttaaatccatgtaataactaaaagtttattttatatatagaaaaactggtcaaatcatttattttttttgtaattttcagagtcataagacctagtggtagactcagaattcagatcatagctgttttacttacaatgcatttttcactacacaataatacttaagattttgaaagatttcaaagagaatgctgtatctacaggtttaaatgtcttcaaagggaaatataatatgggaagcaatatggtgtcatggttaagatgctagctttatttgccctgttgggcagagttcaaattataactctacctcttactttgtgggctcaagcagattacatgcaattgaagttttctcatctacaaaatgctggctgcacagagttgatataatggttaaattagataatatatttagagcacttagcatggtacataagtgccccccaaaatggtaaatgataatgatgtgatgtcattgacaacagtatcactgaagtgaaatttgaggatctcagcttctatctgtagctctaccacacatttgcagttcacttatatgaatttaacatttacttagaatatactgtgtgccagtgttctaggcactgagaaaaaaatatagatagatagatagatagtaaaaatgaagtcaaaagctattttattcattatactaataactgagaattcctattaaatgacaatgagcagcatatcagcaatcatgaatgtttaaaatcctgagattgtattatcctgttgaaattgataattcaaatatgtttaaataataactaatcattctctgctaaccagaatatatcattcaattacatttattttaaaaatatatcaatttttggatgcatggttataatggcatggtatttcttcattagttaaaatgttttagtgaattacagccaattttcattatttgtggattccatatttgctaattcacctactaaaatctgctaaaatgtatttgtaacccctaatattagcagtgcttttgtcatcatttgcaaacatgcgtagatgctccctggtgaggttgaacaaggcagtgttctgccttttagtctcagctatataaacaaggtccttttcacagtccacatttttcatatttttgtgctttttgttggtaattttgctgtttgaaatggccccgaggcatattgctgaattgctgtctagtgttgctaagccgaagcgggctgtgatgtgctgtgtggagaaactacgtatgttagataagtttcattcaggcatgatttatagtgcagttggctgtgagttcaagttagtgaatgaataatatatgttaaagaaggtatctctaaacagaaacacataaataaggttatatatttatcacttaacagaaatattgtaaccagaggcttgcaggaacctaaccctgtatttcccccaggaggatggtttaggattcactaattcattgctggcagtgactttttagaacataactatcacaaaatagcaagaagcgactatatattcaaaatattgtaatcagaaatggcctagtgaacaaatggagttatttcaaaggaaattcttatgactcatttattacttccatttaggtcagtctttttctcctcttaataatatttgattgatacatacaagttttctctttgaggaaaaatgaagcatttttacaggatccctttaactcttccagatattggtcctaaaccctagaaaatcctgaacacattaagaactctattagaatcatttgactgtattttttggggcatgatgtggtttgaggtattatcattttagtttttaattttagtaaggcacatacatggtacttttaatatcaatgactagcagttgttgagtgactcctatgggacaggatccatgcttggcacttgacatataacatctccagtaacagtcctacaagggttgtgtggttatactctttttattgaggaggaaacagtttgttcatggagggcaatttccccaggagtgcccacttgagaagtgaagcaggaattctaaaccaagtctgcttgttttcaagtcctaagctttttccacctttttgcacagcctcgtaggcaagcataccttcatatattcgacagggtggtgaaaaatgacttttcctcagatttaatttgtattactaaaaaaattaaaaatcgttcaaacctatgcagaaatctctctattttctgatactttcattatttttacatgctttgcaatgtacttgaccatctagtacattttagagccttgattcagaaatcagaattttagcataagtgaatgggttcttataaaatatcctgatccttgggctttgcaaaatattgttataaaaattactgccaaagtgcaactaatattttggttgagagagattcttagaattcagacatagccttagaatgggaagtattttgggaaaacaggaaactttttattttagtaataccttatatttttcttactttagcaggaactcagggagtgagctacaagtgtattatgcttcacccagaagttatcaagacttttttgaagccatccgcagaaggggagacacattttatgttgtgtcatttcgaagggtaagttcatcttgaaagaatagagcaaatatttttgagtgcttgccgtacacaagacattgggctgaatattgtggaaaatacaaagatgtgagaaataggaagcaatataaaataaattatgtgagtggaacagtctaagtactgtaatatatgctttactttgagctgttgagtattataaagatgaacatggaattggtgtcagactatgagtttgtatttaggaaatataaactacttgttgatttttattgtttgtaatcctgatagccatgctgtttataaaaaaaggaaaagtaaaaacataaaaatattctatttaggcttttcctatttaggcttttaaaccaattcccatttggttattgagaaacagacttctgaaatgtaggtttgagatggatcatgggctgattattaattgtggaatgtttggatctatgttcctaagaatctctattcctcttttatctcttcttaattaaacatttggttggtgaagaatgtgttagataatcagttagcttatgtaaaagtaaatgtttatactagcacttttgaatgttatgaatgttaggctaaatggaaaaaatgcatagctgtttatatttcatctactttttctataaaatgaaaatattttcttcatagaattgccatgtgaatatctctgttagagtgctgtaggttaacccaggagcacatgaatgaattagaattcctcagtggtggtttctatcccaagctgttttttctttctttctctctgtttttaaacaagagaagggacctcactgtgttgcccaggctggactcaaacccctgggctcaagtgatactgagtagctggctttcttttttttttttaagaatacactgggtatggttagaagtaagtacagttgacccttgaacaacacaagtttgaatgaagcaggtccatttatatgtggatttttctcaaccttagcaggatgccaaacccacttatatgcagggccaacttttcacacatgtagattccacagagctaactgtgggacttgagtatgtacagatttggagttatacaggcggctctgtaaccagtcctccacatatacagagggatgagtgtctatactaacaatagaatgagcaaattcattctctgattattaccactcactgtcactgaaattctcagttaactagttaattcttttcctaaggtataaatatctagcagctcaggtttttaggaccagagaactttgatacttgaaaactagggagatcaaacatcttatatattttcagttattaatcaaacatgctaagagatttggaacactttagccatagcgtctcatgatcactgccttttcacaaaattccctgtgttcaccttactctatcagacataactggtatgtttctgtacaggaccagcctcaaagtttcttttcagcagcaagggggcagctgagaacaatgtttcctgcaaggctccaactgtactggtctatgaaaacaaagtatttcccttactattgacacaattatgttcaaagtaggagaaaaaaagtaaacttttaagaagattcagtactatgaagaagaaacctgctgggtgttaaaatgattgtgttgaagtatattttatggaagttactgtaggagaatgtttttaacactcaaatagacagtttttctgaggttcaggataattactgtattatttgatcaaaacagtataacagatattagaagtaacacttgtcaagccatggattgaagtcatggttagtaatgtttttctaagggaagagaacaagtattttttatagagaagacaatcctagcttttttttttttcttttgagatggattctctctctgttgcccaggctggagtgcagtggtgccatcttggcttactacaacctccacctcccaggttcaagtgattctcttgcctcagcctcctgaatagctgggactatagccgcatgccaccatgcctggctaatttttgtgtttttagtagagacggggtttcaccatgttggccaggatggtctccatctcctgaccttgtgatccacccgcctcggcctcccagagtgctggaattacaggcatgagccaccgcgcccaaccaatcctagctttaaacagactgtatttttataaaagacagtgaatggcggtttaaaaaatatatatgcattgcatttttttgcatttgtaaaaagtgatttctcattagtttgctataaaagtgctgttagaaaattattgatttccactcctccctagtcccttgatgttcattcaggaagactgttaggactggctctcacacaattactattaggagtatgtctaacattctgtttcgatttttcattttcaaattactgatttatcacattttggtgttttatatcaaggaagagtaaagacaaatgaactgaattagataatagtaattaagataacatcctttttattttttttgttttgtttcaatagtagggaaaaggaagttaattttatcttgatgactgtaaactatgttatgggacaggaattttgttctttaatacctggattgttctttttgctcttgctgaaatgaaaatgaaataataaattacctcatgcttggtcttctttcatctttcaatataaaatattctaacagtttcattaaaaaggtgagtggcatcatttcttgtgcagaaggatgtagactttttctcccacttaggttcttaattttattggcagaaattattataattgatactacattggaaattcagaagaagattccagagccccaggtttcggcttagcatgaaccagacatttataacaaagccaataagcaagctatgttattttattttatgaatggacatgtatttaacaaaatattttaatatctaaagatgtagaagtagccattgactgtttcgtactgttatttaagccactctctcccaaacttacactccctcacaccctgcattcctgtaccttttaatctctttacagttgagcggttgaaattattttctctaaagcagacacactcttggataactactgagttcctgttatagctcagcaagaaaaaatgcttatgatcccagtactccagacaaaggtccaaagtgcttctgttcttttgactctccttaaagagtttttaccaccaacatagtaatctattcggctttctttgcttagttccagttatttgtagcttattttcctgtaaatactttgcctttttctcctctctttgatttgtttgttttagtatgatttggagagggaggttggagaataactttttctcaaacttccaagtcactttgagtgtagaataactgatacattaataagaaaaaaatccaattaagtttaatgccttttttgtttgtttgtttgtttgttttaagagacaaggtctctgttgcccaggatggagtgcagtggtacaattatagttcacttcagcctccaactcctgagctcaaacagttctcctgtgtcagtctccagagtatctgggactacaggagagtgccaccacatccagctaatttttatttattttttgtagagatggggtctcactttgttgcccaggcttgtcttgaactcctggactcaataatgcttattttaaaaatacttttgtggccaggcgcggtgactcacgcctgtaatcccagcacgttgggaggccgaggcgggtggatcacgaggtcaggagattgagaccatcctggctaacacggtgaaaccccgtctctactaaaaatacaaaaaaattagccgggcgtggtggtgggcacctgtagtcccagctactcaggaggctgaggcgggagaatggcgtgaacctgggagacggagcttgcagtgagccgagatcgcgccactgcactccagcctgggtgacagagtgagactccatctcaaaaaaaaaatgcttttgtatgatagtctatttagggagggagggaggaggttgattaaataatataacaaaattaattcaagagctaagacagaaacaaatactcaggaaagctcaaataaagttaagaagaagatgattttaaaagggcagaaaagaaacattgagaagaaagattgggaaatgatattaatttattatttcaatacacatttaaataccatccttacatgtagctgtctcatccactaatatataaggaaagaatttcttcctggggcagtttttcattaaaaacaggttctctttgaatcagatggctgtgaatgtcagtttgccatattatctctacttgtttaatatttttcttttgcaaatgagatggatgcctactttgggaacattttttatttctattacattttctgttttcagtacctgtctcaaattgtaagtaaacacgtaaagtgtcttttcatcagtttcaaatacatacataatattacagaagaatctgagctatagccatatgactgcctgagagatgtctctttctcctctctttccaagtattttatatattctagcaatagtaccatatttgggtatgcaccccttactggtcccttataaaaattattaacactgtcatatatacggcatggattataagggtagccttaagtaatagggacttattgtaagttatgtgagattaaagaagcacaggaaactggctcagaatccaaataatccctctgtgcttgtgcttcattgggtggaatgtatactagtcttcatggagaattggaatagtggtttattgtcatttctgatttgacagcagctccagtgattccactttagtcttttttttacactttactgattcatactcctcaaacacaaagatctgattgggtagttctggtcaccatctcttacgcagagaattactatggcagctttggcttatgatccacagttattcatttgtgacaagagaaaaacctggggccactcttctgagaaaatgactttggcaggcactgggagcttcataaactactataccacacagcctgttttttttaattattattcttttttccccgttcttagtaagtgtgcattaaattctttcttgtattggttcctaattgtttgatctaaaaggcccatcttctcatctatatgataagccttttgaaggcaggaaatatcgtatgcttttgtgactacccctgacactcagcaatgcctaccactgagtgcttactgaacagaatggttttagacatgagccattgagagaagtcacagtgatggaagtttgttgtttttcataatcatttaaaaggtttttttttttacattgttttgcttaaagaaattggaatctattttactgatctaagaagtaatataagctgtgctgaatgccagtagaaagtttagttaaagatgatctctgttttgtccatttatgatttgcactagccagatatcatcagcttattcttgtctctgaatctaagctgtagagctaaataattcacctgagtgtagtgtttaacagctttctatgtcagtaagtagaactttgagatacttgcatcttcatttaaaattatttgttggcagcattttggagtagattgttgttagacctcactgatttcttttttggagaagggatgggttctactatttgtacagattcaagcagtaggagccagaaacttgaaactttggaaacactgtaggaaatactgtgattattgcaaaaaaaaaggttgactagtggtgttatttgttcaaaatgtttgccagaggtttagtcccacggatgggcataaaaacgaatttcaaaaatagcaatgatattttctaacttaatacctagattaatacctaacacatgaagaatggcatattttcttaatgcctgttatttatttcttagaaatttatgtttagtttatatgcatatataaaaattcaacatatgtatatatataaaaattcaattgtatgtatatatataaaatcttcagaggcaggaggaatttctttagtatcaaaggaaattcatttataaagtctacttcaaaagggtacagctccttcttttgtttctgagacctcaaaacttgagtgtacacatagatgttggagtttggccattttcttatctccactttcatggcctttgagccaaattctagctggaaaaaaaagtgaatagatgagtttggaaagatacttgcattttagaaaagggtcttatctcagaagagagatgttttaaaaaaccttcttttagaaggctttttaaaattaatttttagctttaaaatatattctcattcaggtctaaagcacattataaaaaaatagagcagagttgactgagtaccctaggttaataaacttaacctagatttatttaatcattatgccaataatgttctttttatatgtccattttctatttcactttattatatacaaatattaacacttcaatgtatactacctttgtagtttacaaacctctttcacatacataatcttagcaattccttacatataatcacaagtattcttagtcctattttatggctgaaaaagctgaagcaaagagagattaagtagcttatctaaggacacaaaaatggtaagcattagaactagggcaataattgatagattctaatttaatacagtgatttttttttctttacattgttgtgcttttttctttatatctggcacttttagatgtattacagcatatgtaaataaattaatctaaccctccaaaatcaagatatttcattgaaaaatctgctggacagttttggcagattcattacacaacttcaaaaattgtttgtttgttaattacctgattatgtttgtttgttaattacctgttaattataattatagattaagtactttaatagattatgctttcataatgctggagaataacttaatggtttgaaatattatagtatagcttcagatttcaagtcagggaatagaataaataggccttgaaagtttctggtttctttttaaaacagtgtctgaaatttccaacatggtggaaaagaaatgtctttgctttgtcttaaaaaggaagtagtttagcaaaaacagaagctgttttaattattggtattctagagcttctcatagaaaagagtggggtttttgtgtgtgtaaatacattttattatggattctgtatatggcgtgctagatctttgagatcagaagcatttgatctcaaactccttgttaaatgtgagttactgttgtgtggttttagaggattcaactatttgttctttgtctctataacattgctagctaacataaaaacatgttttttacttacacttttcaatcacaaagtctaaaataacttgctttatgtttgagaaaagattgttcagtagtctgtaagtagacttgtatatagccacaaacagagaacttataactcaagaataatacgaagtcttcaaaattctcagaatggtgggcagatccatctgagtcatgataatttttcaatggttcttatttgtttgctctatttggtagtcttattattatgaaatgtgtttttcatatgcatttgtttaatctccccttttcaggttgtatgctttctctgtgcagggataaagtctattcattctgttttgtcttttacaagatctattgcaatgcattgcaggctcggcagagtaagtcctaaataaatgttgactactcagaccactaactgtttatttgtgttgtttacccttattttttatgtcctactcttcaaaagattactagaggtggggtttgcagaaacaaaggaggacatttttctcaatgaatgtttaaaattacttcggtgacttggatagcaatgaaatttttaagaatatatagtcagctttggtgtgggtggactttttgctgtggaatagaataattcctgaaagacttctaaagttactttgaaaaaaggcaggaattagggtgggaggtgggagaggagcagaaaaaataactattgagtaaccaggcttactatctgggtgaccaaataatccatacaacaaacccccgtgacatgagtttacctataaaacaaacatgcacatgtacccctgaacttaaaataaaagttaaaaaagaagaaaggtaggatttaatgattgatagcttaaagttctcatcaaattttttgtaatgagggaagaaaatatttccccaaagcagaactgcattcccagaaagaacatttcttcacatcatgaatatgtgaggaaaaaatgtattttaaacaactgataggtacagaccctaggaacctgcattctagccccaatgttgccactcagtgacatctgctatgtgactttagacaaatcacttagtccctctcatcttcagtttccttatatgttaagtgataaagttaatgtagatttgcttttttccttctggctccagaaatctatagtttttatctgtgtgtttgtgtgtgtgtgtgctttcctcttagaaagctgtagtattgctttaaactctttgaagttactaagtgattcaatctagtggagtcagtgtattttaagagttttgaaaaacagccataacaaaaacaacaaaatgtgaagttacaaggtggggctataaattaatgagtttgttttttgaatagctggcagttttgtaatttatttaataacacttatacagaacacaatacgataatctttaatctttataattgagataggtgcagttatcatcattttacagatgaagaacctgaggcagtcgtgtccattgtgaactccaataagaaagattaaaaagaaggaagaaaaagtccgctgtagaaatgaaaaaacaaatttatccattgtgacatcgtttagaaatagcagtcagaatttaaccaagaaagtctggctctatgttcttgatcatttccctctattgcctgtttaagatatccaaatatcatatctttgaaggtagtcaacttggagtttaattccgttgatctctcttttcaaaacatattttgagttgtttcgggatcattttccagagactaagacaaagccctgtggaaaaccaagccacatgttactcaaagtaatagtgtaggaggaacaagagccagcagggaaacacagaggaaattattagaaatataggagaattggaagagtacagatgaaggaaaataaatcaacttgtttatgttattttaaaacctagaggtcaaggaagagttcagaaaacgaggctgtcagtggtatcagatgttatagcgctccctaagaatgagaaatgaaagaaactcatttgtcttgtgtaaacattaaaatcattggtaacttgagattacatttattgtagagtaatcagaacagaatccagaaaagagatagaagagaatgggaaagaaaaacaatggtttggtaaatctgacactggaaggaaatggagatagcctagatatagataaggagaagagaactaagagtgtgtatgtatgtgtttgtgttaaggacaggagagatatagggatagggtataaggtaaataaggactattgtagttagtttatatacatataagaatagagtttatgttttatgcttgacagatgttctaaaggaaaataaacaagtcattgttcctcctctgtattgttttctgtttaaagtaaaagcatggagaaagttgaacagtttttgtttatttgcagtaggactacagaaaagaaaaataaaagagcgtatggaattaaaaccagatttttgaaaaatcaaatcatatttaaagtactgcttgagatatcaaaagtcttttaaatcttaaatacagagctggtttttaataatggtaaagagttttcaaaatgttaaagtttatagaactatttctcatttaattatatgtaaatggttttataattttttctcacattaagttagaaaactagcaaagtaacctacataaaatttggtataacctttcttatgatgtcacaaaacttaattatggaggaagcaattattataattaggaaaaattgatgacttatgatctgactcaggatcaaggtctgaaacactcatgtcatttcctcccctctcctatatagtatacagtgatttgttcattttggactcttaatattttaacttttgacaccatcagcaaatctaaacactgacagttggtgttttcctgaaaaatgttaaggctaataattgtgtgatatttatttcaacacattgctgctagtcttctataaagatctcattatgggtaggctttgaagagatatccagttcataatatgggcatcacactggaagcctgcaagatggatgattggctgagagtaggagtgtagtttctaaataataataagtctgtttcccctgctaggaagtaccctgagggcaggaaccctctatcttagtcatgactttgttcccaatacatggtatatcaggcatgtagcaggtattcaataaacattgaatgaataaatgaacaaattaattagataccaaatccatcagtttgacactatattctaaattagtttatatagtcaccgtaatgtgataaagaaattgtgatagtctagtttactgagcattgttatcaggaccatctgtgtctcatgtttaagtctagaaatcagtctttgaaaatgagtgaattcaaatgcatttttaaaagtctaagtgccattttgcatgagggaaattatatacctagtaagaatttctctgggtttcaaagtcagaacactgatcttggtaatacatggacagaaaggattatttttcagttagggtgttaaacagattgtgctatcattttaacctctggaatgaataagccccagatttaataagctccttatgtataagatgcctgttataatgtgtctgtaatgtcctagaaagatgagactacccctgcatagtgcttatttcttgcatggaatgaatttaagataagcttgtcaaattttaaatctgacatagactatcttttgaataatttatttggagtcatctctgtctgattataatatgccctaaaataaatcttgaaaaattaaaatatatcatacagaataaacagtctacatgtaacagttaacagttacatgtaaagtgttattcagattacattttacaactatttcttttctgattccattttttattgaatagaagttcaataaattttattctgttaagaatgagtctgtcttggagagggtcagtgtcacatatttactttgaagttccttaaagaggttagttgaattctccccccaaaatgtgctttgaattagcagcttttgaatatctattctagtagaggtaggagcaatatgaactagagagaatgatatgcaataaaaataataatttttctttgactttggaatgaggataatctaaaccacagccatgtaggcagacattttctgatgtatgtaggtatgtttgcatgtctgtctatctatccatctccttgttttctatatatttgaccctaacctttcaggctcctattttgccatcaggtccaaaaccaaactgagcgataagagagtggagatccttaaatcagtggttctcaaactttttggtttccacattcctttatgttttcaaagaaacattaatgagaagagtagcattttgttaacattaagaaaaacctctttaataactggcttaatagaaaccagctggattcttatatctgttctttttggtcaaaatatatgaagaaaatccagcctcacacagagatgtaattggaaaggaaggactattttaaaagcctttcagataattgtgggtattctttgatgctacaccaaaatgcaacaagaggtagtttcttaaaggttagttgcaacacggaagccaaatctgtgaacttttagtactctgaaattaaaatccattggttgatcttgcactttgaatggatcttttacctgtgcaaggttttgttacatcatacattggtcatttgaaaatactggttcactgagttatgcagatcttccaaatgttgacacattttattatgtattaaaatgtcacattctttaatactatcacaaatcttatcagaaaagtctttaaatattgtgagcagttcatggtagcagatagaagttttccaaaattctagttttcacttgagggttcaaattttatcattgtcaaaaatatgtcagttttccttgaagtggtagattcactaatttattttcaagaacatatctgtcagatacccaaggctaaacaactataatttatcagtctttcaagtaaaagtggtgttccatgaagaaagtagctagtgcagctcacaactcagttacacaagtggttttcctctagacaacaattgtactttgatatgcagcagaaatgctttatgtgtatttcccattttgtcgtacagaatattaaaaagacttctactcaagggtcaagatttcataaaattaataacttttattgcttcatcaaagacttccttcaattacattgactgtgtgtggtatgtgcatgtatatgaacatagggcagtaatatgatgaactatataatacagtttgatgttgctgtcttaattcatgctagggcaccatcattgcttttgcatcatcagtgtaaatatcaacacagttgtttcaagataaatgatgagatttaagaaagttattcaacactgaatatttcagtactgttagtgtttgttgccaagcattcctataaaaggtctttgttgttgattacttggggctcatactgaataaatctaagcaaaacataaagtttatagattcttccatttgtaaaacaaaagcacaattctgtagttgagatattaactcagccttcgtatttgcaactaagtgtaatttgatgaattaacatatggttggaaagtgtcatgatttcttatactgacttttcagcaggcattgagcaaggtcgattatccacaattttattagtctctcagctattatatgcactttttcagtcattgcattatattaataacttacaatgtaggatacttccgtggtcttttcatttccagtatgataagctgtaatagaatttttttttagaggattcttcacacctgtgtttaaaatatccagttccattttctttgaactctacatgattggtttcagaatgacatcacaacttaattggcaccattatagtatttgaaagattttgttgcataagcgacaagaagatagattattcatatgtctgaaacaagagaaagatggctttcaatgtatggtcattttttattaacaattttgaccagtttctttgctagattccacctttccgtgagtcataaaattctcaaatatatcagttttatcttttctgtatcttatatgtagacagtatagttgtgggttaaggaggcaagttttctaatctcctgtcttttaagccagcaattcattcttaaatataagaaaagtatgtaatagatttttatatgaaatattaaaatttaagaagctgtagatagatttagaaaacttttccaaaaagatttaaaaataatattataaaacaaaacaaagtatacattcttctttgttgtatttagatagaagtttcagtagtggagtccatataactaagctccataataatgtgtttcataactttctccattattctactactagatcatagaaggcttgtttctcttaaggtttagttttttcatgcactcagaaaatagtttttcaggaagtatgtactgagtattctgaggatatgcaaggagcatgggttccagtgataaataatacatagtctctgtgctcagggaacttatagtttagttggtgctaaccagataaattagcaaaataattgacagatatagtaagcatgatgaaaacacacaatggactcagagaataacaaggatgctctcctgagacagcgacatttagctgatatctcaaacatggggggaattcaaggattccaggcagaggaaagagcatatgaaggcagttaagtaaggcaggaaagagctttatttgaggcactgaaagaaaaccaatgtgacaggagactagtgaatgggaagggggatgagtaatgaaaatgaggtttgggagattggaaggggctagttctacaaagccttatgagctatagtaagtagtttgggttttattctgagggccagcaaagggatttaagcagcagaataacacgaatgatttagttcgtagaagatgttcactgctacatggacaatgcattagagagagacctattaacagtaggagcagagagagcagagataccaattagaaggctttttcagtagctccggcaaaatgatgatggcagcaaagtgatgaatggattctaaatacattttgtggatagatttagtgagaattggagagatattagatgtgttcagatttctgtcttgaattactaggtagaaaggactatcattttttactaagatgaaaatatttggggggcacggtaatatgtttggtataaatgtggagagttatttttggatacatttaaatttgaaatgtctgtgagacattcaagggaatgtgtgcaattggctctgtgaatctgggactcaagagaggatagatctgagctaagaagagtaattaagaattgtcagctcatacacatttatttatttatttggagacgagtcttattccatctcccaggctggagtgcaatggtgtgatctcagccccctgcaacctctgcctcctgggttcagatgatcctcctgcctcagcctcctgagaagctgggattacaagtgtttgccaccacacctgactaatttttgtatgttttagtagagatagggtttcaccatgttggccaagctggtcttgaactcccaacctcaagtgatccacccacctcagcctcccaaagtgttgtgattataggcatgagccatcacacccggtcagcttacacacattatctcatggatttacatgggaataatggagtcatcaagaagagagtatatagagagaggagggttcaggaccaaattagattttgaattggagaaggatgagagcagcaaaggacggttcaggaccaaattagattttgaattggagaaggatgagagcagcaaaggaggagggttcaggaccaaattagattttgaattggagaaggatgagagcagcaaaggagactaaataggagcggtcagcaaatagggagaaaaccaagagaagagacttttgaatggggaaggagtggtttattcttgaatactgttgagacgttagataagatgaaggattggttttcactggatatgtcaacatgaaagtcactgatacacttgacaagagccttttagtgatgacatgaaacataaaagttaaagatggattaagtagtaaggaagtgagaacagcataactatttaaaaatgtttgcctataaaagaaaatagagaaaaggtagggttttgtcttattttcaaactctagatatcaattatatattttaaaggaatgaacccatagataggaagaaagcaatgttaaaagagaagtcgagtccttgagaaggggcaaaagggtggaattcagataacaggtggaaggatggccctttgctagtaaggcaggacattatggtagaggcaagatgagttcatagataggaccttaggttccaggaagataaagagaagacacttctaacagtttctgttttcccagtgaaggacatctcaactgatgtcatcagctgaaagtaaggatattagaggaggtgtagaagatttaagcagagaggcacaagtatgaagtagttgtcttggccagtgggatagtgagcctactagagacatttggattgtgaggccttggtggggtgtcagtatgccgtatgctttaaagtcaaatctctgcaacagaatgccaggtgtagagttacagttgattaataagacacagcccctgtactcaaggagtttgtaatctagagaatgaaagacatataattacaatatggtgtgatggttgtgatgaacaaggtaaatatagggtgtcataagagcacacattaaccaatcttggaggggctgtcctatgcaaggaggtcttcatggagacctaacagctaagctaagacctgcctgttctgcaagtaccttacttaaagctattacataatagctgctggggatgaaaatattctagaaggtatgatagtcacactgtattattatatctttatgcagtagcttttatttctgctgacatcatcaggcatctttgaaatttcttttttttttaacacttcgaaatgctgtgaagcaaagtatcatccctctctttcctcaccctcttctcttccttaacacctttcttcagttctagctgttggcagctagatgcaacttaataatgccattttgttttcatttggcatgtcattcatcattttcaaaataaataaactttaattttgtgctgccacaatcaggaatatttgaacatttagtgcttatcttgggtatctgcccttattactttctgaggagctgccctttatagcaatcagggaactataccacttggaagactaattgtctttatacaaaaataaaatccttgtgttcagatttctgtcttgagtggctggtttgaatctaattttctgttatatgaagcaaagatttattatttaacatagtttcaaaattaaaattgatagtgaaattttatgtgccatgcaatgtcatgtgtgttcttttaaggtgaagattcattttttaatagctttattgaggtataattgacatataataaactgcacatatttaacaccacattttatgtgtgatatgtatgtgtgtgtgtgtgtgtgtgtgtatatatgtatatacttatataggtgaaatcatcaccatagtcaaaataatcagcatccccatcagtcccaaaagttttgtttctcatgcccctttgtaatttttccctgccctctcaccagtcaactgatctttctgttactacaaattagtttatagttttaaaaattgtatataaagggatcttaattatatatattttccttccagcagaattattttgagattaatccatggtgttgcttgtatcagtagttcgtctttactgctaatattctggtgtagggatatagcacaatttactaatatattcaccttctactgttagctactacaaacaaagcaactgtgactatttgtgtacaagtctttgtagggacaaatgcactcacttcccttgtgtaaatacctaggagtgggatggctgggttatatagtaggcatatgtttagctttttaagaaactaccaaactactttggtacaagtggttgtaccattttacattcccaccagtgggaataagagttgcagtgcctccatatccttggcaacacttgatacagcctatctttttatttttagccattctaatagaggtatgtagtggtatctcattgtggttttaatttgcatttccctaataactatattaattttgaccaactttttatgtgcttatttgccatccataaatcttctttggtgaagggtctgttcaaatctttcccgattttttattgagttattttctaatgattgagatttcattttgaggattttgtgtgtgtgttgttttgtttagcagcttagaacacacacatttattatctcacagttactatgggtcaggagtccaggcatagatttgctgggtcttctactccagggtttcatctgaaagtaacaatcacagtcttggccagggctgcagttgcatctcaaggttttactggggaaggttccactcataagttcacatgattgttggtagaattcagctcctcgtgggatgccgaactaagggtctcagttatttgctcagttggagattcccctcagttcctgccacatgggcctcttgatatggcagctcacaacatgacaacttgcttcatgaaagccagcatggaagtgtttatgtttactggtttattatgattaacaaaggatacagatgaatagcccgatggaagagatgcatagggcaagctatgtggaaggggtatggagcttccataccctctccaagtaggctaccttccaggcacctcctcatgttcagcaatctggaagctttgcgagttctttatgtattctatatacaagtcctttatcaaatacatgacttgtaaatattttctcccagttttttgcttgtatttaaatttcctttttagtgtttttcaaagggcagaaattcttaattttgatgaagtccaatatgtcagctttttattttatggactgtgtttttatggttttaagaaatatttgcctaactaaaggtcacaaatattttctcatattttttttcttaaagtcttacaattttaggttttacatttaggtgtatgatccattttgaattaatttctgtatatgtgcaaggtgtatatcaaagttcattttgtgtgtgtggatatccagtattgtatgatattcaatgctgtgttttcacctaatagcttttaaaggaagaattaaagcaaagccaagttaaataggttataccagactgttagttttctttgtgttatccttgactttgttaggttgcacattttgctggaacttcttaaaacagtatcctatgattgaacttcttcaacctcaaatttccagtctttatacttaaccaatgaaatgttatttatatactctttggaaacataacatatactgtagataattataacaaaagtgtaatgggtagcagaagatattgccaaaccaaaattctggagaccagatgagacaaacacataatatgtgcctgtatgggtcacagtgctaggaaatacactgaaaagtgaacaaagaactaaaaataagcctcttataagaaaagctgctacttctgggctaatctattagtagtttgttttccttaatttgaaaaagagcttcagaatcagactctagagtgaatcttttaaaactatatatattatgcatgtatacacatatacatactctatgcattggcttagataatataaaaacagcacaggaatagtttatgctgtagtattgtgcagtcttattcagaaataagaaaaatagtttttccatttagctgtgagtcattactttttagtttcgtggagaaattaagttttagtgggggtcgatacagcttttttttttttgtagaaaatcaggtagcatgggctttggagtcagacaaatctcggttttaattttcagtgtccttatctctaatatagtaatattaatagttacctcttcctgggttgttgagaggtttaaatgaaataataagttaagtactggcacagtgcttaacacataataggtattcaagatatgtatacttctttatcatcaggggattgaccttggaagcatatgggtacatagaaagaacccataaaaggatatgacaaggggagaggagtttgttttcattagatttagcaaattcattctttcccccaactccccagaaaaattcattttaatgctattattttccttatcacccataaacagacagaaaattggcatgtttcgaaagagtgttaaaactgcaagagtattacatggtatcattacactaccatccattatctaactgggtttatttatgaaggttagatttagataatttagacttaccctttttccattttgtggggaaagagaatcagaaacttgaaaggaagagctcttccaaacagaaagatagctagaatctctctcaatagtctatataatctcttctaataatctttagcaaaagtgacttttgagttcttttaaatatttcctgtattgattctaattcagtgctcatttcatgtgatgtctatagaactacagacttagattacagtcagaaaactgagtaacagcagacaccaggttttcagctgtttttagggtttattcagattgactacatcacattcatttggatggatttagtgacatcaattgataattgtaaagaaactagcctttaatctgacattttcatattgatattagataggagccacatgactatgtcatgggttcattcacaagatataataaacattattttcacttgtagcataaaagcagtctttagtgttatcttagaagcattaaaacacacacatatataaaatcatatagattaaaaaattctatcagcataggttctgtaattgttaatagatgtaattgcataaggtcgctatgcattatttctcattttcagatgaagcctgtcaccttgacatttttatatataataggaatccacaggttgttaaaaacataaggaaattaagataatttgaattcagattataaaatagttcaggtctattctgatgaagcaatgtcacttaggtctgaggcttttgggtcagcttttaaaagtttatcttatttttcattaaaatatgtatgtataatactctatcatgcaaagagaaatggtcaacagaatttctgtgcatatatggttgctggttatttgaaagccattctcctcctaggattatttgaccaattttgtattcagcttagattagggagaatatagtgtctccttaggtaaaatacttactagaaccaaaaagtccagattaaattgtttttatttttattttactgcagttttgtgcagttgacctgattttaaaatataaaactaggaaggcatatttttcatctaccaaaatgtgaatcttactttcattttgaaacaaacacctctgctttaagaagatgaacggtagtgataaatacaaaaacgttaaaattttttaaatgaatagcgtttgttgatctttaaagaaaacataaatgtgaaataactttagagcttaaaagttttcttcctcaaaccttttaggaattgattttattatccaaaacaactttattcatactaagtgtgactatctgaataattaccttacttttatagttttttttttaaaaaagctcttctaactgtaattatcctcaaagaattggattaagaaattcaataattttctgtcattagtccagcgagatatttactgaatagccattacgttcctggctgttaacactacaaggactccagcaatgagcaaagcaaacaagcccttgcttttccagagcccacattctagagtcagatgctaaacaaatacacagatacatatataataaaatattggtttaagtgttgaaaagcaaaatcagagtaagaaggcaggtagtcattttaaattaacattgagaaatgtttccattttaagcatataaattctttggcttctctttttaaatttgcttttgactgtttgttgctggcgaaaattatttaaagtaattaggaactcatcgtaaatattttgtacactactctaaaaatctaattccaactagtgaatttagcatttataaatggaggtgtctatagaggaataaaatctttggttaaccactactttacttttagcagtaaagtctgcagctcatgaaatttgtaattctggagtggtttcagtttgcaccatcccctggggagcctgttgatacagcactgagctacagattattattcagctgtagaagttttatgcttaggcattttcttacatcttcttctctcagtcagttgaaatcttgtatttttgccaaataaaacaaatcctatattaataagaagctataaataaacagtaggagcatgagtcagagccagcatcaccccattccttgtgtgtacctctctagtactccccagtatgttccttttgcacaaacatgtagtactgcgtaactactgttctacagatgaactccagttatttaagtgaggcctgttttttagaactaagtaatactgtaactagtagaattctggcatgttaccacagtcaaaagcagaatgtgaagctgtatgctattgatgggaggaaaaaagaaatatatttcctacctttcctgtataaagcccagaagattcctgttagatttccaaaatgggtttttatataatataatataattcaacatttttttcagaggaaaaaagaaaaagataagttgcttgaaagtcccatctcttttgctagtcggcttctgtctgataaaattttattctgttttgcttcattgtttattcattcagtagatgttcattgaacacttactgttaccaggcactgtgctaccatagacggtataaagacaaataagctaaaatccttgttctcaaggaatttattattgtagagaaaagtgacttgtaaatccaaaatttcatactgggataggaactataaaagagacatcctgcagaatactgagattataaataaaactagtatgtttgaagcatttagtgtcctagctgttttatagaagtcatttcatttaatcctttcaacagctttatgaggtagatatcattacactattttacttgtgccaagagcactacattcatcaaggaaggaggaggtagtatcaaatttttcagaaaacaagagagttggttatagaaggatgagtagggtagagagtaggaggaagatgaggcagtgtggcatttcagacagagaggtgaatatgtaagcacacaggatgagtgagagaattgttggaatgtagtcagttctaggaaataaaagatggcagggtccagatcatgaagtttggttcttaacctgtagaagacagaaatatgatcagacttgcatttcaggaagataactctgtaattgtttgcaattcctgttaaacgaagaaattttctccagcattgacttatgtttattaaatacatataaaaactaaattctagaaacatcttatacagttatacatcacttagcaatgggatacattctaggaaatgcattgtcaggcaatttcttcattgtacaaacgtcatagagtatacttacacaaacctagatgtatatctttgtttatatttattttttcatatggaaaaccaaatttcttagccatgttactgaatgtcagtcatttcccttacttgatctgcatcaccaacattaagtgccatgtatcagatttctgtatatgttccattataatctcatgggaccaccatagtacatgcggtccattgttgacagacacatcattatgtggtgcgtaagtgtacttatagttttacaactacaaagtgaagcacagagaggttacataacttagccagtgtcacacagctaataagtagcaaagtcaggattcgacatgttaagccaacttcatggacttaaccacagtcctgtattgccactcctcttcatttaaaggcatgcatgcacatattagatttggagacagttctagagacactgaattggcaactacagtcgacaaagagacattgcagcaagtacctctacgttgtttgtttctgtacccttaacttgcagtggtctacaagaaagaatgaaggaagggaagtgatatatttgtcaaccctaactacattgtaaaatgaagctttttttttttctttttttgagagggagtctcgctttgtcacccatactggagtgcagtggtgcgatctcagctcactgcaacctccacctcccgggttcaatctgttctcctgcctaagcctcccgagtggctggaattacaggcatatgccaccacacctggctaatttttgtgcttttttttttttagtagagacggggtttcaccatgttggccagtctggtctcgagctcctgacctcaactgatccgcctgccttggcctcctaaagtgctgggattacaggcttgagccactgcactcggcctgaagcattttatgatgctcactaccaagtgttcataagcggtaaataaagcccttgggctaggtaatgtaagatccattgcaacctggagatgaagaactttgtaaaggggataattgttatcacccatcagagcatcagagttttaagatgatctagatttagtcccactaattatatttctcctaacttttatagacagagaaatcagtgaaaaatatgtatttctaaggattaaatcccaatccatagctcaaggctacctttatgtctaatagttgtgatataatatgttgcttagaataggttctataaatggaattcacacataggaccccagaatcgcttcttcacagggtttcagagttggaggacatataaaaggataaatcaatccataaatctctaagtattcctaaaagaagagtggtgtgtcagttattggcaccagtacatcatgaatcctgctgggctgtggagaaaggagaaactaacctgaacaagactatactctacacagctgtccctgacattctaccacctgttagcattcagtattaatttcatggatcaaatcaaggcatgcaagtgcattaaataactttttaaaaaacaactgctgattgctgacgtctatgagggaagaaaaattaggggctgttattttcctatcaaccatcactctcattaacaagaacaggaaacattacgaataaataaaactcttacatcataccagaaaaaagaacagctgaatcccctaaaggatttcatattctatcatcagacaacgaaagaaaataattccatataaatggctgcatgaatcattgaaagaaacttccctgcttttttaaaagagcaactagaagtatttactttttgaaaatagagtaaccatttgttaaaccgtatataccattgaagatgttttgggtataaaagggaatttccataataattacatagtaatcttttatagccaaagttatgaagaagatcaggatttgggaaaattgtggtcaatatttgattttccttttctgtttgatagccttatctaaattcccctagcttgaatgtagtaaatatgagtgtgtaaaaatgtgtatctaattcacctcttgggggaggtttaatgtaactataaataaaaattctttccccaggttaaaaaaaaagttacatagtgtttaattctaccttttctcatttctctatatccaaaactatcaccaagtactgttaattttactttataaagctctcttgatatgtctcttcaacctcatcaccactgctttaaatgaggcatacttcctcatttggattatggcagcagtctctcttcctttagtctctccttcaaatccacctccatccttcatatcatccatcatgtatttttccctgcctaaattccttggttggcttctattaaatccaagttccttaagcatggcaaacaggggccagcttccacgagctggtccatacctctcctgccttatttcctgacactttcccttataccttgagatccagcttgccagtatttccccaatacctccaccgcatatacaaccacatacatatacacccttatcccctccctcatgtaccacccatatataattctctttaccgcatcctttatcacactcctacaagccttgaagcaatctgaacatagaaaccatctttgattttcaactcctaattgggactgaacatacttgtcttgaacacagattgctgccttgttagtataggtatcctaatatggcacatgtgtatagttgaagctataatgcattccccaagttccctttcaggactaaagggttatttcccaacagctggaagtcctgctgccagacagccttcttcaggaattgccttgtccccaactcaagacaaccctgaaggacctttcccagttttccatggggtccactgaggccttgagattgtactgaagtcaacttctccctctgctgtcgcttcccttccacaggtgtttatcacaagaacaatccttaataaacttcctgtaagcacactctcagagtcagcttgctggggaacccaagctataacaacatgtttatcttgttcacactttcttctgagttctaaatcatgggaagttacagttatccaaaatcttactaattggaagatcatttcatcagacgtgtattgagcacctgcttcatgtcaggcattgtgccagatacaatggaaacaaatcaagacttggcctctgtccttgagtttacagtctgaggtgacagttacatatgaacctaactgtattaaagcatcttgagaatctttttgattcaaatgtcaataattttagtataaaattcaaaagcatggattttgtggtgttacaaagaacaaaaggaaaatatttcaggggaaggaaaatgaatataaataagtagaatgaaattttagaagagcacagaatttgtctttataattctgaaagcctttagggaaaaggtaattttttcactttttattttgacataatttcaaacttacagaaaagtcacatgaatactgaactcccatacaccctttatgcagatatatcagtttttaacattttccctcattctgtttctttacacacatacaaattatttttgtgaactctctgagaacaggttaaatactacattatatcacttcataccttaaaaatgtagtatttcctagaaacaagggtattcacctccataaccacaatgcagttgtcaaattcaggtaatttgaccttgatctttaatctacagtccagattcagattttgttaattgtccccaaaaagatgagtttaggaagagtcatataacttaacatttgtaatgtaaattaaagatctcggaagtttgctaacctgatttaaataccacagtgaaatgaaccacttctgattttctacggagaaagcaagggttaggtccaggttacctgtaaaggtgtgacttagggctccccagaagtgaaccttgctctggagaccccatttggtgaggttcttttcaaaagagattgtatatttttgacccagggattgtcgatttgttgagctcccatgtaagtatgccgccttgccattgacaggtcttcacaatgctttcttaaacgacattctttggaactgtctttcatagtcaggcgacccgccagccaggccgccaggtaggtggaagggcggcttcgggaactagatccggctggttctctgctaacatgtggtcctcgatgctctagcggattggccccaaacctcagcacacagagctttggtagggctggggatgcaggtcagcctgctgaaggcgtctagaggacttgggcgggggcgtgacttcctgctgcaccacttcctttccagccacgtgggcttctgggaccctatgacataatttctggagtggtctgttgggagttgtggcggcggcgaggcccaagcacagctggccaaggcgggtgtaaaacgcgggtcgtgtccaccccaaagctcgacgcctctagaagccatggcttttctgctgaagctagagccggacatgcaggggaaagtagatttgtttcgagcccgtatcgcccaggaggccgaggatctcgtgtccaccttctttcctcagaaggtcttggagctgaatagccgagttcaggagctccggctgcaagacctgtccagaatccattcggtgccaacctcggagcccctggccaccccaggcaacaagggagatgggcccaaccaaaatctgccagttctgctgactcagttctccatcaaggtcccagcactgcttggcagcgagggacagcttctgcggagcaaccagcatctggtggagttgactgagtgggtgaaacctgagatcaagctgctgagagagaaatgcaacacagtgcacatgtaggtgcacccgcttatcctgaaggtgcaggacggcaacaacttcagggtgtctatccaggaagacactgtggaccagctgtggaccgtggatagcacagcggcctcctctctatgcggcttctccacctactacaacacccaggccaagttggtatccaagatagtgaagtacccccaagtggaagattatcgctgcactgtagcagaggtcgacgaaaacgagtacctgagtgtgcgccagatcctgctgcacctacggaacgagtatgccaccttgcgtgatgtaatccttaaaaacattgagaagatcaagatccctcggagcaccaaccgtgataacctatactgatagcctttctccaccccatttgccttcaggagttggcggagctgtttaggcacctagaaggctggttattaatgactctacaggtcatgaaattactggaaatgtgtgttaccatttagaatttcatacagcttatcctcatactgaatcatcttttggtgtaatttttatttgattttccttttgtgaggagaatggggacaaaccatcaaaaagaaaagactgccatttttaaaagcagctttatagataaatgttggcccaaggtttctttattatggccttagcgacattgaatggttttaggggctacttaaaaactaaatcttaaagttaaatgaagtttttcctaaagttctgctatccgttgaactttgttcaaacttacagaaatgctccttttacagcatcatttttctttttttgcgaggaacggagtttaaagggatatgtttaggtcattgtatgcctccagtttaacagattgaaataaaacttggttataaaattttgtgatggcctgagtgtgcttatctgagctttaattttcggatgtggacaattcagatgataatttcctacttcaggtggactcatacacttgatatttttcaactctgatgggtaagaaaagtaagcaaagagtaatgtattttaattattctaaacaaatggacatctacttcccttagaatgaaaagaggaatctgtggaaaatgacttccttccataatcttctatcatctcaggatcttcatttctttttacacaatttagaattccttctgtatatccgtttgtctctttaagtctctgctaaatccatcaagctgtgtatcctgtaatactttttcccccagttgattttcattgccctttctttttgtctcttagatatttcttaaagtccctcattagcatttccctctcaggttatacaggtcattctttttttttttttttttttgagatggagtcgcgctctgtcatccaggctggagtgtggagtgcagtggcgtgatctcagctcactgcagcctctgcctcccaggttcaagagattctcctgcctcagccttccttagtacctgggactacaggcgcatgccaccacacccagctaatttttgtatttttagtagagacggggtttcgccatgttggccaggctggtctcgaactcctgacctcaggtgatccacccgccttggcctcccaaagtgctgggattacaggcgtgagccaccgcgcctggcgggtcattctttaaagaccctaaaatgtggctttgtgttcttttgctacgtcgttgaggggaagccattgtcttctcaacagtaagctatatggttggtatttttaaagttcagcatttccagatttcatttgcaggtaagataaattactgcactgtgagtctattctaacctatgtagattagaaaaatcatacactggtttagcggaaactttattttctttctttctttctttctttttttttgagatggagtttcgctcttgttgaccaggctggagtgcagtggtgcgatctcgactcactgcagcctccacctcccaggttcaagggattctcctgcctcagcctcccaagtagctgggattacaggcatgtgacaccatgcccagctaattttgtatttttagtagagacggggtttctccatgttggtcaggctggtctcaaactcctgacctcaggtgatccgccagcctcagcctcctaaagtgctgggattacaggcgtgagccactgcgccccgccacggaaactttattttcaaagtaaactcctgaaaaatgataacaagtgaaactattcttttgtcgaccttctgaaaagcctgagtctttcaaatctgtgcttaaaaagcaacaacagcaaaaggtattgcctaatagaaagacgtcttacttccttccccttcaagtaaaaagagttctttttattttccctgtaaggtgttctatctgattcagaaaagtgctgggaaccctaaatcagttcataccatttgacaggctttaattgcacacaagtgtataatggacaatgtaagggaagaacaaatgttgcttaatttttcaactaatgttaatcatctaagacttaacatatctgttcctcacataatataatcatcttttgcttgtttcttttactcaaactgtcaagctttatgacagattgaaataaattttctccaatccctggcatgccttttactgagaaaatatgtcctttgtagttaaagatttctggtatatgcatttttcacctttttccaactctgtatcaaattaagttggctctggaatactttataaagtccctacttctgcaaaaattaatctctttgtgattttcccctttcttgcaaatggttggaaaaacttttataataataaacttaggaactggtgttacaatatggtatccaatgtgaatcatttgcctgttattagtacttgttacttgaagccacgtttttgttccttttaagatggcagctgaattgagcaggtgtttttttttttttttttaagaaatggttttaaaaacttattttggaattaagtaattttagttttaaattctaaaactaaaacatgaagaccactaaaatttgattggaagttgaaattagtagatctaatttttatgattgagtgaaatgtcttaaaccacataaatgatggagaagagtcttaaagttcttaaacttcaaacttcttaaacgtttgggcttagttttaaaaaattactgaatcgtttataaatttttctttggttattagaggcaacatttgttttgtagtctttttttttttttttttttttttttttttttttgagacagagtttcactctgtcacccaggctggagtgtagtggcgtgatcttggctcactgcatcctccacctaccaggtttaagcaattctctgcctcagcctcccgagtagctgggattacaggcgcccaccactaagccgggctaatttttttttttttttttttttgtatttttagcagagacggggtttcaccatctcagccaggctgaccgggaactcttgacctcgtgagccacccgccttggcctcccaaagtgctgggattacaggcgtgagctgctgtgcctgtcctattttgtagtctttatgaggtttacatatttatatagaattcttaccaagtagtctcaaccattaatagataactgtgtgatcaatttaagtgatttttaatttcaggccagatgcagtggctcatgcctgtaatcccagcactttggggggccaaggtgggcagaacacttgaagtcagttcaagaacagcctggccaacatagtgaaaccctgtctcaagcaaaaattaccaaagttagctgggcatggtggtgtgtacctgtagtcccagctactctggaggctgaggtgggagaattgcttgaacccaggaggcagaagttgtagtaagctgagatcatgccactgcactccagcttggctgacagagtgagaacctgtgtcaaaaaaataaataaataaaaagctttttaatttcaaaagtaccatctcaatggtcagaaatttgaaaagtataaaaggagaaatcacctatggtttactagcctaacaaaatcattactatttgtgtgtgttttacttattttaaaggatgcatatatgtttttacatcattgcaatatagtatatgcctacttttatagaggataaacatctgcatttaaatccaatctaatattataacttcgtttgatagatatcccctgattcagataacagatacatccattcccccaaatatttttaaggctctgtttcctaattgtgaaaatgatacttgtctgaggcaggaattgtgattagagtatggaacatagagatcaagtagctgggaggaaatgtgcctatatgactgtgagaatgtctagatatttagaatagggttttactctgcttttaggttggggcttcataatagctttagcaacatatctgatcattttattactcagtgctttttccctccccctagagcatttaattacctctaaaaatatgtacaagaaagcattcatgccttatactgattagatgaactgtttcagctttcatgatttggtatgagtaggagggaattctacttcctctgtcagcacttaaacatttctggaaaatgctgtagtgcattgacatcaggcatttttaaaaaattactgatctttgagaaaaaataaaggacccagtgagttacagaaatagatgctggaccatccctgttctctgcattagaaaactatactgctaacacatagaaataactgctcaccttgaactgaaattatccatgggaagccaaatacatccgtctatctatccatcaatcgatagatagatgtatttgtctcattctgtcgcccaggctggagtgcagtggcacaatctcggctcactgcaacctctacctcccggtttcaagtgattctcccacctcagcctgccaagtagctgggactacaggtgtgtgccacaacttttgtaattttgatagaaacagggtttcttcacattggccaggctggtcttgaactcctgacctcaagtgatctgcctgcctcggcctcccaaagtgctgaaattacaggcgtgagccaccatgcccagcctccatattggatgattatacatttgtatatatttttctttgcttgctttattttgatgagtcttcaagtcagtagcagaattttattagtgaagtgtagtaatcccagttactcaaatttaaaatgtttcactagtaaactgaatttaacgaattctctttcatagagaatgttgtgttatttttccttattggtgaaaacctagctggtgcagatgaacaggaatcgaacctattatcagtaaaattagattccttttacaatttggccatttattttagctttattatttaatctcatttttacaaagttatgcaatagtatattggaaaaataatattgctttgaaagtgtgaagtatttagaatttcttaaataaatatatagtttccagtttagatgtttgagatttagaggtgtacttttagccccttgttttatagatgaagaaatttagaatcagagatatatatggcagcacacaactcatctgtgacaaaacaaggtctagaagtcaaatcatcttccatttcaggctagtgcacttttcactgcactttactatgttctaatcagtaaataaaattacattagaagagagttctttcagaaatacgcaaaccagtaaaatttcaacaaattaacatccctttcaagttgtgtgttatttttttctgcaaaatgtaagagaagttgaaatgtttccaactcagaatggactataatatttttactgaattaaatattatgtaaagagctgggctcggtggcacacacctgtaatcctagcactttgggaggctgaagcgggcggcttgcctgagctcaggagtttgagaccagcctgggcaacacgatgaaactccatctctactaaaatacaaaaagttagccgggcatggtggcatgcacctgtagtcccagctactcacaggctgaggcgggggtgggtggatcacttgagcctggggaaacagcgatttcagtgagtcaaggtgccattgcactccagcctgggaaacagagcgagaccctgtctcaaaaaataaaataaataaaaatattctactggccaactcctcccccaccttctaaccttcagcaccaaagaactgctacatagatttgtcatggctgctgctcctaaaaaacctacagaataaaaggggaaagaagagctgtagttttctgttcgggaggaagcctgaaagggtcatttcccaaaagaagtttatcttttagagctggactggtcagtacagtagtcactagtcttgaaatgtagctagtcctaactgagatgtgctgtaagtgtaaaatacacactagattttgaagacttagggtgaagaaaaagtaaaatattttaataacgcttatgttgcttacgtgttgagtgataatattttggatacattaaataaagtagattattaaaattaaatttatatgtttccttttacttttttattttgtgtgcccgaaattttaaggttatatatgtggcttgcttatatgcctcacagtatatttctattaaacaacactgctctggaactaagatttctaaggtaactgagatgatccttggagttgagcctaaacctgctcttgtggtatattttggagatgtgggtttccattaagtatagatttttttgactcctagtaaatttttattgattcgtcatctggttcataatgtacaattcagtaaaagccattcagagagaggctaaacattgtaagccaaaccttcttacagtgcaacttggtcttggaacttagaatgcttacaggaatggatggctagcatgtgctttatgcaagccttttaaatatcatatccaggcttttggtgagagactagagtactaatattctgtattgctaattcagggctgctccatatgctttataaaccaaatagagggtagatttagcatgaatattgagacatttacccagtgtttttatctggatgaaagaataacgtacctctggtgcctcgagagtacctataggcagttaggctttttctcaaggagcaatatttgaacactcaattaaatccccatgatttcattgaattcccataatatagttatatagtactcattgtattctgtgtgtgtgtgttttttttgtttttgtttttgttttttttttgagacagagtctcactctgtcacccaggctggagtgcagtggtgtgatctcagctcactgcaacctccacctcctgggttcaagcaattctcctgccttagcctcccaagtagctgggactataggcgcacgccaccacgcccagctaatttttgtatttttagtagagacagggttttaccacgttggccagaccggtcttgaactcctgacctcaggtgatcctcccacctcggcctcccaaggtgctgggattacaggtgtgagccaccgtgccaggcctgtattctgtatttttatgtatatcctcactaaataagtttcttgagaatagtgtagggttttttattcaccctttttccattatggtgttttgcatatggtaaaattctaaagtattctgaattaaattgagctaaaccaaacctggatgaaactaaagaaaatcgtttctcccctttcttattagaggaggcactttgttacaacagaggatatatgtggataagtgtacccaggaatatgtaacaatgttgagacatctacaaatctgattcagaattaaacaaaggccaatgaagtttctacactgttttctggcttctaattaaacatttttttcatatcacaataatataaatattttaaagtactccaggcagttctccttcagtattcccaggatgtcattaagcctattcaccctgcaacagctgcaagttattccaaacatttgtactgaatctttacactctacaagcccatttgaaatcaactgtgtcaccctattaacagcttcagtaattctctattacttttctaaccaagagttagggagaaataagtctagtatatcagaatgaagaatcctgaaaattgcttttcaaaaccgattctctgtggtcacgaacataatgtttttatttacccttccagattttggtacttaaaaagttagtttcttaaatgtgtaaaatttagatcatttgataaatgattaaaaagaatttcccttaagtttattaagtcttatttggtagtaaatataaaagacaaaacattccatgtaaaaattatttcatacattttaaacagtttaaataaagtaagtgtagtcaactcaaaactccactgccttattcctctgggtcttgcatatttattggtggaaatttttctctgctatttttttacattttacattgtgggataggcacagagttattgaacctatgacctatatattccacagcttacttcaatgcttctattaggcacccgtccagagttgaagaaacgtctcagatcacagcaggttctcaaaaaatgtcattttgtttagcttcatttcaatataacattgatgagaaaaaaaatcagttcccagctgggaccactgtctgtgtggaattttcacgttttctccatgtgtctgcacaggttttctccagtttcctcccacatccttataacttttgcttcacaaacatttattgacttaacttacatcactacgaccaccatcacttactgattcaccaaaaattgcataaattatcttacttgtttttattagtttttattaaatgtatagctcacatttatttcaatatttaatattagaagtgcttggggtctttatttagaagtttggtgatgtttttatagccagaaatatgctgtaggaacgtaactctcatttatatcaattaggctatcataaaactggtttcctttatgtcatttcgcttaaagaatttatggacgacgtgaggaatagtactcaacttttgcttataaataattaacagatggcatgaaaaataattaacagatgacatgaaaagagacctcttaggaagcaatttttacgagcctgctgaactgggagttaacattttcaataagaagccattaagtcaaatataatcttttgcatttaaactctacatcattatattactagaagtctaaaaaccaaacagtatggtaggaagaataaaatgttacttatgaatataatttctgattatacttttagaaagaggattaaaagtattgacaacaaatgaagtcagaatagcttgattaaagtagtttatttaaagtatctccttaatgttatagtgtatgctaattatttgctttgcatatgtacacatcatgacatacatttatgcattagctgagacatgttcattctgtaagttttgtacaaaactaatgatcttcagttacacaagaacatttaaaagttttacatttgaaatagataattaagcaatgctgtgtgaaactgaaaaatgaaaactttgattaaaaaaagtattttcaaatataggatagtacatgtatatgagaatacttttttgggtataatcttagtaacatcattatggtgttatgtaaacatatgacatatgacatataaaattatagtagatagatcactgtgttacccacttacacattcttctgtcgtattaagcaacaaacattattcttatctataataaagcagatatttctgtctgtcatacatatgaaatatttgtatgtatttattggaagtaatttttaaggctagtctttttttataatttcaacttttattttagatttggggtagatgtgcagatttgttacattggcatattgggtgatgctgaggtttagggtatgaatgatcccatcacccaataatgagtatagtacccaaccagttagtttttcaacccttgagtagacattgctccaaaggaagatatacaaatggccaatagcacataaaaatgtgctcaatatcattagccattagtagaaataaaaattaagaaatgtttaaaatatttaatgttttatttgaaaaaaaaaacaattaaaattttaaataacatttttaatggaaaataattatatctcccaaagcaaaaaaaaaaaaaattagtgagaagagtagcactgttttacagttttgcagatttttaatatgtgatttaatggaagataacaagattcttatatatttctgtattcagtctgttgcaatatattgttttagttgaaatatatgaagaaaatctaccctcatgcaggtaagtagttgcaaagggaaggagtactttaatagccttttcaaataattgtgaattattgttttgatactacataaaaactcagcaagtggtaatttctttaaagattagttgcactatagaatctaaagccatatcagtgatacttttaccctctgtaacattaaaaatccattgatctatcttgcagtttgaatggaacttgtacccatgcatgattttgtaacatcattcactgctcatttggaagatactggttcactaagagttaggcagatcttctaaatatgaacatatttcattatacaatgtcaaaaaatcacattcattaatatcaccacgaatcacatcaagaaggtcatactcatggtggtagatacatggtttccgaaattcggattttcactcaaaatcccaaattttataatttgcaaatactgtcaagtattttctttgaaatatcaggcttactgcatttttaaaaagtgcttaatgggttacccttgcctgaataacaataattcgccattatttcaagtaaaagtggtattgaaaaaagtgggttgttcagcttgtaaatcattcacccaagtgctttttcttgagatagccattatgcttcagtaggcagcaaaacagttttttatgttcttgccctttcatcacagagaatgttaataatttttactgcttcaacaaggatattctaaactgaaattggctttaaaatattttattcatttattcatttgttggctgattcattgttactgtatgtggcggtgaagaatacagtgactgctagactagcttggtgccactacatagatttatactaaggcctagcagtttggctttgctttttcaccaacagagtaaatttcaacaaagtgcaaaaaggcttgaaaatagtttgacctgaaagggtcttagagattcttgcctccttagggaaaaaactagttaaaaatctattataatagctctcctttagctagtttacattataaatcgtttgtggttacctactatatgaaaggttgtagtagatcctggggattcaccaatgaacaaaacagatgaaaatgtctgctgttatggagctcatggagctcatttataaagggtaacgatatataataggtgttagagagaaaagtaaagcagagaaaggaaaggaggtgtgtttggtgggaatgtgtgtgtacaatttaactaaggtggctaggaaagacctcactgagaaattgacatttgaatgaagatctgaagtgggagcaggtaaaggtgtgtgcctctacaaaggccacagctgaggccgcccttctttatctacctcttttcatctttccaacttccagaccttttttttctgctgataactcataccttttaattaaactttaatttaatttaatttaatttagtttcttccaactctgctctccaccacttccttgcccctagcacacacacaattaatcagcacttacaaaaacaaaaatttacctctttacaaaaggtacagggatagagtagaggctttgaatacttgtgcttcaattatttttctcctgtcatcttttatattaaaggaaataaaatataggggtgtctccttttcctggttgaattggtagagaatatctatggcagttagtgctaatgtttataaaaaggaataaacacaagtgagatcatgatggagagagaccaaatcagtagggaccaaattataaagagatttcatttctaggctaaagagtttggattggtcatgtgtgcctgtcatcctttatttcattcagtagtggaacaatggctctcaactatgtggttgagggaataaacttaaacaacaaatctaaatttcctatatcagttgcatttaactgttgcgtttcctcagggacttcactctcctcaaactttttggtccctttttttaaaaaaaaaattattgaacacttataagtgttgaaatactaacttgtctaatctttataaacaatcggtgcaataggtgttgttactgtccctattttactaaagagaaaatgaggacacagattaaggaacttgctctatatcctacagctagaaattaagtgatggaagcagaattcaaacccaggcagtctagctccagagtccatccttttaatctctgtctgtgccactctggccagtgtttgtgaatgcagagtcctggaactatctgcatcagaatcaccagggatacttgttaatagtgaaaaattctggcccacctcagacttaccatgtaagaaattgtttttcaagagttgaggaatgtgggtatttatattataaaatcctgcaggtgattctgatatgtatcttttgttaagaacttctgttttagaaggacctaccattggcactgtttttgcttctgatcccagcttcctatgattaaatgctttctgaaagatacatagttagtacagaacttaatactattatactattctatactattttaccccagtttgacttttaagctgttaccacctgaaatttaaatgaaatcctttttagaacaatacttgaccaaacaatttaaaaattgtatttcctacaaatgcatcataccttaaaaatgcactttaaaactgaatggaagccaggtatggtgactcacgcctgtaatcccagcactttgggaggctgaagtgggtggatcacctgaggtcaggagttcgagaccagcctggccaacatagcgaagcactgtctctactaaaaatacaaaaattagctgggcatggtggcgggtgcatgtaatcctagctactcaggaggctgaggcagaagaatcacttgaacccaggaggcagagtttgcagtgagctgagattgcgctactgtactccagcctgggtgacagaatgagactgtataaaacaaaacaaaacaaaaaaacaaaaaacaaaaaaaacaaaacacacacacacacacacacacaaaactgaatggaaactgagaacttactgttctatttatgatgaaagaaaactggtaggctttagaaagtacaccctatgtgatatgaaaagtgaactcttctagattgtggaacagctttatatagtatcatacctccatctttaactaggattgcagctggcaataaagctcagcttctaatgcgagcaagtgttgagtttggctattttgttaacccaagatcctgagagaaaatttgttcactgatgtacataaagcatattatggttaaaatttcttattccactttgtagtttgccttgttaagactagtctttcctaaaatgtgctttaggggcattttatagtcctccatatttctttatgtgacgccaacatcaaaattgctttgaaaaggatcaagatctggagtgaaggctggaggaatagctagacactgaggctcatgcaaggagagttaactttagaaatatatattacatgaaacccctttttttctccccttccagaaatttgtagaatcattgatatgaaagagttggctagtatatctccctgtgttcccttcccaccctgctgtgctatccacacaaacacaagtggcatttgaggtaacttttgagattctgctgggttaaaaaaatatatattttttgtctcaacccaatatgttcctttttttcaacaaaaagtataatgattctcctatatatctatgtttagctttttgctagaagtgtttcctaataacttttctcaggaaacttgttgactcaatttactgtagtcatagagcctcctacctgaccccctgtggtctgctttggtaacacacctgtaggaggcaatgtaatcttcaggaaattcacttcctaccagtagtcctgagtaaagtgaattttctaaaatgaaacatcttgtaaacattatatatgacaaactcccaaatggttaaactctttatgcatttagtgtttgatctttttccttaagaagacttttttttggattgctgtcctgttggcactcaacaaattacaattgctaataagtttcagaggccctaacttattttcctaaatcatatacttcccagtttttgaaaaggctctctattatagctaacaaagttttgaactttgattaactcaagtgtttttgttgttgttgttttgttttttgttttttgtttttttttgagacggagtttcgccctgtcgcccaggctggagtgcagtggcagcgatctcggctcactgcaagctcagcctcccaggttcacgccattctcctgcctcagcctcctgagtagctgggaccacaggcgcctgccaccacgcctggctaatttttttgtatttttattagagacggggtttcaccatgttagccatgatggtcttgatctcctgacctcatgatccatctgcctcggcctccgaaagtgctgggattataggcgtgagccactgcgcctggccaactcaagttattgaatgaagtaatatgaagcacatgggcagagacttcctggtcctatacctgtccaaggcatgtaaccaacattttgtttaagagctttccctagggagatcaatcctgacctggtttagaaacattttttcctgaaactctcatgaaaagagaagaatgattttggatgctactgtcttatcggaaagtatttacaagaaaccattttgaccaagaaactcaaaattaattctggtttttaaaaagagaggcatatattactcttagattgaaccttatgaaattactgatatttgactcaccaaaatgacagttttttatggtccaacctaatactttttggtgttaataaaaggggaggcagggttagttgggcagtttgtgggggacatcctacagagtttgacatgaaaagtatatcttaaatcaaaacttgaatttgtacttattaggatttcaagctcatttttcctctggtgaccttgccagcattatcagatttgtattaagtgtcaaaagtttcctcttgtcaaagtgtaaaccttggctcattcttgggccatctgttgtacactaatagttttgatttattcttctggctgacatgcgtattaatggtacagatgcaagctttatatttccttttatgggtctgtagttttattgcatacattagtggcacaaatacagcattcatattagctatttatatgaactatttctagttttggggtgactaatatactttgcttatgtttttactatgctgagaagccctgtatcgtagacattttaatagactttaaatgattacattctacttaattttaccacccctaattttgttttttgtaatttttattttcaggatatgtcatgatgtatgtctgtatatttttatgatttcaaattcccaaattgccattgctttaatgaatgagcacatttggtttttgatcaggaattactataactactagaaaacaacactagtgcaaaatgtgaatttagataaataactctgaaaggcctacttctagttgatgctttggctctgatttttgagggttaatatgttcttcaacttctttgacagcttgaaagttatgaaatagagtgatagaaaacaaaagctctctaggacagggacataggttagagaaaatttaatacaaagctgtttttgaaataaggctaggtgctatttttatttttgatctgcttttaacagtttcctatattggaaaaccaaacccatctctggaatccagtggatatgggccaaatataaaatgttaagaggctggtgttactattggtctgctatgcaaaactttttccctaatagaggtctgtgttgatctgtgtgaaagctgctcagtgtcacaagtgcagcctgagtttcattcatttctaggggaaattatgatagaaataacattcctttctattaaagataaagggctccaaccttgagccagagttttctaatacagtagaagccatcttatctatatagtgggtactagtagatagtctgttaataaacaatactggctaaaataattttttaaaaagatatgtatctttatttcatttgattatattaatgtgcactcattggctagttttgtatgcagggccaatttcttttctttgagtccaaatccactcttcagagttccatgttgccattcttgcataaactatactcacaaatcagcaaccataatttccagtcttggttacagttactgtatattggaataagaacttaaaggtacttgttaagcaatctgagggcagactattatgatttttatggttgctttgcaaggagagaacattttaaaacttacctttatctttttgctctcttttcacactattagtttatgtaatattttattacacaattatactaatacaattaatgaaagtagtcttgaaaaaagacacaactcaactagtcgtgaatgttccctgtgctatgggcaccagtcagtgagttttatagggggaatgggaagggtcatttaatcagtctgtactctacatagatacgtagaatcaacatttgataactctcagtagggcctgaattttattgtgagttaccataattaatttcagtggagcaaaatgtggtccttttcttttgataagccagtctccaatgcttttgttttcttaaaaagacaagaaacgtaactttgaaggctgtgttatacactaatattctgttggtttctaacaaattgcttggaagagggaattgggagaactatatgaaagtagcatattttctcatgcacaatattgcacaacattagaaaactgatgctttattttcatggtgaaatgttttgatgtttctccccgccccctcccctccatgtttctctaactttttctgggaataagagtaacaatacattgattataatatttgtccacatgatttcattccagaggaaatcctatagtatctaagccctacggaaagcctcataaagacatttcaggagtccattcgaagatgtcttaaaattaatgacattgttttgagtgacagtgccgaaatatatttctttctatggcaacattcttattctactatcctttttatttttaagtagtttcatttttgtcactgttgggttattttaaacaatttaattggagggaaagaaatacaaattcatcaaattttacctccagaattgaatttccttcactagttccttaataagtatttaagtaaaagggggtgcaatatcaagaagactaaattataaatatggtttctatgctgttaaaaaataacagtcctgtccttaattaaccattatggagattcctcttgaccaaatacctttagaactgtttcacagatttataatttaactagtaatttggtttaggtttaggtttaagtgacagaaaatccaaaataatagtggcttagataaattataagtttatttctgtctcatgtataagtttcagagatctaatgatagctacttaatcatcgggatccctgtctccttctgtcttcttgctccataatcctcaacttgcagcttctgtctcatggaacaaagacggctactccagctctggcagtcatatctgccttctagctagcaagaaggagaaagggaaggaggagggaagccttccaccattaccaccttgaagaagttgccatttcttcttacagtccgttgaccagaccgtgtagccttatttggttgcaaaggaggctaggaaatatagtctttattctgggtggccttgtgcccaactaaatatcacaagtcctgttgctattttaatgttacagaggaaggagagcatatattgggtaagaaaaaaaaaaaggctgtttctgccacaattcagtttccccaacaaaataaaaacttggatttatattctttaaaagaaaatatcctctgtagcacagtgctgaatacatgacaggacactgtgctcagtaaattttttttaagtgaacagtaagggccggtcacagaggctcacacctgtaatcccagcactttgggaggccgaggcgggcagatcacgaggtcaggagatcaagaccatcctggctaacatggtgaaaccccgtctctactaaaaatacaaaaaattagccgggcatggtggcgggcgcctgtagtcccagctactctgcaggctgaggcaggagaatggcatgaacccgggaggcggagcttgcagtgaatggagatcgtgccactgcactccagcttgggtgacagagcaagactccatctcaaaaaaaagaaaagacagtaagaggccagtaaatatttattgagtgattacagctcctttgtttctgaaaatgtgactcacagtactaatgatctgaaaaagagtaagatgaacacagagagaaagtaatgattcaggattcattgttgtgaggttcaagaaacatttattttgaggaagtggaggtaaatattcaatgaagttaactacattgtcccagatatatagataagatagataaaatgtatatattatatagacacttatttttattataagatatgtactgttagagttggtagtataccagctttggttccctgcagtctgatttttgggcctcttggtaaacaagtacttaaaaactgttaccccagtttgcaaacctttaataattagagacaaggcaggttaactgtaataattcgtatgcatgcaagatatgattcttctttttcataaatcatacctagtttttagctttctgctgcaaaagtaactagtttgttagaaatttagtgaaaagaaaaagtaggagacattgtgttcagaagatcatgtttaaaaacaacaattagtatggcatctgtatcttagcaggaaactcagaattaagtctgagcctgaccttaacccatgaccagtggaatctaagtttgtttatttttacaatagccttaatttggggcttgcaagttttttggtttgttttcacattcaatttagagaccctgaagcagtattttaatgataggaattaagctatgtataactttcatggcttgaagatcagcaaattctgttttttcttggttataatgttatcttaatcagaaatgtgtgatctttgtgtctaacaatgcacttaaaaaaacaaaacaaaaaattcccttgctgcaatgctggaattctaacagaatttactcatcttctctctcctccccaatttttaaaaacatgttctcatggaaatgttgccttgaattacacaaaatacaagcagttactggaaatgttttctacacagttctgttcatgtatatcaatttcaatttgtttttcactttttagatttttttcttagttttgctgataatcacacttcataatcatatcaactttgaactttgaagttgtgttgaatttttattgctctcagctgtatcagatcctactttttgatgagttatttcatatagtaagtttgttgaatgaatggtgaaacaatgaacacaggaacaagaaaagaaagcaaaatgcatcaaacttaggtttagttttatctccagtttaaccatgctcccttaaatggaaatgctaatatacttctttttttcttttttctgtaacagttcatatgtttttgctaggaagaagaggagttactgaaaacagtagttaatatcaaagtcataagtcatttataatcagccttagaatgcctacagatgtatatacatttttcaaaacacttatactctgccttttctgaagccaagcttctcttggcttattcttacttttagtacttgtgtgctggaaattagaaacctcagatgccctgcacagtgtaggactatacaattgtgctaggcatgtatttataattctttaactcttctaccaaactgtgtgctttttaagggcaaaaactgtacaacttctttagcatgcacctgtcacttgcaaataaatgtctaattctgtggtcccttcaaagggagaagaggaggctaagcaggcaaggctctaggccttggccctgcttcagtcagaatctttcttgtacatgttgataatttctttcttctacagatagaaaattcctgggataagaattttgatgggaaaaagagtttattgcctttaaaaaaaaagtttgagaatgactgtttaggggagatactctcagtatcttgtgacattatctagtctagcccccatcattttacaggactggaaactgaaacacagaaaggatacgtagtcttgtccagattatacagctatttagtggcagaattagaattaaaatcccttgtcttgactgcttgaccagtattctttatagtggtgctacagcatatgtgttgtaaaaacctaggagttttccaagatcactgcatagtgcctgacaacggtagacactctgtaaatgtgtattacattaatgaatgaatgattctaagctggtttgtagttaattaagccaacttcaaataaaaactataatttttcatcatcccaacgaaatattgacctcttagaagccctgaatttggcctgttctaggactaagccaattgttatatataacagattgttctttgttaattttaggatcacctgctgttaccagctaccacccataacaagaccacaagaccaaaaatgtcaattgtgttaccagcaataaacataaatggtaagttgaaattctgatgtatgaacaatatgagatttctttgtttaaccaggattctcttcattagttcaaagacatttaaaatgttcagttaaatgagtatatatccgtacattatttctgaaacatttttccactgttttattatttttaagatccattattcttttaaaaaaaattactacatccctaaaagaaaaagtagctttcttttacttacaaaattggaaaagctagcatcttgactgctctacagacttgcatctgcgacccttctagtcataaatgtagtgtaagaagcccctgctgtgttctgacagtgaatttgtaaattagatttttggaactcaaagcagtttcctgtgttacctaaatgttgatatcatcctagaccatgccacagaagcctgtttatgtttaattgataatactgatgagtttgacactgatagtattactattgcattttgttatattactagccctggacattaaacaaaatacaaataataatataatgcacagatgttaaggcataatatacctgcttatagtttagaagaaaaaaaaagacaagcacaaaaatcactgtactccaaagagaaagtcacgtaagtaatatgtgaggtactaagaaatctagtgaaaagagattactttcagcttgattcttcatggagaagtgaaataactcactcccattaccagttgtggattataaatgagcacagtgtatgttattgactaattgctttctctgacacattatattgaaaatcggagagttggccatctttttcaagtttgtgtatctcacataatgtaggtactagtaaattttctgtctggtagcaaaaacctcagtatatgaagaagatggaaacgaaaagccctttgaactaacctgcagtcgaaccagttcacattttgattgataaatataattaaaccttcaaatacaattataaaacaaaacactagaattttggggggattccagataagtttcaataaaatttagtctttaggggaaaagtggtattcatcatacattttaagaccatagaggaccttagaatttcatgatctgtatatagacagcttattagaaatgcttaggaagtaacttcatagacataaacataaatgggctttttgttaaagcataaaaattacaatatttacttagccttacaaagacattcagaataagtttaagaaaaacagtaacattgagaagaacatctctttcttcagtaaagacatacctttgaagttactcatggaataatcatttactacctgaagaagaatatattccaaagtgcattttattacattccaaagaatgtatttaggaagtctcacttatactcaatctataggtacctaagtttctctgcctaaactagaatagaccaaagggtcagcttatgctcagaaaggctattttctaagctttatcaaggcagaattcacttaattttgttcttctgatattgggttcttatgcaagagaatgcctggtcttattttgtaacagtgagctatctttatattaagccaaaaccaacaagatgctgtttgactatgtttatcttggccaggtgactgatttttgaagaggagcctttcatggatttggaaaaatccagtcattagaggatcattgtctttttaatctgtttcagactctttgtaaatagtctttttaaaaacttccctttttaggataagtcctattaaaaaatcaaaattcaaattcaagaaatattgattgaatatataccgtgtttcaagtaccatgctacatcctcagccttttctcttaacagtcttgctctgaggatacttcttaaattagagcctgattttttccccttcctcatgtacctcaaagtctgcagcagggcaggtggtatccttgcttcccactacaactttcaaattatttctccttcagtccccttaacatcttgcaaatctgtcacatcacactttactcctctaacccttatttgttgctgccgtctactccaccttcactgacgactcctccactgcctctgtcatcctgctgtctaacttcagcatccgcatagaggagtcattagtactctagccttttttgatccagtcatcttttattccgcgccacctcagcctcccatccatatggtcataatctagaccttatcatcatcaacagcagcactctctttgaaatctccttttcaggcatcccactctctgactgttacttactctcttactttaaaactcacactccaactactctcttaacttacaagtctacagtcctttgaccctgccacttcttttctgtgtccatcacatccttaatggccatacattcctccttacccagcttaaattccatggtcctgtcaccactctcttgtgaacaccccttacttcctggctcctttcttaggtcccactttcttggaaaaactgctttctaggtaaacccagctcttctctctatgcctgctctcaagcagctgaaaattgctagaaagtaccgttcagtgagaacaagtagattcacttcaaatttgtgaccattaatttcaaagggatatttaatatgccagtcattactagtaaattcactttccctctctctgaaaaaaagaatttctcaccttctcttgtcaaaactccaacatcctctctccccaccccctcagctgatgaactcaccaaatactacactgagaaaatagatgtcatcatgcaagagctacatcatgtttccactaccaccggcccagctgcatctacacccacaaactctgccttccctcttgttgcactgaaagaaaagtctcttccattgggttctaaatcccagctttgctacttgctggatatgtatcattgggcaagttaattaacttttctgtacctcagcttcctcatctgtaaaagaagatattagtaataccttcctctaagagttgatgtgagaatgaaatgagtaaaaaagctttaaatagtacctgactattttggggttagctgctgttttactgcaataatcatcattgccattgtccttaagacatcattgccaacttctaaggtaatttcttccttttggaccctgactcctagcacttctcacagtgctcaaagactttactctgcatttataccattcgtcttttatacagtttcttcttctctactgggtcattcccatcagcatacaaatgtctttttttttttttcctcgagggagggactcattctgttgcccaggctggggtacaatggcgtgacccatggctcactccagcctccacctcctgggctcaagcagttctcccacttcagcctcccgagcagctcctgaacacaggcacattccactcccagctaatttttaaattgtttgtagagacagagtctccctatgttgcccaggctggtcttgaactcctaggctcaagtgatcctcctgcctcagcctcccaaagtgctaggattacagacatgagccactgcacccagcccaaaatgtcttaatattactgttacctctggtgtagggagacttctttgacttcacatcctatttctctgttaccctttagagcagaactctcaaaagacttacactcactgcttctacttccttacctctgattctgtcttcttttcacccttaccaagcttttgccatttcacttcatgaaatgctcttgcccttccactccactgaaatgctcttgcaaaacggaagtcaatgacaaatatctcgccaagtcaaaggtcatgtctccatggtcatcttacttgacctctcaacagtatttgacacagctaactattccctcttttttttagtccacccaattcttatttttaaaaatttcaaatctatagaaaagttgacagatgagtgcagtaaatatctagagacccttaaatagataccaccaattgttaacatttttctatatttgttttatatctatctatgtacactcaccagattttaaaacctatttgagagtgaattgcagataacatggtgctttacccctaaatatttgaaaatacatctgctatagaaaggactttctcttgcataaccacaataaaatgatgatactaaaaaaaatttaacattgatacagtagagttcaatgtatagcatatattcaaatctctccattttcccccaaaatattctttataactttttgaatatatgttccaaagattatacattacacccactcatcatacctctttggtttcctttaatctagaaaagctcctatcctttttactgtctttgatgacatttacgtttttaaaaattagacttatttaggtataatgtacatacaataaaattcaccaattttttgtatacaatgtaatgaattttgacaaaagtaaaccattgtgaagccaccatttcaatcaagatataaatgttgtcactacttcaaaaaattccctcatgctcctttccagtcgttcccctcctgtacatttttgacatcccttctttcttgaaatatgttattttctaggctttcatgataccatgacttgtctaggtttcctcctgtatctcctcagtcagcttatccagcttctcctcttctgtcaggatggaatcttgtttgttatgttcgccacttaccaccatatccccagcccctggaacagtacctggtgtaggaaaccttgaaagatgaggcactttcatttacattaactcatgtcatgctgagctgccagttaagtgcaggctaactgttctttattcaaatgctgggatcatgtggtgtgaatccattggtcaaaaaggaaagataagaaggacaaaatgcatgggaccagaattatttcagattttggattgtttcagattgtggaatatttgcatatacataaggagatatcctggggatgggacccaagtctagacatgaaatttatcatttatgtttcagatacaccttatatacacagtctgaagataattttatacacaatttttttttttttttgaaggcagagtctcgctctgtcgcctgggttggaatgcagtggtgcgatctcagctcactgcaagctccacctcccgggttcacaccattctcctgcctcagcctcccgagtagctgggactacaggcgcctgccaccacgcccggctaattttttgtattttcagtagagttagggtttcaccgtgttagccaggatggtttcgatgtcctgacctcgtgatccgcccacctcggcctcccaaagtgctgggattacaggcgtgagccaccgcgcccggcctttatacacaatttttcacaattttgctcatgaaacaaagttaatatacattgaaccatcagaaagggtcaggtgtggattttctgcttgcggcattatgtcaacactcaaaaggttttagattttggagcaatttggatttcagatttttggattagggatactcaacttttattctctttattttttatagataatgcctcaagaaagtaattcataccatttgcacaaccactatatagcagagccaagatttacatacattgtataaaatatcttctaattaattatattgttaattcaatattaaagacagatgtgcaaggattgaaaatatttgggactccaaaatttaagatagattttataccattttattcctacactataaggtgggaaagattcattgggagcagtataacataatacagtcatttgaatttgataggtatatgtttgttgaataaaagaataagtaaggtaaatgttatttggtgataactttgtgaccacttgaaaatattttactagtttaataatattttatataattaataatagttagcaagcacagattagtctaatcttttcaagtgtaaagtaattaaaacatatactaggctacctttctaccacattgagatttggacttcagagtgaattgaaattattagcctccttttcagcaattgttctataaataaaaccatgcaaaaagttgtcctataggaaactataattctataggattcttcaagacccagagataaatttctttggcttattagacttatggatttgacaaattatattataattacataatgtataatctgaagagtttaagttatgtaggcacaaaaagtttgagtacctatttattgaaagagcagagacattgtgaggctatccctaatatcagagttgttcattctgagcatataagggtttgagaaagttgaataaaatacattttctgtcatttctgagtttaaaagttacatacaacttggaaacaaaaatgagttgtggaggtgatccctctctctgactcaagtggagcttgtaaaattttggagagggtggcaaaggatagaaagtgaagacagaaattcagattttattgagcaactggtttatgtaatatgctggatggggatatttgtaagatgaatttgattttccaatttaagcacagtaaattacatttccaggtcaatgtctggtcttaaactgtaacgtattatgattatactttgtggttttaagccatggaagaaagtttcagaaatcgctaaagagagtaggatatgggtgtgaaattaatgccatttagaaatcacgtcatatcatctgtgttctccatgccagttttatttttgtaatttattgttttttactttgcattctgtttattatttaaattcctttgtttcataagagagttgaaaacaggttagtgaagctgcaagaaagtaagtctttctttgtctgaggaagttgtcacacaagattattgaaataaaaatagaatgctaggtatgctttgaaaaggcttttttaaaaaaggattgcatggttggtggaacagtggatgatggactaaaagctactgatttcttttttttaaaggattttggaagttctactagtagttactgtaagctaacatttcctgctttcaaattatttctacttatgttgtggtaaaactgttcatttcctttctttcactcttggtaaataattgaacaagatagagcatagaaaagggggtttttaatttgattttttagtgatatgtttgttttttaatggtagatagctaaactttgtagatatctttcataggggaatgaattctatgaacaagccatcagcagatatgtttcataatttggccaacatgttcattgatttgtttttactgtttcccttcccttctgtgtgccaggtacctgtttgtgtggtacatgtgtaataaaaataaacaactgtttataactgttacttgaattaagggcccacgtagatgaacaaatgactaccaggctaaactgtaattatatttaatctcaaggtaatttccatccatataaagaaaatctagaagagcttaatagcaatggttgcaaatactagtgccagcacatgcaacacatttttagttggagaggtcgtaacagaagggtaggaagcaaaccaaccaaataaatgtgttggttttaaaaataaaagaatattcatataactgcttttgatgatcacagttttttggactatcccaaggcaaatatatttggaaaccgtcctattcattctgctcaagcagcctggtttcctaagcaggtcgagagtttttccttttattcttctcaatatatttctccttaaaggtctgcaggttgtctattttttttaaaaaagtattatctaccttgcattttcattgtaattcatttcatttcagtttcatataattgcatccagacagttgaatggagtcttcacttaaaactatgttttaatttttaaaaaatacataatcatagttctctttctctctctctctctcttttttttttttttttttgagacagagtctcgctctgtcgcccaggctggagtgcagtggcgcgatcttggctcgctgcaacctccacctcctgggttcacgccattctcctgcctcagcctcccaagtagctgggactacaggtgcccgccaccatgcccggctaattttttatatttttagtagagacggggtttcatgatgttagccagggtggtctcgatctcctgacctcatgatctgcccgcctcggcctcccaaagtgctgggattacaggtgtgagccactgtgcctggccatcagttgttttttgtttgttttattatattgagaagtccacagcaaagaatcacagtgaatgagccagttgctgtgttgagtcaacggcttaagagtggctaaggccgagattgcagaaattcttttggcctttcccagatgatcacaaagtgactgttgcagttcaagccatcatatttgtattacaggcagaaaaaaggaggtgtctatcaagaaagcagacattttccagaaatttctagaaagctctgcttatgtcttattgaacataaactgtgtcaactatttaggcctggcttcaaaggaggctcagaaagataatattttaactaggcacattatgatttgaaaaaaaatttggagtctttttagtaaggatccaccctcggcctcccaaggtgctgggattacaggtatgagccaccgtgcctggccatccgttgttttttgtttgtttgttttattatattgagaagtccacagcaaagaatcacagtgatgaaccagttgctgtgttgagtcaacaacttaagagcagctaaggccaagcagcagctgcttgctgcagcactccatcatatgctaaattggaattgagcaaagtgtctgggaagagacagtaaagagaggattcatgttgaaaagagaaataaatatttatttattgcatgggatgcagccagatgatttaggtcattaatgagttgaggaagtaactttaaactatcaaacataagaataatacaatgaagactctattaagagattattaatctggctaagaattgtatatagaaaaaaatgaagagcgaagatgagctaggatagatactaggatagatactttggaacaatctcaagatgaggtgattcaaagcttggaatgggaagaaaggaaaaatttccaaagaaattccaaaggaaaaatctatagcatttggcagctgatgatttataaaggagagagaaggaaaagctgattccatgattttgagaccagaccactgagagactagtactgccattcaaagaaatggataaaatgggagggacagtgtgagatttatgcatcttgaattagagatgtcattggtgggtatttttgtgtatctcttgtaacagattggtgtgtatttctgtgtgtctcttgtaacggaataccaagtaattattgactgatgaatttcattttctttcctttttgttagatactaccagccccctcacaagttagtgtccctttccatctgttgtattgtcttagacttctcctcattcaccaccttgatgcttttacaagataacaaagcttatggagataggcatggggcagcaagaaatatagagtgggaatctgcagagaaaagaaagatgagccctctttctttgcttgttttccctgtttgtttgtttgtttgttttttctctgctttgccttgggcatgattgggattactgagattattcctcttgtctatattgttgcattagtattttaactggtgtccctaatttattatttttccatcttaattcctacaattcaccctgcatactgctgccaagatgagtcatccttacatactgcttttgttatatcattatccttcttgagaaccagcggtggattttcagtgtctatcagatgaaatccaaatgctttagcctggcatctaaggcccaggacagtctgtccccacattaccttttcaactcagttctaaccaaactgttctactaacagttccttgaatctgtattcattagttcatttaaaaatactcattcactgattctcctttatgcctaatgctggagataccaacatagaataaggtacccatgatttgtactttactgtagcctctaagtgcaagagacagaagaaaacaaaaaaaaattaacaacccaaacaaaacaattgcagcttatgacagtttgggagaaagaaagaaatatggtcccttcatgaaatatggtgggagtcaggggtagagaagacctttttgattgggtaatgaggggataacagttaaaccaagatctgaaggatgagaagaatcaactgtgaagagtcaaggggcagaagattccaagaagagggagcaacaagagagcagaggccctgaggctggaaagaatgtgttcgttttaggatttgtcagaagaccagtaaggctagagtaggacccagtagggagaggaaggaatgatacgagatcagatcgggaaggtaaacaggggccacatcagacagggaattgtaggccacggtgaagagttgtgatttatcaatatagtgggaaggtgctgaggagtttgaggtgggaagtgacttgatctgatgtacatgtaaagagatcactctatttttgcacatgtggtgtccatgtcttggattacctgtcctcttccctccaggctatctcctacccatccttcaaaatccagctgaaatcctaccacctctgcaaaacttttgctttacttctgtggaccactagaatacttctgtaggtcctagaataaatagtctttcctccactgaacctccttaatgtaaccacctctcatttatggctttatctaacactactcaaagataattaccttgaaggtggtggtgttttttttttatttaactgtgtctcttcctcctcttcatcccatgcctaaagaaatgctctgatacttaatttttaatatatacttagagttgggaaatttttgcctttttatgattcacaaaaaatagctgttctatagctgtatcttacctccctcatttcctctggttggccttacttccctcttatttcttgaagtcattagtgtatccatttttaactcttcccaaaccattagattttctcccacttagcagagcctcttctgaactctctactataaggtaaacctggaaataaatagatttcttaagtggaaaaaatagggttaatggtagagctgcctttatatacttggaatgttattactttgctaagaatgattattgtgttgatgatttattggcagttgcatgggtaatttttccatgaatagtttatattcattgtatttgatttactaattaattatttagtttattagaaccttcacaagaccccagaggtttagattcaatcagcttgcattgatccttctaggatattagttacttctttgacccaaaggagccagttgctgagccccctgtacctaagtgaccttcagagtcctgttagctttcagtgagatcacattcactctttctgccttatggcaaaaatctgtttctactcaaacagatggtttagctttcaacaaataaaaactagagatcagcatctacttaagccaacagagttggtttgagcctcccactaactctccaaagtctgttattttttattttttaatgttaagctcctcctaatggatttatctttgtacggggaaatcaagaaccttgcactttgtcagaagatgagccacttcatataatctcaagtttctatgttttagaagaattgcttagtaagcacaggttcgactgctctgcgttctctcttttgcagttacaccaactggaaacattggggatcataactttctgtggagtgttacataggtgtgtcagcagttacatgatactttctttgttatttaagacatctgcaagctgaggatggccagtgtcatttcagagatgtacatgccaaagacatggtagttttcattgacattgggaaatactccttctcttgagcttttacaaataaaagttagagagtgctaagaaatccacatatttaaaaaaatctagaatcttgacattgaaaatataaatgcagattgttaattatatgttcctgtgttaagaaagcattcttgctttggggatcttgagtacatcagacaaaagttgcctttgaactcaaccaagtatccatagagatatttgcctctatatgtattattaattttacagaaacaaatgcctagcttaaatataatatttagattaaatagtgagacaaatgtaacctgcacaatagtttgctgctaggaaaggaattgttaggaaggccatataagcagtttctttgaagatacctaggacctatctctttcttttcactctattatgtaggacagaaccttgtgggaaatgtgatctacttggcatcattatggtatggattaggacaaagaaagatgcattaatattcctgtactcatgccataaaatatcatggttaaaaaggctttagtacaaagttatccatggtaactcccttcgagggattggattcctttctgcaacatgttgctctgtggccaaccagtttagatataatcaccgccatgtatagagactgcctgctttaaatagctctggcaatttgtaaattgttccttttctgtctcttaaatccacaggattatatataaatataatatttcttccacatgacaaaccttcagctgtgtgtatactatataccctctgagtcttcacatcccaagaccttccggtttttggaagctattcttgtgacctgggttcatggtgcctcgattctggtcattctcttctgaatgggctctggtttttccacatctgttaaagagggctgatgaatgctgagcatagtggaggatctcctaattctatatagtgtatttctattggtgaaaccaaggtgtttttttctagttacatcatacattgtaccttctgtcaaatatagtctttagctttttcatatatgttactaccaagctttttaattttatttgctgatttggatttttggcctgaatttagaactgtgtttttatcctgattagatacagtttaagttccttactcaataaacattcagagaaggcttccctaagtccatggaataggttaggatcccttcccaactttatgtacccagaatactccaaactttcttatttttgtaacattcatcttacttgtaatcagtagttatcatcaacttccctgctaaattggaggcttcttaaggttaggaccttatttattcaatattctttgttattcctactgcctgacaagagtaagtgcttaatacatagtagctgctcaaaaatgtttgttgaattgaattaaatatatgaagtatctatataagccaggcactgtccattgtatctaagaaaaaaatgtaattaattaaatgaacacacagtgaaatttgaactgaatcttcaatactggccaagtgaatgaggcattctgagcatagggaacagtataagtagggatatcagagaaagaaaagtacttagtccatttggggaattaaagttggactaaagtgcacatggatcaaggtacagatgaagctgcagaggcaagcagaagccagttcatcatggccttgtgtaggacatgatacagagtttgacttaagcctctgagtaatggggaactattaaaatattttgagcagggaagaggcacaaacagagttacatttcaaaagatttccccagcagcaacataaaagatagatgagaggggattatgcttttatagggacaacagttagaaagttatcatctaggcaatagatgatgggtagttcatatttaaaaaaggattctttctgtatactatctattgtgtgtaacaaattactccaaaacctagcagctgaaagaaaacaaacattatctcagacagtttctgagggtcaggaatctagggccagcttagcagggtgattctgcttccggatctctcttgagattgaagtcaagctgttgactggggctgaagacttgattgggtctcagggatgtgcctccacattcactcacgcagcaggtggcctctttctggggctgctcacaacatggcttccccaaagcaactgttccgtaagagtgagaaagcaagtgagtaagagcactcccaagatggaagccactgtcttttaaacttaatcttggaagtctcataccatcacttctgctgcgtgctgttggttacttagaccaaccctcgtacattgtgggaggggactgtacaagggtatgaataccagaaagtggggatcatttgggggcatcctagaggctgccttccatgctgcttgtcaaagaatgtaaagagtaagtctacaagtccataatattttgatggcttatggagataagagggcagaacactccacctagaaactatcctattacctagagcaggtaaataaagtcatttgcttgactgaaaggtaagagggttaaaacccaccattctaaatgtcaagtaatagttacgttgcagtcattgcttagttttatactataaattatgatgatttggttccatgtttttttttagtataatgtgattgctgttcagctttatattcagcgcatagcactatgccaagtaatgtacaggtttcaaaagaagactaaaatgtgattcatgccttcagagagttaatttactggaaaacaaggcatacatagatcatagaaaatcttagaccccagagaaaacttaggggagtttaacacaacagcctcatgaaacagctaagaaaacgggttgagggaggtgaatggctgatccagcccagctactgacagagctgagaccagatctcagacctttaggtctgtaggcaagcattttatttaaatataaaatgtaatttgtttacgataccaagaacattcttttttaaatataatgtaaaaaacatttatagagacagggtctcacggtgttgcccaggctggtctcaaactcctgggctcaagcaatcctcctgcctcagcctcttaaagtgctgggattacaagcgtgagccaccacaccaggccaagaacattgtctgaggacttaaatcatttttctatttgaaatcagaatgacttagtatttgatgtggggaaaggcaagacataaatgtgttagaagacatttctgtcttctcttgaaagaccaactcatcctgtcactgattactgtgtgactttgagctaaattacaacacattagtaaatacagaagaaaataatgagcaatgccacatcccttgcattttttaaagcaaggaccaccctaattgacagtgagatctttatattaattttcccatttaaaatagataatattcagtgttcgatgaagaaagaattatggggtagattatgaaataataattggaatactattactgttaatagtaaaaaatgtctgaactatactgttggaataataagagtagaaatgagtaaaattaagtatttacaaggtttaaagtattttggagttttgtttccttttttaaaaacaaaatgctttttaactgttcattgcctatattaccaaatagttttaagttgtacattcaggttcagctccccttttttgagtacccaccatttatgttaagtatattactgggttctttaacagatataattgcatttggtcctcataaagcctatgtgagataaacattttccccattttacagctgagataactgagaaattaagagaaccacaactgaactttctgcatggtcctttgaggtcatttttctgaaaagcaagtgctaacttttaatagtgtctttagcctttccctcaggcaacagcgtatgactaagtcaagacagcagaactaaatacgagtttatgttaccataatttcagagtaacagctactgttttatgttctggtcatctattacataaatatttaatactgagcacataatttggcatgatggcagcaaaaagatgtctatcctggagtttccatgataaaccagaaaggctttttttccccaccagtatgttaaaatatggagaaataaattaggagatggtaagctatagctttcttatcatcttaagtttacctaattaaagcactttaaaataaattcattccatccaaatttagcagccatctattgcaaagtttgcttcctttttccatgacatttaaatatacaaaagccttttttttaaaaaaaaaagcattttttagtaggtaaatgtcagtcactttcttaaactagcctgtcctagaccaacagaccagttctactttcaaaacaaaacatagcatttaatagtaaaaataaactgtcttctcactaatgaatttactgtctgcatttccatagatgtggccatgtgttttcccaggaaaactggcttgaactcaaactaagatagctactaagatccatttagacaaagtgggctataaacatgagaaatcttccgccccctattctgtgtttggttaattttgctgctctcatacattctagcaatgtaccattctgttctcccttttactccagggagcctcatttggcatatagttagtcatacgcatacacctttgaaaacagtcaatgtaactcccagttattaagaacctgatgggtgctaggcattgccttatgaactgagaggtacaaatatgaaaactatataaaagctcctgccccagataaactatgatacagaagaacatttgttagctactttttaggtgctgtgtatcaatcagttttcttagtttcaggtgacagaaactaactctgggtaacttaagtagaatttctaggagggccaaagaatctgacttggaggtacggtaaacaaaaacaaagtcctaaattacaccacagagctggacatagaccatagcttacatcagtgatagtgctgatcctgaactgtacttccagaaccaaagccatggctggcccttgcaactagataccactccttctaggccttctagggccacccttctttccagaagagtctcctttgcagtctggagctggtgcatctgtgtggcagagcctaggccatatgcctgtaccctagttacaaggaagtctgggaaataaattatctggtactttatacacttaactagtaggaggtcagctctatctcacaagataggaggttctgtaaacctaggtatgcagtcaggcactaagtggccaaaaacttctatcagcagcattttgaataatcagagaagattcaacacaggagatgagaaccaggaaacaacaaccaaaaaagaaatatggtgagtttggccttaatatcacaaaaagatgaaaaaacaatgtgttcctaaaccagtttacaaacccacagttagtgaaaggctaggtgatagcttatattctccaaagttataaagtcctaaagaatgtagcctctacttgagacccatttggtctgtgcaggtacaggcactatcatctctctctgtaaagggtcagtatgatgtttaggaaagcagcccacatttggagtcaaagccttttgttcttaccctgcgcagcccttaaccagatgtgtgacctgtaagcaaggagttcagttagtatcctcatctataaaatgagaaggttgaggtaggtgatctttaaagttcccccttggctctaaagttctatactttgtacatgataggccagtgacaactaatgtttttactcaagccgattgtatgttttagaaggcaaataaattatgagcttattttttgatgacagtacattttcataaacccaaaataattaaatctccacctcccacttagtttagttgttttgggttttttaaaacaattttattttcccacacagtacagtttaagcattcaagttgcagcaggggaaatactcattgaatttgtcatcattatttttggcttctatctttatgagagccattttagttttctagtttcagtgatctattttttagattttaagctacaatatattttaacatttgagtattaaattgcatttgtcataatgaattagaaccttacgtttctttcaaaaatagctttatctcaatatgaaatgcaagattattcacatttattataaagaggagaatttttgagacattctatatccactggtcagttactgttttgatttggtgatggaaaatcatagcaaattgtacatttaaagtaaaccaaataaataactttatgcagagatagagattgaagtagccatttggagatgagaattttatctccatgccttcaagaaagaccatatgtaaaccaggtcagaaaaataaaaattacaccatatttattttaataggaccatcttagaatacaagacataacacaagagaatttatttctggaatgacgtgaaggaatttattatacaaactgctccatctaaaacatgttcctaaaatgtaggttcgtagaattttttttttttttcccctggggacatagtttcactctgtcacccaggctggagtgcagtggtgtggtcttggctcactgcaaccttcgcctcccaggttcagtctctcctgagtagctgggattacaggtgcacaccaccatgcctggctaatttttgtattagtagagacgggagtttcaccgtgttggccaggctggtctcaaactcctgacctcaagtgatccactcgcctcagcctcccaaagtgttgggattacaggcgtgagccaccgcacctggctggttccaagaaattctaatatttgttctgtttttaaggagaaaaattattgaacaacttacctctaaactatagtcctttaatgataaacactactgttaaaaaattcttataattaacataatctgatattgttacttaagtctttgaagaaatagagaaaaactggctaacatcccttatgactgcatgtttttatatattaaatagcagtatcgaattgccttccactatctttttcagacgaaataatatatatttaaaccttgcaagccttatccttttttatacttcttttttctagaacagctttattgagttataattcacataccatacatttcacccatttaaaatctataactcagtggtttttagtacaattttagaacatatcaccccaaaagaacccatccccattagcagtgactcctcattcacccctttccccactccagtaatgctgagcatctttttatgtgttactggccatttgtatatcttctttggagaactgtctattcaaaacatttgcccattttttattggataatttatctttttattgaattataaaaattatatcttctaggtacaagtcacttatgagatatatgacttgcaaatatttttactcattctgtgagtttgtcttttcactttcttgagcaagccttatcttgagcaagccttattcttaactctggttaaattttggttttctgaacattttgctaaattttctaaaggtctccagttgtggagtagcctgaaatgaatactttattttttgaaagtggaactaaactctaatttaagtctataatagaaaagagtaattgctataggaaccaacattttttttggttgtttaccctgtgccaagcattgtgctgagtgctttgcaaccctaaaatatagggttgttattcctgttacatagatgaagaaacaaaggcttgaagaagttaagtaagttgcacaaaatcaaaaagtgctaataaatggtcaattggaatgacaatgcaagttattttttttgaccaactttcacattttatgtggggtgtttgtattccactattgtactttttaagacaatattattttacagcctcattttccatccactacaatccctagattttttcaggcatattggaaccgaatcattcacttctgtctctttaaaactggaatttcttggtttctgaaccaagaaatttgatttgatttctatagccttttgattttttgactgtcccttccaaattggccctttttaaacaaattataacaattttcaaagctaaaaaaattctaaaggtaaacttgccattaaaatgattaaatgtaaattgcagaccattttaaatgtctttttgattagctactattaagaatttagctgatctacttcattaaaatgttatattagctcaatgaataattatatatttctgtgtaacaaattacccccaaaactttaatggcttaaagcagcatttgttatttcacagtttctttggtttaggaatccaagtagagtttagcaatgtggttctgctctaggtctctcatgaggtttaagtcaggctgctggctggtgctgcagtctcatttttggggaggatctatgtgcaagctcactcgtatggttgttgggaggattcagttccttttgagcttttggactgagacctgcaattcctcactggctgttggccagagttctccctcagttccttgccatatgcgcctctctatgagacagcacatgacatggcctctggctctgtcacaatagcaacacaagagagtgtccaagatggaagccatagtatctttgtaacctaatctcagagttgatatatcatcacttttcccatattctactcattagaagcaaactattatgttcagcccactctctatagaagggaaataccaagggtatgaacaccaaaatatggagcttactgagggccatcttagaggctgcctgtcacactcagtgaatctattgtttaatcatggagaatccaaaagtcatggtgtttttatatagaacattgatatgtacagttccatcctgcaaacaagtgataattttatctgaaaatatataaggaagtctctccatcctaaaatatgcatatgtgtatatgtattatttttaaagcatctttagtctgcatatacatttgctacttattaatctgttttatcaagagacaacattaaagttgtaagacacaattagaatagaaaattttatgtgtaactttatgttctccccttgacttataaagattgctattgaattttagtattggaaaactttggccaatgtaaagatgattttaatttgaacatgtacaacatgcaaaagaatattttttctccttaaatcatactttagaagtcaaccctaatttaacaaaataggtgatcctgaatggactttaattcatttattcagcaaggcttattgaattactcttctaactcatcatgagttacactcataataaaagtctgcactcctaattttggcctcccatagctcagtcaatctctgtctatgtttccagtttcatttcctattgccatctcccttaaccttccactccagcacagtttttcttgctcctccccatgttgatgctcatgcatgcctcagggcttttccatcttcctgaaaacctcttacccagatcgttacatggctcgcttcacttcatttacttctctgctccagcatcactaccataaagaagcatcccaccagcactcttcacaatacagcagggaccatcaaaaagcaagagacacaataaaaatgatagttgaaaagattaatctcatgacagtgtacaagataacttgtacgtaaacaggctggattagacatggatgagtgggggccacaattaggaactttcacattcattcaggtgtgaattgataatgatccagttatgaccaccttgggcatgagtaaagctacacaaacattctcccaaaaccaggtcttccctcggatttgtgatgccggtaaattgttgccaccttcctccatcctcctctaacagagccatttcagaaccaaaactttttaaagaaaagtttgaaaaaaataagaagcaccaaagaattagcaggaaatggttaggttttaggactagaaaccacaatgcagtaggggctctgcaagaggaaggagtgagtgcttcaaagtgacatagcagctgtgtgctgttgtgcctgagactccttccaatcctagatgtttcctagtggtgctggcaaagcttctgttggctgtaccacattctttcccaatccaactccctctatgtaaagtctcataattctaaggatcctgggttcaaatgtaagtttcttccgtagtagttaccatttgggtgtttctgcttcttctaaactcccttctaattgtttttcctcttgtttttaagctagtgattttttcccctgtattttacatatgcttatggaaagaacagatatgttttcatggcacttagcatgttataaatgcattgttttccatggagtaagatcattctaccactgagagcattaaatccatgttcctaaggtaacccatgttttcctagaaacaggggaagagtcatgaccaactttcacattgtctgctttgttcttggggtatcatccattgtgataaccattcccaagaagtttcctccccaaaacagaattacttctctgcctacccttgattcaagtgacctttcattacagataatctggttttatagggaaatctagtaggttctgcactcagttgtaaagaaagacagatgcaaatgggtttcagtaattggtacaacattgtcacaaagctctttagattagcaagtacttataaactaggtggaatattttttattccatgttgttaataagaatgccctaatcctctttacacacttgaaaatatccagggaatgcagagagagacagacagagagatagactcgtatgtaatcatggacttttgagataggtaggtatagatgttcctgtaaactaagcgtttgtagcctcccaaaatttatatgttgaaatccctaccatactgtgatatggagcctttggtatgaggtcagaggcttcatgcatgggattagtgctctcataaaataggccctggagagcttcctcaccccttctgccatttgaagacacagtgagaagatgaatatctgtgaaccaggaagcaaaccctcaccagacattaaatctgccagtgctttgatctagttcttctcagcctccagactgtgaggaataaatttctggtttttataagccatcctgtctatacagtttgtcacagcagcctgaacagacagagacaagtgtaatcccatcttttccttagctgtattattaggttagtgcaaatgtaattgctgttttcgccattttaatggcaaaaatcacagctacttttgcaccaacataatatttgctcacttttctctgttgtaattttctcatatgagactgtaggaaagaatgatttaatatattctataaagtgcctagtaatataataggtccagcatatgaaagcattcataataggttctcagtaaagagtggcaatgctcgagcatttctaaagaaacggaattgattatattccattcctttttcagacagttataaatgttagaaatttctttctgttactgctccagaatctgtgcttttcaattattggttctaattcagtatttttaggcctcagagaaaaagccttaatgccgtcttcacgtggtaggctaccaggtctttgaagatggccattttgtatcccacatcttctccacatctgctcatagaaatacagtttcttcatttgctcccttatggtttaggttcgaagcaactcagaatggaacacaacgctactggtgtgttaattagcaggtgagaatggaactatcaccttttttgttgtgttcttaacacaaccttagttggcatgaatttgaggagcagttatatttcacctttgacttgtcaaacttacacttgactaaaacctacagatgtttttctttttaattttttttaatttttaatttttgtgggtacatagtaggtgtatatatttatggggtatgtgacatgttttgatacaggtgtgcaacatgaaataattacatcatgaagaatgcagtatccatcccttcaaggatttatccattgagttgcaaacaatccaattattacactctttaagttattttaaaatgttacagatgtttttcaaacatgtctctgttctaccctatctctctcatcatatatttgtatgggattttacattttgacatattaaatttcatcttgttggagtttgctcgttttcttcttacctatgaagctgttttgggaccctaactatgacagtaagtcacttggctatgcacttaatcagcatgtgtttaatatccacactcacatttttataaatatttaacaggaagggaaatttatacctccaaacccactctaatccctgaactccaaatgcatgtaaccaactgcctgttaaatatcttcacttagatgattcctgtcagttcacacttaaccaaactgatttccaccctcaaccttctcctgtagtcttctcatcctagtcacagtgaagcatatccgtccttcacattgcacagccaaaaaccttccttgcagtcatccttgacccattttgtttcctcccacatcccatatctaatccctcagcaaactctacttcacaatgcatcctgagtcatacctttcttacttcttaccttcttgcactaccactttggaccaaatcatcagaaatagattcctaacattttctgtatttacccttacattctttagtctttttaaaatattgacgctagaatgaacctgttaagacttaaattatgtcactcctactaaaaatacaaaaattggccaggtgtggtgaggcatgcctgtagtcagtccctgctactcgggaggctgagttgggagaatcacgtgaacccaggcagcggaggttgcagtaagcagagattgtgccactgcactccagcctgggcgacagagtgagactccctctcagttaaaaaaaaaaaaaaaaaaaaaaatcaccttaatgccttttatctctggttacttcaacaccataattaccataaataattcatctctgttggaatatttgtgtcccattaaaattcgtatgttgaaatctcttcactaatgtaatgatatgaaaatcagcctttatgggggtgattaggtcatgaaggcagagccctcatgaatggaattactgctcttataaaaagacaaaggactttgcagggacgtggatgaagctggaaaccatcattctcagcaaactaacccaggaacagaaaaccgaacactgcatgttctcactcataagtgggagttgaacaatgagaacacacggacacagggaggggaacatcacacatcggggcctttcggggggtgggggacaaggtgagggatagcattaggagaaatacctaatgtagatgacaggttgatgggtgcagcaaaccaccatggcacatgtatacctatgtaacaaacctgcacgttctgcacatgtatcccagaactgaaaagataataaaaaaaaaaatcacgccactcctctgttcagaacttaccagtagctttccatctcactcagagtcaaagctaaagccctgacaattgcctgcacaactctacatggttctgcctccccttcccacacatgtacacaaacacatttgcttttctgacctcattttctagccttctacccttgcttcctcctctgcatgcacagagtcctctttgctgtcccctgaacatgccaggcatactcccaccttagggcctttgcatctactgttcgcctgtctggagtgcactttcttcatcccatgcactatgaatcttccttctgctctcatttttgtttaaggtattatatgagactgtgctactaatagaaattatagggctcttttggctagtgtcaagtatagatttgcgttttggactcacataactgaatatgttagaattacatctaaagaaataattgcctataaatggagtattgtgtgtgaagagttagagtcctgccccatctcctttcctattaaatgatagtgattttcacagtatctgagatagccctttgaatatcagagaaacataagagtgtaaagatttcaaggaaatggtcatatttttcagatgagaaaagttcaccaaagattttacccattggtgccagaaatgtaaggcaggcaagaagttagtagaagaaagtcatcacactgtaacaattattttttttaagttgtaggcactgatttccaaatgagttccataaaccactgctatttccatttgtagtatagcaataggttgtgatactaaccttaaaggtctcaagttcaacagcttattatgaggaaagctgccattcctttaagaaggtgagtttctattatctttttaaagagagaattactcctttataaaaatgtaacttcttcatactgtatttcagatctcttgctttttagtaaaacttttcattgcagtgggtttgataataatagtgctcacttttaaaaaattccctaaattttagtttcccctccagtcaccagctcacttttctgtgatcctctttagcagaactccttaaaagactcatctatacttgctgtttcctccttctctcctgctgttctctctataacccactccaaataggctttcatctcgtcgctccactgaaactacttatcaaagtttccatcaccgtcatgctaccatattatcttctccatcctcatcttattcccagcaacatttgacatcaccttggaacactttatttacgtgatttcactgagacctcctgtctggttttgtttttcatcttatttcattagatgctagttctcagtctcatttgactctttctcttctcccaaaccctatacattgaaatatcccaaggcctagaccctctagtctttggcctaggtgatctttttttatatatgtattttaagttctagggtacatgtgcacaacgtgcaggtttgttacatatgtatacatgtgccatgttggtttgctgcacccattaactcgtcatttatattaggtgatcttattcaatcacatggtatataaattacaatataggctactatgacagaggccccagaatgaaggtgcctaaacaagatgaaagttgatttctttttcctataaaagtgtgggagcttgtccaagactgataggatagcttgttagtactggagacccacgctctttctttcctgcactctgctgttctcaacatgctgtctccatcttctggtcccagatggctgcttcagcccctgcatcctgtcagtattctaaccagcaggaagaagaagataggaagtgagaacgtatcccttccctttaggactcagaagttaaacatgtttcatctgctctcatttcattggccagaactgagtcacatgatgataacttgctgaagagaatttaggaaatatagtctttaggtaggtagctatggcttccagctaaaatggagcagttcttttactagaggaaaaagagcgtgatggattttggaggacagggagcagtttctgctgcacatggctttaaatactatctatgagctaatgtctcccagatttgtagctatttcctgagttcaggactctttcctcagctgcctccctaacattctcgaacacctgcctgttcaaaattgaactcttcacttttctccccaaactcctacccatcttaggtctcccaggtgctcatgccagaaacttagaacagtcttgattccttgccttctctttcatccacttttgatccatctgccaatcctattaactttaccttcaaaatggactccaaatccaaccacttctcatcagatctatcttccacattaccaccaatgacttattttaataaaatacatatccccatcctgtttcttacttccttaaaaccttcctctgtctccttattgcctttgggataaattctaaaccctgtgtgaaccaactctttctatctctctggcctcattttcccattttccacttatattttgtatttcagtactacctagcacaacacacctcatgacttgatgtatttactaatgcttatccctctgtagaatttcccccacctcagacctggctgaagaatcccttagtctcaagtgtcacctccttcagatctttttttttttttttttgagacagagtcttgctctgttgcccaggctgaagtgcagtggcacaatcttggctcactgcaacctccgcctcccgggttcaagcgattcttctgcctcagcctcctgagtagctgggactacaggcatgtgccaccacacccagctaattttttttgtttttttttagtagagacagggtttcaccatgttggccaggatggcctcgatctcttgaccttgtgatccgcccacctcggcctcccaaagtgctgggattacaggcgtgagccaccgtgcctggccagaaaatgttctttgtcatctctccacctccccaggctaggtaggcaccttcctctttattcttgttgtaccatatgcatacccgtatcacacctatcctggatgataccagtttacatagctgcctcttttcctagatgcaagtgccttggtcaggggcaagggcttactcatctctcagtgcccaacacataatagctgctaagtaaatatttatgtaattgaatcatattgatcatgggaacaaactcccattgggagagcatcacctctgccttacatatctgagaaaagcccttgtttattgtaccctatcaactgaatctgctgggctatatattaaagtgggtattttaggccctgcttaaaaaataaaggttaaattgagcatattcattgctctgttaggattacataatgcctgatagtgcaaaaacatggttgttgactgaactttacagttgtctggggtttgtgaggcccagctatagtctaggtagctttgtgtgtttgaaggtattctgactagatgagtcagtagtttaaaagtaacaagtcactgttggtctgtgggagaagttgtgtggacttagacttgccttcactgctttaaaatcttgctttttaaaaaatcccaagaaaggtaggttctctttaaaaagtttatggcctgtatttgctgtcataaaccaacccagttttcagcctttagccgggctccgctcccttagagatgaatggtaacccatataaactacatggcgattctagttgtttttagtcaggaaaagccccaaggtttttattaagaagcccagaaagaagagatgtcaaggattccggtgagaagtactatgttataagaagcagattaggataacttgtcttaaaaatgaaaaagggatgagaaacttgacaagtttttagtgctttcttagcactaaatgatgacttaaagaaagtttagtccttgccaaattttcccctttggaactgtttccactgtgtgatagagatctgccgctacgagcttgtcatcattctcatccactgtcttctttgtcttcttcgaagtcacgtcctactcctcttcctcttatcttctttttttcggcggggtgggggggttttgtttgtttgttttttgcactaagtcatagaactgaaaagactctgggtaatgttttcaaaataaagccacattgtttccaatacaacagctttctctgggttctttcactgcctccttaatgtaagtcttaatcacacttgtattaacagtagaaacactctgcagtatctcgtttcatacagtggtgttagaagcattaactcctcagccctcataccatcacaggaaaacagcaatcattgttaacccccatccattggggagatgaagaaaatgagcaaactatgaagaatgcagtttatttcgtctccataagactgtgaggcagtggaaggtaagggctagaccccaggatggctgattcctagggctcttttcctgtgctccagaatgcagtgacacctttcagttgttgctgtattcagaggtgtgtgttgcatgtgataggtacagtacttgacattattaactcttgcaaccaccctatgggttaggtattaatatccccatgttatagatgaagtctgtgattccaaagcctgatgtctctccactgtgccacacacactgactccacacaataacaattactcccatttcatatcacttgacatcctgaaagtcctccacaaacatcatcatatttaatccttaagaactttggaaatatcagtgattatcacacactttgaaataagcaagtcactaatcaatgtgatcttattaaaatttaagtcagttcatgatgctactactccgaccttccaatcatgtcacatctgtctagaatcaaggcccaaatctgtgtgacctgtgatatggtttggctatgtcctcacccacagcctcatctttttttgtttgtttgtttgtttgttttgagacagagcctcactctgtcacccaggctggagtgcagtggcgcaatcttggttcactgcaacctccgcctccagggttcaagtgattatcctgcctcagcctcccaagtagctgggattacaggcatgcgccgtgacacccggctaatttttgtatttttagtagagacgtggtttcaccatgttggccatgctggtcatgatttcctgacctcgtgatccgcccacctcggcctcccaaaatgtgggaattacaggcatgagctaccacacccagccccaaaacctcatcttgaattataattcccacatgtcaagattgagaccaggtggaggtaattcgatcatgggggctgtttcccccatgcggttctcatgatagtgagtctcacgagatctgatggttttataagcatctggcatttcccctgcttgtactaactcagtcctgcccccttgtgaaaagggtgcctgcttccactttgccttctgccatgattgtaagtttcctgaggcctccccagcaatgtggaactgtgagtcaattaaacctctttcctttataaattacccagtctcaggtatttcttcatagcagtgtgagaacggactaatacaacctgtaaggagagtggtccgctggtttcctctccagcctcatcgcctcctactcttcccttgattctctctgcttcagtcacactggtcaccttactattcctcagatactcagggcacgctcctgcctcagggcctctatacctgctcttccctctatatgtaatgccctctccccagacacctgcttgactagctcccccagttctgccaggtctcgaacaaaaaatcaccttttcacacgcacacaaaaagccatcttgctggtcaggacttgccagaccactctttgcaaaattccagtctagcccctaacatgtcatatccaccttccatgctttagttttatccttagtctttatcattttcaaacatactgtgtatttacttacttctctcgcttaccatctgctcactagaatgtgaatgctgtgagggtagggctttcatctgttttgttgttcacttctccactccagcacctgtaacatactgggcacatagcaggcactcaataaatatttgatgaatgaaaacagattagaaaatagaaagtcaaagaagctaagtgagtttccccaaaatgatatggtatagcagcatcaaagctaaaaccaagactggtcttctgatccacatgcagtttggtgctcagttaggccagaatccgaaaaagttgtaagttaagttctgaaataaaactcagccaaataaagtagtttggtgtaatttgcacttttaaaataatttttcatcagttactatatcatagaggatgaagagcagtccttcccttggactgtctccaagcagcaggaataatgagaataagttacagaacttaaaataaacccaggtgtttctgggcctgagattcttaatgtccacaatgaagggaccatgtcagttcagagctcttcacagctctaatcttgaatccatctcatggatgaatgaaatgcctggttttctttgtaatttgttcagttctatgcatacaaggtatgcagtttgttctgtagataaactacacatgggtatttctgtaactctccttttatcatcattaccgtctgtttgattctttcccctacatttgtgcaaaatgtaggcttgtcatctcactgtgttgtattgcaggatcagcaagcatgtcaaggatctcatgtgtcttctaatctcatgcagcctctgctgcaaggaagctctcaccactgcctcctcagagttatccaatgggcaaagaaaccagaaggcaggacgacttaaggccagggaactaaatatgcaataatggtgtctgggggtcaggaaagcaagtgtttgtacaacatggcctggcattctttgtcactctgaattaaatctgcacatggtaatcagacctaaaagaagtgcaccaataagtcaggccattggttatccagctctatacaagttttggcaaagaaggttaaatgcagtgtttggcattgtatctcatcctggttcatttcttcattaaaaattccctctgtagagagtaaaatacagttattttgaggtggtgtccatatccttaggaacaggaggcaccgtcctaagctcctttacacataccagctcttaaatacacaacttgagtaaggtttataattctcatttctattatatgctgcacatggcttatgataaagtgaacctgcaaatgatagcaagatagaacaagtctgcaaaagtaagaatggcacgttaattacagaagttggatcctatcagtaatttaaaccaaagcatttatttgaaaacaaaatgaaacaaaacaccaatgccctcagtcaccttcttattccattcccatttgctccagtaggaattaatctctttatttctccttacccttgagcacttttatatatctgcacttgggttaaaggcagttctattaatttctttgtttggacagaagtttccttaatttaccataatcatcactgttgtcactatgccagtccagtatgtttggacttcacagataagtcttgcagtttccaaaacaccatcccatccttactgcgtttattcttgaatgacttttcactgggagatagtatacttatctttttcaacaaaactacaaatgggatcctaataacaagtttactgtttgttaatttgtgttagatataggcatactgtcatattttcctgtaatttttcatatctggtcttgtgaactgttactagtatttttcttccatatgtattttacctaccaacttgattgtaaactgcttaaagatagaagctatgttatataagcatttcacgcatgctggctcaatgaatcacaaataattgggaatttggttagacatctcatctgaacagtccctgccctgataccaccctgggacattcagcccttggccacctgctttgatgagcacatttctatgtctcctgcttaagtacttacgtaagatgctactgagtacctgacttcagacctacagagtctgtttttgttttgttttgttttcttttgttttgagacagggtgtcagtctgtcacccaggctgtagtgcggtggctagatctcagctttctgcagcctcaacctcccaagctcaggtgttagcctcctgagtagctgggactacagacacaaaccatcatgcccagctaatttttgtatttttcatagagacaggagtactccatgttgccccagctgctctcgaactcctgggctcaagcagtctgcctgctttggcctcccgaagtgctgggattgcaggcgtcagccactacacctggcccctgcagagtctttatcaaacagaagtgaatattaggaggagcctggggaagaattctctttgatttaccttggtgttaacactccagcgatacaactatggatcctccagaaagactatgtttttgctgtatcagtgccacctattaggaattgttccataaaagagcatgagaaactctctggagttcaaaaagtcaaaatgacatccttgctaaaaaatctctttatggtttgagttccatagttacaaccaggaatctctgggaatttggtctccaagctcttctcagagcatgtgttgcatacattctgcaaagcccttgggggatggagcaggcctagtttttggttttcagcagtgtttgttatcttcacagttaaatggaacactggaatgtgatatttactcaattttgcccatttttcattcagtatttataatttttaatgtggcaggtcttctaaaaaaccaacaaaaaattgctgattttgtgattttagtttctaaaacaaatgaaagcaaaaaacttctcgcccctgaactccatccctggctgttacccttcattctctgttcttactctttcctaagcaagtaagatatgacatttattcatcagagcattttatggttaattcactgttcaattttctaaaataccatttggcttcttacctacagagctatagcaccagaattcactcggtatatgtgtaagaatgactgcttccattttccgagagaaatagaaatagaactaagagcagtgatttccttgtgttaaagaaaaattattcatgacccttgttgaaaacaatagagaagactttattcaagggaggctatgggaacgatacaaggattacggcagtggagtcttgcagtgtgggagagagattgggctggagtctgactctgacaaggacaagtagggatttgtagccaaggagcaaggtgtgggggtcagtagatggaaaattactaagtggaaacaccaatgtaagggagattcttgctagatggactcaacagaattcttgctgaaggcaggccagggtgattagatgtcgagggtaatcagataacaagggtggaggatttttgttaaactttagccggattcttgctcaaactggattctgtaaggacagagagggaagcccagggtcaggcccatttgagcagggggcttatggagatctgattagagttagtttaatgagagtctttgtcacctgctgaaaagaattcgtttttatggctcagaataatagtgtaatcatagcaagagatgacttgtctatgtccattttataataattcaaaaatctcaataatttctgaaaaaaagaagcatttgttatcagagtcataaatgttgctatttatatgcttaagtagtagtatatcagaattcacagaaaggaacaattatttagtgtgcaagatagtatattccaaattatttcatattatagaaataaaaaatattccatagtccttaagccacgcctttttttttttttttttttttttttttttttgagatggagtgttgctcttcttgccgaggctggagtgcaatggcatgatctcagctcactacaacctctgcctcccaagttcaagtgattctcctgtctcagcctcccgagtagctgggattataggtgtgcgccaccacatctggctaattttgtatttttagtagagacagggcttcgccacattggtcaggctggtctcgaactcctgacctcaagtgatccacccccccgtcagcctcccaaagtaccttaagccattccttttgagactctgaagaaagggtacgttcctaatgtttttggtttggattatcagttcatggcagagcagtgccttaattgtacttggtagtgaccactactagttgttcaatcatgaatcctccagtactttttatctgaataatatggagatcctttcttagtactttgttagacagcttttctagatcggtttccaatagtagcgaaagagaaaatcctttatcccatcttttccagaattaatattttctgatcacttcatttgcaagagtaaagtaaatattgaaaataccaaagtgagcttcagtcatttataagaattgtttaaagaaggcagtcatcagttacttttttcacatgattgtattgctgagagtagtatctgcattagtctcttaagcaagactttaaaaaaatcctactgttgtccccacctttatttttgaaagataaacttaaaatttacatttttaaaaatttttaaaaagtaaaattttaaatgactcaacaggtgattagattccatctaaggatgagattgaattcacgatctcagattctcaacatatatttggccttacctattgttaatgaaacttgcctgcaaggagggctgcatgttgcagaacttaaacggagcaataaaactatttataaatccagacacctttatgaggatgtttccttggtttcacttatgtaagccgacaaaacgatcagttgtaaggaactgaaggaagtaaacacttgaatgtactcaaatgtctaggctttgctgaacattatatgattaaaaagcagccaagttcagcgtggactgagaactgctgacaatggagaacatgagacccagaatggcaaataatgtttcagacattgacttctcagactggtctccaccctgtacttaaccccattctcacccttttttggaggggaaaggaattatctagttaaaaactgaatctataggacaacctgtctctcctgaggcagctgacttatgctaattcttgcttagctcagtttcttgagtttagcagaggagatcactgtcacccacaccctctttaaatcagcctcctgtggggccatgtctacacaaccaaggcctcattcattcgtttattccaaaatatatttattgagtgccttctgtgtgccaaggactggggattcagtggtgaataaacagataaaaacacctgtccatagggaactgatattctagtgtgattactgctaggagtgtgtctgagttgaattgaggctcagaagtagatgtgtctgagaggcctcaggagtttggaaatgggggtgtccaacctgtttctttgtcctccaacaggctttattacctgtgcaggtatggtagtaagtctgttttgcatttctttaaggaatacctgaggctgggtaatatataaagaaaagaggtttatttagctcacggttctgcaggctgtacaagaagcatagtgccagcatctgcttctggtgagggcctcaggctgcctctactcacagcagaaggtgaaggggagcctgtgtgtgcagaaatcacatgatgagagaagcagcaagagaaagagggaagatgccagactctttttaacaaccagctcccatgggaactaataaatcaagaactcgctcacccctgagggagaacattaatctcttcatgagagatctgccccatgacccaaatacctcccattaagccccacctccaacattagagatcagattccaacatgagatttggaggggacaaatatccaaatcatagcaggaagagacactccctcctatgaaaacacaaatttgaagaacagttgtcttcagtgttatacaaactgctttctgactgcatataagagaattccgtttatggggttttggtctaaaattatagtgtcatgtcagatctcaatcattttaacttaaggcagttattctagcctttgaatacatttttcccctgaatattcgtggtgttgtgtgacaactatccaaaatattttaagattccattttatcagtaaaacatatgccaggctttttaataggcagagagtaatttggtagtatcattcctcttatcctttaaagttccttcatgctctagaatttaattcagtgattccttgtagaagctagcctgcccaacaccatgggcagagatattgcagagaatgccattttgatactctgagaagaacatgtaattcccatgccttgattttaaatgcaattaaagagccatagtttttcagaagaaagagtactctttggcaaacagtagtcattgcagaggtttggtccttaatctgttttcagggtagttatttcatggttactggatgttatagggacgtgcttctgaacattggtttagtttttatgggtcttgaatttcagattgtgacataaaacagttttctagtacatggtgccagtgttttaatcattagaagccagaaagtaataggccattcctcatgttggctgatgaccccaggctaaacctccaagctgtgtttaggacagtgaatcaggttccagggctagttcactcagccttcaaaatgattttttaccccaacccagtcttctcatgggcccctttgtacacacacctgaagttcacttgttttctgtttttgaggcactaattgtaactacataatcagatgtcagtttggtagtctagaaactctatttgaagaaaatacgtaataattttgttagtcattttctttttaatggtgtttcaagaagtgtttgagatcgatgaaatgatattcttttctatgatctaatgaagaaacctcccacagttgtgggcagcatttttggaaaagagtagccaggtccagtgaaaagcaaatctaataccattagtctttgaactttaatggaattagccagatttcctgaaatagtcctagaagactatcaaaagccctaggggagctaaacttgattgaaaatattataggaacttgaccatatatagcttagacctctgtggcataggctgctaaatttcccaagggagaaatgtcattgggtcacctttcaaagagtcattgttgatggttatgaattcaacagataagcttgaggttgaagagaagtgactttgattgtgttttagggacaaggtcttaacaaagtattgtctaaatttgtatttgaggatattagaaatccagaaaccaccatttctggaactattctgcgatggcactttctcaagttggagccaagaatggttgaattttcagaaagcaaaggatttcttgatgacttgaccagcaagtattagaggacagccttctcattgctgaaggttgtgttctatattttcatcatctgctgggtgccaggcactgtgctagctttgggcatgtagtggtgaacaaaacagatgttctctctgaatttatggagtggatagtctagtaggggtgacacacattattaaataagcaaataagccaaagtttaattacactttgtaacagatactatgaaggaaaagaacagatatgatttgggagtgctattagagttttggtcataggagaagacctgaggaaatgcatttgtttgatgatttaccagtattttaaatgtaatttctggtttcacagaacttgagtaagctgcacaagggaaaaaaactcatcttctgtaattcctcccagtttcttaagccactcagtaaatgctgactacggttttgtggatccattttgtggtgtctgttttcctttaggcaatcctccctctgtctaatttggatacagaatctaaatctttatgagtctgtaatagtacctggccattactggtctataatcagtgctcatataattgttgaatgaattagtgaaggttacaaattgagtgtggtttatcagttaaaagtgctctcccaattatctgatggaaccacaaaccttctcttttcccattatgcccctccttcttaacacaggtgttcccagcattctctccccaagagtaataccctatggccccagggctccatctatctcttttctacatataagtcccaagcctacaggttctagccctgttttctcctgcagagtatcagtccccaccccagtttcttactgcttgccagtcctctccactaaaatgtcctcctggaaactcagacgtgtgtgcaactcttccccctttgcctccttaagtctttagaggtcaccttctcagagagtcctcctctgggccctgcacttaaaactgcaagctactctcccatcccacctcaccccacactcaatccctaatcaacttccatgctttttccccccatagcacttattcatcattctctataacttattttctttattttctgtatccaccctctcactctctttttttataagaattaagctccatgaggacaggatttttttttccgttttgtttactactgtgtccccctgtgcctgtcatgtggtaggaattcactaaatgtttgttgaataaatgaatatttaatgttcaggcattatatatatataatatatcataatgcttctattgcattaggagacagtgaacaagtcagacgcttgcactgatctgtactgtcactgtgaatgtaacaaatacagactgatccaagtgttcctggtggtgactcagatatcaggagtgtctttgaccatagatgatgtgattttctgaaatgatagacaattcttgattgaattcagacaaaaacaatgctcccagcaaagtggaatggtggtgagaaaggattctgaagccatactgcttaggtttgaatctctcctgccatttgccagctgagtggctagtcacgtgatgtctccatgtttcatttcctcatctacaacataggaataataataattcttcctcatttaggagcttgttacaagaattagatgagcagtgtttagcacacagaaacactaagtgtttcttaagtaaattattattcagtagcttcgttcctggaaatttagggtatattaaactcatgtaaaagtactttatatttaaatttaaaacagtgagcttctagactaatttagtaataatcaagtttctttttaacctacgtgaattatatgagatataagacagttgtcatatgggactgtcctgtgtgtcacagaacggccagcatccctgacccctgctcactaaattttagtaatacccttcaatcatcatgaccacttagagtgcctggaaggttggtggtttttacatacactgttctagcgaggcctatacatttgttttgtgacatcattatagatcatctaactagacaagctctccctatctgaatcctcattgcccagtgtccacaatacccttatcacagtgaacaaattctgctatgtcacagctgaatgtgtgctgtctctttttttccctccctgcctttggacacttcccatcctgaatctctcctgtcagaggaactgtttttaatttatttcagcaaaaggaatacgtggtggtggccagaagctctttgccccatgcatgtgttctcccttaagcctccagaaagattcttgagtttggaagcacttaccccatctgcagttttactgttactcactcagcgttcttcccacttataactgaggggctctagttttaccacgctccctgaccagcttcaatttcaccccacctcaatttttgccaggcacttcttaagggagccaaacttcatttctaaaagtattttaacattattcaattaaatggaacatttataaattggttataagggaaaagatcaatattggagttcccatggaaggtttataagaagaagtgggcctcaaagaattaatagaattggactaagtagaaaattagactgggcagaaaagagcaggaaaggagggggtttgtttgtttgccaagcagagggaaaaaatactaacagaaatgcagtgcatggtgtgtagggatggtcaaaaccaggactcagattgaaaattataagtaagaatggcacagtagagttaacttagggaagttcttggaaaccacagtaaaaacatgacattctaccacttccttgttcattgtgttcccgcctcccttgtttttctgtttgtttttgttgaagaggtctctcgtggtccatgagtgagtggatatttatttaccttccatgcctccacacttgtgtaccccacaccccaggggattcaggcacatatacagcagcactacctgtcaccagcctagtttacacagagaaagctacctctttttagggttagtgtttgattctgaatagaaatctcattatttatgcttctttgcaaagtactggtgaagtcttatcactttttaatattaaacttcatgtaaatgttttggatatttaattgtttatgatcaaggtgtctggctagtgtgttagtcatctcccagctaacagtctcttggcaggccatgcttaattcagttattgcatgttaacaggctgttcaaaattccacattgcctagagtttttccacctccaatgtccagacactttttctggcttctccaaccctctgggcattcagaatcatagtttagtgctcatatttgaagccatttagctctttcctttttatttgcctgattaattttgaatttgaattaatcatactttatacccttttcctgactcagttcagtgttcatctcattctgtttactcagaaagcccagaacataagatttgaaccatttgtgcagtgcccaaatgtgtgctgatggaagagtgaacctttaatgttttgactcccgtactatttggttctatttttcctaaataagtcatggtcttttttcattaagtatacatttacaaaaatggttcagtctttgcacataactcagctctcacaattccctaatctaatgttgaccatgttctattttgtcataaaacccatgattttactgctttctctttactagagccctgcatattagcagtgaagacctggtccttaatgaaagtgtggggtccatcctcagtgtctcatatccctgcctgtgttttccttcaggagaccttcctttccttcctatctaagccagagtcttctctgtttccccagttaaaactcgatctgatagtttttattcagactgacaggcaagttgtaggcaacgattgaaggtggctttcttcccaggggtggccagaactcaaagtcttaaagtaaagggtagcaggagcttcatctgccatgattaagaggagttctgggggctctctgctgctcctgggtgcatactatataaacagatgcccagccacccaggggagggacctacaaagatcatgagttaccacgagctgtttccagtttgtcctcctttaattaaaataattagagcctcgtcagtaatgacgagattgcctcactaactgtccaagggtgttagtactaagccacccaaagaacctttttataatgtctcatacagtagaccagagaatgttgctgtgactcctttatcatttatagagatgtggctatgttgggactcctaatggcatgttaccccaaatgctgaactatccagcttgtcactcagaaggagcttcctgacttcagcttcaggcattcacatgctatctggtagagtcgtcttctagcaatgctgatagtttccttggtccagaatttgttaccttcagaagaagagtgtgaggaagagatcccgttctaaagccacctagaccaaacctagcctgagtctccttctggttgggcttaagatgacaatgccattccaaccatggctaggaactcctgagtcttggaatcagatcatagctttacatttccctcaaagcatctgagcttacattcccaggttttccatctcttcttgatatttaaagctttaaaaaaccgcagttatcagtttaaaccataacaggcacgtgggctctaatgacttctgcaggtggtttgggctgtattagagaacctagtcttgatcttaaactgtcatctggattctgagttaatccaggaaaccagtaagaattagtaatgtgtattgcatgtctctgatacatgtgttttccattatttggtcttccacagtgcatgcgcatacacacacacacacgcacacacagcccttcagtttttctaaaatggggagagagggactatggttccaaaaggaaatgactggtgtggtgccttgaaatctgaacttagtcacgtgttgtaaatgaaatgactccaggcacattaacaagatttctttctttcatctcctactttttggaaaaccctttgatgagaaacattggctaacttatagactttcagatttatttctgtaaagataagtaatagccattgcaaagcagccgtacttgtgaaattggagttaagcttccataacagcggtcttaaagaataggtagggttagttaatacacagcagcaaccagctgttcttcctccctgctgagactgggaaagaaggaaattaacttcaactataatggaagagattttcaaaactggtaatgggaaatttatcatcaatgaagactattttaaacattggaacaaatgagtgaccaacagaagtggaggaattatgtattctattggatttaaaatagaatatatcatctgctcaagacacttagaattgatagattagatctgtctaataatttttaactcttgggggtcacagaccccattcagaatctgatggcccctctctccaaaaacatgcacacacaaaactttgcgtatgatttcagggaacttacagactccctgaagtctataaattagacctgaatttaggacaccctggactagatgatctccaaaagtctgttttagctctctaagtgacaagctccacagcatagttgtcccatacataacaatggaatctgaagaccaaatgtcagactttgcattttcttcctccagatttgtaatgcttggcatgctcagtgtcaaagttaaaaaaaaaaaaagtagaatagaaagaattctacgtttaaattcaattctttgtcttggaaaagccaaacatttaattttaaaaatcactggttggctctgtgtcatctttgtagaaaggcagtacagaactaggttgttgccggcagttcttccccagccccacaccccgctctggattcatggatgaaaatgcaaactcagatgccatattaagtactcagaattctcccatgttcacacatctttttactgtattgctgtgattgttcagttgggcttgaaaaatattatttattttctcatcagttttatgtctaagtttcattgactacaagttggaagatgaccacccagaattacaaatcagggagtaatttggtcctctccctaaaataaagagcttttatcctcttaagaagtaggaatggagtatagtctgtgtctgtgtattttaaactcatgataatgagttgccccatatgtagaaagcatgactctatatggttttcccattcccttctgtaaatattctctagcttacctgcaagttctgtagactccctttaattccatgttggaattgtacttgacactttgtgcctggaatcaggaactctggaaataaagatcgcctcaatatggaagggaagtgatctctggaaaagagcataattgtcagatgtctataacttgtcagttttcactgtacctcacactcctaatggcaaacctttaaattcatagttggaagtgtcttaatgaagtcagaaatattactgatgaataggagctaagcgtacttggccagggtctccttaccattcacatggaatgctggtccttttgacagttgtttcttcccattgttgaaggcagggaggaggacttagggattcttctctgtattccccactaaaaagcccttctgttccagttgctccaatcagagtaatacactgcacagaaagcatacaagatatacgatgtctgtggacagatgctctgtggcattattaaccctggcagttgctttagccgttgtttagtcaatggaggttgtttgggagctagaattgggagagaacaggtgatcctggcacccagcccacttgtagctctgcttactgactgagagtccctctgcaccccttgaaagtttactgacagttcacacccttaaagcacatttctgtatttctggggctgaagcttatggcagagatgcacattctgttgaatatttattctttgtgtatattcctgtctgcagagaatgtgatcaatgggcaggactacgaagtgatgatgcagattgactgtcaggtgatggacaccaggatcctccatatcaaaagttcgtcagttcctccttacctccgagatcagcagaggaatcaaaccaacaccttctttggctcccctcccgcagccacagaggcaacccacgttgtcagcaccatccctgagtcattacaatagcaccctgcagctatgctggaaaactgagcgtgggaccctgccagactgaagagcaggtgagcaaaatgctgctttctgccttggtggcaggcagagaactgtctcgtactagaattcaaggaggaaagaagaagaaataaaagaagctgctccatttttcatcatctacccatctatttggaaagcactggaattcagatgcaagagaacaatgtttcttcagtggcaaatgtagccctgcatcctccagtgttacctggtgtagatttttttttctgtacctttctaaacctctcttccctctgtgatggttttgtgtttaaacagtcatcttcttttaaataatatccacctctcctttttgccatttcacttattgattcataaagtgaattttatttaaagctatgccacacatgcatgttcaaatggtttccactgattcgatttttcattcatttaatgcaaacccattctggatattgtgcttatttgagaaaacacatttcaaaaccagaaaagccaaaaacactccaaaaacaagcaaaacaatttggagctttagataaaaggaaaaactcccagttggtaaagtttatctttacttaggatttgtggctcacacctaaacaaagggggtcagggagtgggtacaaatttgagaaaatagaagggtaagggaagggccagtggtggggtttggagagaggagatagctccattaatacacatgtttaaaagatggaaagttcacgcctgtaatcccagcactttgggaggccgaggcgggtggatcacgaggtcaggagatcaagaccatcccggctaaaacggtgaaaccccgtctctactaaaaatacaaaaaattagccgggcgtagtgacgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaaaaaaaaaaaaagatggaaagttcgatgtgactgcagtatgagattaaagccacaactattgtttattttggggactctaggccaccaagtattagcacacatacttatgttttctctactaatctggtccaggtcctcatggaccacaggacaaagctttcattttcattcattcttctattgaaattataccaaattcagctgaggaatatggaagtaactttagacttaaacaagacaaaagttttttcactgaagaattgacaagtatttgctccttaaaacaacgcagattagtgaacgtggattcctgctgagggagtgcatcccataatatggcaataattttcagtttctccaacgaaaagatagtgaaggaattaaatcttttgtcctcccatggttaaaaaaaaaaaaaaagctgtgttcatttttactgtactatgcctcttttttcaccatagtagacaattatgtttcatttgatgaattcatagaactggatctcatacagcgatgtcctctctaatgttctacctttcagtttctaaagtgagtcttcctccctctcctacaaaacttttcaattttttgatgtaactcatctacaaatactgtttcttaccccagttgacttgcctttgtcagatttcttcttgttccacactatagcaatcaatttctcttcttccttacaagaaagggaacgagaaattgtagcaacctctcaaggattatatgcagctagttagttttctgcctgtgaaattaggtctggctcctaaataattttaaagaaccatcagcacttctaactctctggacaggtgcctctttgtccaagctagttaaatgctttccaaggaaatcagttcaacttttgtgagcggggaaaagcagggctttattgttgtgttacctgggagtctggagtttgaaaagtgctaattaaccttcctctttttccacattacaaacctttttaagcagcgcagcactccccttagatttggctatcctgggtgattttcagacaagaaccattttctctggggaccattcttctgctgggtgccaaggaatataaggcaaatgcccagaagaccttcaggtgactgggcagtcttatcatgggatatttcttctggccctgccccttcccattctgtaatgtgaattagccacaccagaggctgtgaccatggctagtagacagtggcaacatagtcatccccaagatgctaatcttctgctggaactgtcatacgttatcatggtcaatgtaaacctggtttgtgtggggtgattataaatagagtttccctcctctctgtgacagaatcacaggagaaggacccatctcgtggccttcttgttcttagcgcttcacttttacttcatccctcgattcccagctttttctatcatcattttgccaactcctcagatgcaagactttggttatgtcatactcaccaacgttagtccctctcttccaggtgaaaaggtgggtagcggttgggagggagtctccactgaagagcaggaaggtggtagcagggccggcagctctgccacagagctaggggtgcctgtaaggtgccgcctagagcagcctgggagctttgccttcttttgtctctcactagcccttctactctttgtcattgcctgttcttgagtggatctttgaaatgaggggacaggattctcctaagggtagagtttcaggaaatgagtgaaaggcaattgacaaatgcaaagaagtagtcactttttaaattgctggcaaagctataattaatccctaggcacaattgtagtttttattttaatgtttgtatgcacaaggccctttaggaaatgagaagttgccatgccagattaatttttttttttttttttggtgggattgccttttgggggttgcagccagaaattgtgggtaatgtgtgtatttttttatttattaaattttaaacaggattgtgcaagcttatgagacaattagataaactcatggaggaggcaggtcctcctgttattagatgattttgtgctcttggggctgacaataatacactcttgggaagtgatggtagagactgatgggaatagtctttctgcctggttgcaagtcccaaatttttaagggttaatggaagtaagtggatgtttcctcatgttaactactgaatcagatgttaggagcttgtccctttggggttgacttatgcccagcagtacagggacacagcttcattagagtgttagtgtaaactaactccaaagttaggagttaatgtgaaaggatcatccttgaaacaaatctgctgtttgccatgcttgtagtacagaaacttcacatggagttttgggtgggatttgtgttttcacaagtaaaaaatccctcacgattataaaactcagagcatcatctaatttttttttttaatgactacaagttccagcacaaaactggcatttctttgccatttcttgccagtaagaagttgacacggaggtatttgaaagcaatgttatgtgagtcattcttaagtgttccaagtaagtttagaaacagaaaaggaacttgggattcaaattgatttttcaaatcatttttaaagagacatcatcctgactaaatcttagcctgaaccttcctcccctgtgtgtattccccggtagtcaccgcagcgagatgctggtgagactgccgtggtggcatttagcatcgttaaaactggaaaactctcaagctctttgccactttcctactattttttgattcttgccattttaccaagcttaggttgtgaaacttgacagaaatgtattacaggaaaaacttataattgtatttgactttctaacacattgcaaagtttcaaagtgactttcactttcaacaacatattagaagtaaccacttttgctttcacagcctgaagagttagagcctgatctgatgccccctttcactctgaagtcatgggaaattttccagccatgaaagccctctttccactgcatactgatgggctgactcagcttccttcagccgactgagatcttttcatactattggctatttcataccaattaacctcttaaataagattgtgaattgccaaaattgatagacacttattaccacctgtggactccatattccttaccacaaatgttattttcatcagtcctgagtcattttaacttacagaaattaggattgttgctgctaatatgaataccaattataacttttagaaacaagaataaagcctaaaagagaatgaaatataagaaatgttcgttcccacccctaataacatttggaagtgaatattcccattttcttccacccacagggattgggattgatttttaatttcctaggaaacaatactagactacccaaaaagatgttgccagaatccaaaaggaactatgctcgtaaaagaaatgcagttttctcctacctaaaaaaaagaaagtaaagtgtgttctgttcttatctttttaatgactaagctttaaacagtttattttgggtaagactagaactttcggccatttgttctaatatgtgtgttattagatgcaatagaatttatgaaaagaagaatgacaaaggtatctgattagaaaatttgatcttacgcatgaatccatgtcatggccagccactgtcacatagtgggtgccattctcaacatattggtttgctaactttaagcattagggatttagcacactaaaatacttttaattatattaggtttggtaactaaggagtaaataaatcataatttatcatttgccaaggccaacaaacaacactattgtgctgtttgctctcaatgaagttgaataaaccaggaggcttggcatatcccctttatgttaatcccagctagagattagtaggttgactttcacagcaattgtatattgatccattttaactcatccttgccataatttccaggccagtcaccaggacagaggagatgatggggaaacagagctttagatgaaaactactatgcactactagccttagaggcactggtttcctgttaccactttggcaagtatggatggtctaagtccagtagggcttcatccatggagccattagaactgaggggggagtgttagagatgccatttcaccaggatctttttgctcaggttgtacccatgccaattgaagaacgtgttaaagatgaggaggagagatgtaccattctctcccttaataatgatgttggtttgcaaaacctaaagaaataataacaacagactatttcatactttcaagcaagtctttatactacctgttatttctctaaaattcaaataaagaatttttaaacttaccttgtttattctgtatgtagaaagagagaaaaaagcccccaaatgaatcttcagtgttggggggttagtaatgggaaaggaagcctgaaaaggctttgtggcttgtgttactgttcagatgaaactgttgaactattttccactcttctcccaagcctaattaagtaaaaatttcctttatttaagtgtccagatatttaaactacaatcttatcaaggaaaaaaaaatctaaaaacccatattttatctatgtcttcaggaaagtgggttactcggtcacgcatcttgtcctcaccaaaggcctcttcccagcttgcaatggcaaatgccaccacacctgaagctagtcactgcagactgacagcaagggatccatccaggagtaattaatgcaggcatttactgagcacccaatgattacctctgacactggtttattaactatattatcttatttcaatcgtctctacatcctattttgtaagatggttattaataagtagtggagctggctgggtgcagtggctcacgcctgtaatcctagcactctgggaggccaaggcaggtggatcacctgagctcaggagtttgagaccagcctaagcaaaatggtgaaaccctgtctctacaaaaaatacaaaaattagccaggcatggtggcaggtgcctgtaatcccagctacaagctacatggggagctgaagtgggaggatcacttgaacccaggaggcggaggttgcaatgagccaagatcacatcactgcactcctgcctgggtgacagagtgagaccctgtctcaaaaataaaaattaaaaaatagtggcccaatatttgggcccaggcaattatgtgaattattcaccattatattattccacctgctgatacatagatctggcataagttcatgccctaaaagagctcacagtcagcccatggagccatatacataaattacaaaactacaataacatcagggttctctgagaggcaaaactacatttgtttcagaagatactttaatggacttatttagaaaatgagaccccccccccgccccctcatctaggagaccaacctcaaatcacctctactgcagacaaagttagcagagattggagggtagagggttgaacagcagaaaagagaaatgggaccaaggaatagggctggagactaaagcccccaaggggagtgtcatgaaaagaccccctggtggcaggagggcaaaggacttttacaaactgtgatgctgaaatgcaaatcctcttcattgccccaactcttcagtaaaagcagatacacagttttgtatcaatgttgccttgggagtgagagactgaaggtaggactcaacatgatattactagtgaagaagaagacagcacagcaagataattcatacactgaagtgtcagtggacgtcaggtgaaacagggaaataaaaacttccaaccccccaccccgcccccacaatctttatggcattgtcccctgggacttctcactctatgtgggatatggttcaagccaatttttgaatctcaaagggtaaccacaaatgacatttgggttatataatacatggtatcatagatagagggcctctttagcatttaccctgtaatttacctaactggtccaattttggtagagatttaaatcacttccaatgttttgctcaccataggaaacctatcgcatatttcactccgtcgtattcattcggcatgatctgtgcaaatgcctgaagagaatcgttctcttagttcagttcagagtaggagctgatgcttattgaggacttaaccttccagacatcatgctaagcctttacaagcattagctcatttgaactttgcagcaagccttcatcatcgacataataatacctatgtctgtgaattacagatgaagaaatagtcacaagagattaagtaacttgcccaggatctcacaactagtacatagcagagttgagatttgaaatgaagtctgtcatgattttaaagccacattccttctactatgctacattgtcattcatcctttgaagtcataaagagacaaatgagtgaggaagaaaccaagccacacaacacaggcaaccagggtattgaggcatgttcaggaaagagggagagtcgctaagaggcaaggtccagcagtactcgagggttttctatgagtgactcagaaggcatacactcgatgctggctgcatgcagagcccatgctgggctgctgcaccaattcttctagacctcagtccttgtagtccccatcttggacgagttacccagtggggtggatacaagctggctcctccataattgaagatcctaggctctcctaactctcctactctactcatatccaaaagcccacccaagtgtggcatccagctccatcccaggatgtatccactgttttccctgtgatcacaagttctatagaaagttttcactgcagaattaactgctgatgtggatgctggactatgaaatagagatgcttgtgtaagagatcactaatctgcagacccaaaattgaaatggtttgtttcagaagtgaaggatatatctttaaaataaatacaacacaccatattaataaatggatcatcttgtaagattgagtgcagcagtgtcagtcctaaaagctgtatccatttggaaggcggaccttgcaaggctaacagaaaatactgttgccaattgtttacagtacagcccatatttctgcaaacatcaactgggtacaaaggaagaactgagaacctcaaaagccatctcagatgctccttccctaggtgtcctgcttgacttctgaagcctccgagttatctccatttcctgagcacccaatggagcttcgattcttgggctgcatttcttcatagtgggctagaggcaatggccctggaatttaaacatttgccactagttctaagtgttgtgcgaagctccaacatctaccatggagctgtaggaaaccatacagatgaactagacaacatccttgacatgtcctttacatgtctagacacatgagttatgtctcttccatgggactatgtggtcacccttctgtccccacagaagagtaaagatcatttccaggtgagggtaagatttctggtcagcctgaaaaagaaagttcagttggacacaagctactctcaggagagtttgggggtgggaggttcatggccagcatctttgccatgggcacagatctcacccactcacttggctgctggccccaggacatcaaatgatccatttcgccatattgtctctggtttcctggagttgctggaattcttctctgctaagccattcgttcacatgagatcgacatgttgtccccttccgcctggcaacctttaggaagacggaattacagcaacccccacacatccaactaggctgtctccatcaaatcaccagctagggggaacaggaaattcgtcttaatttagacaatatgagcaggaaagatgctgaaacacttaatctcttgttttaaatgactctacaggtcaccacccaggggagcacaactagaagcacattgcaagtagcagcacggttggggccgattccatcttcccaggatttatcatctggtacaaggcagcagggctcaaatagtccaaggaaggaaaaggccactcatagaaagattgtttttgttgccatagcagcatcttgtacttatcccttcctaactcccatcgcctttgcaattaccaggtaaacatttatcatccctgtgggacagtgagctccagaagagcaggaaccctactaatgtcttgaattcgatttttttcctccaaaagtgctgtggatatagtgtgcttgggacatggtggtttgggcattttaggctaaatcaggatttcgttgaattattgagcatttagaaagccacaaatatacactgtccttccaggagtctgcatgatagactggcatttgtcacactgcactagctaccgcaccctattcagatattcacagggcacagaagttgcagtatgtgcgatgcccagtgctgaggcaggactgcaagggaaaacagcagagatccctgccttcccttaaaagatgaggcatcatttgttttcctcttccccttttcttttcttttttttttttttttgagatgaggtctcgctctgttgcccaggctggagtgcagtggcgcgatctcggctcactgcaagctctgcgtctggggttcacaccattctcctgcctcagcctcccaagcagctgggactacaggcgcccgccaccacgccctgctaattttttgtatttttagtagcaacggggtttcaccatgttagccaagatggtctcgatctcctgacctcatgatccatccgccttggcctcccaaagtgctgggattacaggtgtgagccaccgggcccagccttccccttttcttttcatcctattgctttttcctctggcttcagtctgtggcatattagaaatgggcctggaaagaggatgtaaaccagcgagtctgcaagcggggccctgagactgcagcagcacctcaaaacttgttagaaatgcaacttttctggtcccaacccagacccattgagtcagactccaaggccgggcctagcaccctgtgtttcaacaagttccccagatgactctgagaggggactgagaaacacccgtgtagttccctgtcagcaagactggagaatgggaagatgcagactcctgccagagatgaaccttcccctggctgctgatgttggggtgggtggtaatatcaggatcacctgatgtcaggagttcaagaccagcctggccaacatggtggaaccccgtctctactaaaatactaaaattagccaggcttggtggtgcgcgcctgtaatcccagccacttggtaggctgaggcaagagaattgcttgagcctgggaggcggaggttgcagtgagtggaga

SEQ ID NO: 179 - DNA, 127826 bp, Homo sapiens
gaagccactgagatggaattaagaaaccctggtttggacttagacttgatttcaaaagtgtgtgtgtaaggcctagagtggagtcacggggaagtgagtgatttcagagccttagcaggcaacttcctgggaaggaagggcaacctagaggtggggacaagaggctgggacctcgggggcaggttgtggctgcttgcctgcacagggaccccgtgacaaaccctaactgggacgtcagtttgacacagttggtcaccacccagcagaaacattagcctttggagtgaaggtggagggagggcagggtggggcgctggctgccttcgggacatagttctctcccggagctgcaccgggttggggggctggcagagctgtgtgagtgtgaaggcacatggaggggactcagaacatggaggagcagagggtctgcctgcgtgtcattgtccatgccctgccatcccggtgtccagcctgccggaggagccgggttccggtcctggtcctgccaggaacagcggggcttgtttccccacctgggacgtgggggtgtctggtgaggtgtctctgaagctcttagctcttctctgcccaaacccctgaacttggagaggtgagagaccagcggcagcgagggatgggccagatatcccagggctggggggcgccgaggtggtggcgcagttgctgtcggtatgggggcactggccctgccacttccccttccctaggtgggaactgtgtccctgcggaggcccatggcttccgctaacctggaggtgctctccagttatgcagaacctggagcggggtcagactgtgctctgctgggaaggatcttgggctcggccctcagaggctgtaggggtgtggggtccttggttacttaatcactgctctctgcctctgggcagctgcaccaggcagggtggaggctgggtcctctctggacaaggttggggggtccttagtcctttaagttgggaccagagcactcttggatcctgcggcgaccccttgggttgcagccaggccctcccagcacacacgtccctgcgctctgcccgtggtgccttggatgctggagagtggctctggctccccgaggctttgcctctgcagctgcattgggcatgggatgggcccctgtgccctgtggcagccagagggcgagcagggggctgggtgctctgctgctggcgtgggtggggtgtgtggtccctgggccactcctctctgcgaggagagtggagacggttccctgaacacacaacacacacgtctggccgctgcctggcgtcttggcccgggagacaggataccactcacatgaccacacttcctcctgccccaggtccagcccgccgggctctgtccccctccctgcctggtggcatggcaggaatttgcccaagtcacacatctgttagtccttctgagtgaggcttggccagagaagcccgtgtcccttgtggctctgctgccctggccaggccttcgctgaagctgcctgactccatcttccctttctagccgtttatgaggaagcatttccgcagcctggcggcggatatgtccctgctcctcccaccctcctgcttcacccctgccctgccctgccctgccctgccttgccctgcccaaggcctgggcctccctgaagccaggttctcccttgcccagggaggccagtcattctttgctgggggtgtggttgtacctaggtgcaggatgaggtagctgcgctgggaggctctcctgggctggagcagagcctgcgtcctgcaagcggggaaggcaggagtggggaaggcccctggcctgcaccaggcccccatgagtactggctgggctgtcactgggtatttagttttgggggtgaccagagagagaggaaatcctggaaaggatttcacttttcctagggaaggtgaaaagaacagctgtggagggcggatgtcgctcagaggtccagggtgcggctcagtggccagcgtggaggctgccacggcccttggggggcagaggtgggctgtggagggcacggggtggtgactgtggagcccgggaggggctggaggggaaggagcctgtgacagccttgggcttccagacgatggaggtggaggggctgctccctcctaccacctgtgacctggaagccagagctcccctggttgaggaagtggctgagttagctgggatggctctgcccatatgtatggcctgtgggctgtccccgtcctgacagtcttggcctgaggtgtgggggcagcggatgggccggagcttgggcctgggctgcttgctgggcagggctgcagacctcggtgcccaagtgctccctcagtggcctcctgagtctctgaccttgggctcagcccccagctgtgggccaagtggcactgctggggtgggtgtggtggcaggcagagtctccgggcaccttctcaggcctttcttccacaggggaggcgagggctggccctggccattgggtttgctgggaatggccctgggaggtcctggtgaactgtccctaagccaggcagctcccctgtggggagtggacaccctgggacagccagagcctggctggagctgctttggggccacctcgccctgcgctgagcatggcttcaggccctcagccctctgaggaagccctgcgtctccccttttcctggcgaggcctggccttccagcggggtggtggtctggggttgttcctgggcgtggatggtgccttgaggccaccatgtgcgcagagggcagcttggtgccctagggccagccccctgtgacactgcctttgggggctacctgggagggagaactgggacctgcaggatgggtgctcgtgactggggagcccatctgggttcagatcccagccacgcctttcccggctgggagtccctggacacaccctcagcttcagcctcctgtaaagtgcctgtggggacacagggagggcgaggatggccttctccctgggcagctcagagccctgctgccagccccctctgtccttggtgaggcgggagccccgcggcctctactgtcccagggcccagctctgagtggatgacagtggcatgactggccactttcactgcaggactggagtcgccttaagggagtgctcttggaattagtcagttccctaatttcgccagtggccatggtccctccctggccgcgtggcttattgcacaagaatgggggaggggcggctagagagagccggtcaggaccagagcggttgagaaggttgaaacccacctcaccaactcaggtgggctcttccgggtttggaagggaggagaactcgaggctgtggggaccgcaggtgttccggggcaggggttccccttctgccctccagtgctggggacaggactgccctgcagcttggggagtcttgacctagaatctggattgtgtttctcagttcagaagatttggggttttaaaaagtaaatgatgccaacactccttttgaggtctagggcagtactgcagttaaaactttaatatttctgcagcaagacatgaatattcagataaagtaggataaattacgactataaatagccacacaccagttcaggtcacatgttgctgccaggtgagtttgctgtcaagtgacagcgagttctgccttcagcgcctcttggcgtttgaagttgtgggtacggctgtggaatcctggggggtagggaatgctgcccacccttaggctgaccccagagccagaggtgagggccgaactctcctggccagccctcgggccttcgaagcccgttcagagctctcaggcccaagtgctcgttctcccgggccggggttctcaggtctggatcacagccttctgttgctggcagaggcctgagcctcctgggacagctggatctgtccagctcccgggcggcactgcagggaaacaggctcgctctccccagagacccgggggccttggccctcctaccctctctttaagcggtgtggaggtgggcaggagggtgggggttgaatggaccagggatagggaggctgccttaggaggtgccggagtgggtccctggactgaggggctcaggccagggtggcacaaacggcccagccctgtgctctggctgaggatgggatgggtctggacagaaattccgtgggttggaaggagggtgtttccctgtgcctgggaggccgtggggtcagcacattaggtttggcccattgtgctgcttgcagccccggggctgggaatcaaggtgctgggaagagaggcgccggggcctgggtgggctgggctggcgctgctggaaatcctagcactcaggtgggccggcgccctggcccgtggcagtgggagtgcagcaagagtgagcagccttcctgcacttctcagctctgacagagtaggtgggttttgggtctggatggagaattaggaagcaggagggcgctgctgctcttggacttgggtcccaggcgcgagcagcagctgcaggtgggaggctggtgtgggcggggcccccaggcagcactgtgaagccccacccctgcccattgcaccatcacacctggatgtctctgctgcgccccatgggcgggctccagccgggctccccacccacacccctttgcccagcctcctcccaggcatctctgggcctttgaacaggcagtcagctctgcctgcagccctgcctctcagcagctttggtcctgaggtgaggtgctcagatggtcactgattgggctggctgaggggtgcccggtgacactggggaccactctggggggtgcgggcctctcccctagaaggatttctcagccggttcaccctccctgtctgctttttcatgggacattttctaaccagaatatacagccagtgtgtttcctgggatttgaccgcagatgccaggaagaaaagggaagaggaagctcccctgagaggcctgaggccactggctccctccagctcccccggaacctgtcatggccatctgtggggacacagctggtgcttggccttcccgaggctcccccacctcgactgtgtggtcttgggagctgtggcacctgggggagaaggtcctggagccaggcagggcgtgctgcagtcggcagggctgggcggaggtgtcctgcccagtctggactggcaggggcagccctgggcaaggctgaacaagtgtggtggcctgacgaccttctggggcttaaataggggacacatttgtaaaagcccacacaggaagtagaaactttcctggcagactctggtcttctgcttggctttgccttggagcttcatggtgtgccctgcagcccagctcagcccctccacacagacaggtggcgttgtgtgagtttgggaaacactgggtataagagtgctgcaggacttctcagagccttttgagaacgaatggacatagggactgtaggagaaaagtttcccaaaatcggctgaacaatcccccttttccaaatgcataccactgtgtctggctaattttaaatttttgtagggaggggtctttgttgcccaggctggttttgaactgctggctttaagcgatccgcctcagcttcccaaagtgctgcagttgcaggcgtgagccacggtgtcctactccactggagattgctgaagggacctccctgagtaggctagagggaggcaggtgggcatgaagtttttttcttttttctttttttttgagacggagttttgctcttgttgcccaggctagagtgcagtggcacgatctcagctcactgcaacctctgcctcccaggttcaagcaattctgtttcagcttcccgagtagctgggattacaggtacccaccactacgcccagctaatttctgtatttttagtagaaacgcggtttcaccatgttgaccaggctggtctcgaactcctgacctcaggtcatccacccacctcggcctcccaaagtgctgggatgacaagcatgagccactgcactttgcaactttttctttcagcagtggaaagcccgacttcagaatattctggtttatttttccataatccccggagaagcagggaacaggttctgtgggtggggtttgggctccccagcctgctttgcccagcaggggtgggggcagtggccctcatgagtccagacccccaggaagcagctggaaacatccagggggctgggatgggagtagggtcccccagatggccaagttttctccccttagcaaggcacaggtagtcatgcttccctgtcgcaggcaggcggctgcactgccttgctgtaggctccccttcccccctaagcaccaggtcccatcatctatcagacagccccaccctgttgtgtttttctgtccactcactccagcactggctggatggggggtttgggcccccaggaggcccagaaggagcccgttggggtctgcctgtctggtgggagcaaagcttttctcatttgggctgagctggctagtgtggttaatttcagctgtgtccagaactttccagaaatagcctaaggagctgagctgagcactaggcttctggcttcctacttttagggcctctgaaactgacagttgggttcgatgatgatttcaggtcactgaacctaggctcactggcgcaggatttgagggatggcctgcaggtgtctttagtctgttacaaacattgaactttgttgaagaggcggctttgagatcacatttctcaaaataagtggccttcagacattgtgtgaacatggccgactgtagtctcccattaacccacccccgctaccaaaggaacggaaatcgaataaaagcccaaacctgactggatcactaagctgctagttgctccttttctaagagcagatgtatgtggcttgtggcaccaaaatgatcatgcctctcaaggttgtttttttttttttttttttttttttgagacggagtctcgctctgtcgcccaggccggactgtggactgcagtggcacaatctcggctcactgcaagctccgcttcctgggttcacgccattctcctgcctcagcctcctgagtagctgggactacaggcgcccgccaccgcgcccggctaattttttgtatttttagtagagacggggtttcaccttgttagccaggatggtctcgatctcctgacctcatgatccacccgcctcggcctcccaaagtgctgggattacaggcgtgagccaccgcgcccggccatctctcaaggttttactttttgagatggagtctcgctctgtcgcccagcctggagtgtagtggcttaatctcggctcactgcaacctctgcctcctggattcaagcgattctcctgcctcagcctcccaagtagccgggactacaggcatgtgccaccacgcctggcagatttttgtattgttagtagagacagggtttcaccgtgttggccaggctggtcttgaactcctgaactcaggtgatccacccgcctccgcctcccacagtgctgggattacaggcgtgagccaccacacaccctgccttgcctttcaaggttaactgatgagtcctttcaactgttttattcttcccgttttctttgaatgttacatgtagtgattaaataactatggccattccatgaacgggtacgtgcagctggttcttggggctctccaggccagtgggctgtagctgggtggtggggtggggggctgttttctgtcactcgccagaggtccccatgtgactcatggccactggttggttattgaatgcaagggtggcaggggtgagggttctggctgcccgggtccttacggtgccaccctctctgcccgtctctgctgcagggttggggtgctggaggactgcttcaccttcctgggcatcttcctggccatcatcctcttcccctttgggttcatttgctgttttgccttgaggaagcgacgatgccccaactgtggagccaccttcgcttaaagggaacaccaggcccggctttcctacacccagctctctttttctaatgtaaatgttgtgtacaataattttatttgattaagcttcaggactgttttgtaaagcgaggtgggaccgatgtggcacacgccagctgcggtttcccggagcgtggagaggcagtgctgctgctcccgcccgaggctcatgacaactcaataaagcactgcttttattttttgcagtcttcaatttgagaaaggtgagaaataatgttttcaataaatgagattcataccattgttgacctggtgctgcttactcggtgctttcagagacccaggaaagactggaacgacacccccatcgctcccccggccagtcctgaccacagttgtattcagcaggcgcttacagctcaagaaaatgttttcaagttctgctttattattaaagttgtaatcccttgatatttacagagcaggcacctcggtgccaaggaccaggccatgcccgttctggtctgggaggcagaacctggggttgggtgagccacggggtctgcaggttgcatccgagacccccaggtcctattcttccaccccgtaacaaaaccagaaacctccccaaggcagaacgccaaaggccaggtgtcacccacaccccagcagttccccttagcgccagatggggctccctgagccctgtggctgaagtggggaacacggccatggggcttgtgtggactgaattctcatgtggctgcagccctttctgtagtacagactggggttgttaacatagttcatggtgcctgcagccccttcatggtgggggtgcctggtttgtcctcccaggagaagcagatggtaacactgctggacctggctggaaggagcctgaagcatcggccacgtccactggcttacctgcatgtaacctttcccaatctcagcctcataggatactacacttatggcaaggctaaaggagaggggataagtcacagccccagcacccagcaacacacacggtgagcggccgggctggagtgcagcagcatgatctggctcactgcaacctctgcctcccgggttcaagtgattctcctgcctcagcctcctgagtggcgcccaccaccacacctgtctaatttttgtatttttagtagagactcctgacctcaggtgatccccctgcctcggcctcacaaaatgctgggattcccgtacctgggccgggctgggaattttaaccatgactctccactccaaaataggtccagatccttggcagccaaagatgatttccagccccgggctcagggcagccagtgcgtagtcctcacatccataccatagggccaggttccgagggcatcatggctgctaggctgaaaaacccgcccttctccaggcaccagaggtcatcctggctttacacgtatcctttgagagtctgtacctgattcaaacacggagaaaccaggaccccgagcagtttgagtgtactggtaatggatgcagctttggccaactagctgagtgagaacacaaggagccgtgactccgacgcccaggcctgtgtcctggatgggccgtgtgcagcgaatccgttggcgactcctaactaccaagaaaaggagctctcggaggagatttcgtcgagtgctacgtgtggctgtgataagggcaggcaaagcgtcttagcactctacagctctggcgtggttggagggagggtgggggtttctccatctctggaagctctacacttaaacattttaagttaaattacatttatatagtattttcataatttatattgcttaaaattatgatttgcatgctaagatgcaaacttacgtgatatcttctttagacataatgctattaagagcacatgctttataaaataaaactggtctcattcatatcaggtgcagaaagccagtcctgaaagcatagactatcccttattctggctgttattaaggaaaaaattcatttaaaaaatacagtaaagattgaaaccaagtttactgtttcttgaacagaataggaagaaaatattttaaatggctgagctggtcattagactattactcatttatcttaaaggcagaaacttgtcaacccaactacgtgaaacagagaagcatgatttgcttaagcaggcgacattagagttaggcctctccactgaagcttcccgaccgtcagcacgtggcagacaggatgcgcccatcattccgcaagggagaaccggagaggcccgggagagtccttggctgtcctctcatcgaatgatgggtgccgagcgatcattcgtcacagtcgggcggagtttcacagtggcaaaggggttttctccgctgcaggggataagaaaaatctttcagaacttctgctctacgagggaaactggattttaacagtgctaataacccgttcttgccctgtgagactgggcggctgaccacctccccagcttgtacaggtcccagcagcgttttctgagtgtgaaagttttgttcagtgatgattcctacaccataccacctgctgcagaacgatcccaggttttaagcgttctggacgtgggcacccacacctctttagtcctgcattgtgtgtgacatgggggtcactctggggtggggaagccctgctcccagcgtggtctaaagtagttggtaaagcgagcagggggctgcactcccccatggctccacaggccgaggcctttctcaggctggaccccctgggctgggcaccgaaggcccttccgggggacactacagggaagagcaatgtcacacactgaggctcacgtaggaagccacgcctacctgagaaaaggcggctttgcagtcccgttggcatcgttctgtgagaaagataaagaagtttatggagggcttagaattggtcttttaaaaattattttaggtagagatggggatttgctatgttgcccaggctggtttcgaactcctgagctcacgtgatccttccaccttggcctcctaatgtgctgggactacaggtgtgagccgctgcgactggcctgtattggagatttttaataagacccgaaggtaaagacatctaaaacataagggatgtttaaaagtgccctgtcccaatctgttagactgtctaaattcacttggaagaataaggcaagaacagaaaacgctctgaaaggcggtagcggccctcccaggtgtcagagcgtgaacagagcatggcactgcctgcgcgggtcacccgtgatgtcgggagctcacatgtgaacgagccgcctgctaaactcggaaacagtttcacaaaatgaagcttgagcaacagagcgacatcacagaagaaaacatttgtgccaaacagaacctctcagactcggggcaaacagagatcccacaggtcctcagccacggtcttttgaacgcagaatctagtgactgggatgtgctttttgggagctgactcctgaagcatgacaaagaaacaggaaataaaaataaaaccccactggctttggggctgctagagccagggatcttgtaggaagctcaaactgaggaaaagagaaggtggaaccaaagtgcaaaggtgcctacagggctcgggtggggagcaactccttccagcacctgccacccagggcgagccagggccaggtgtgtgcgcgccttctttccctcactccaaaaagcctggagggtttaacactctttcctgcctgcacacagggagtggagtcaggcagccgcccaggagagggcagtgtaacactgtgtaaccagcctgtggcccggccacaccgtcctgacagccccaggaagcgtcccagcacccccagggggtctcagggagcacgcagacctctcaagattgacttaggggaggccctctcatgcccgatgccagcgctagagcgcaggccgttcctggacatggaggcccaggccaggcctcctctgggatggcctccactgcatgttgggtgtacaggctgtggagacggaaggcagtttgggagccccagggctgtgcctgagacctgtcccaccctccccagatcccctgggcagggcatctggggccaattcattgtctgcttttcatcactggagcacaaagccactgacctgccttgcacatcctacagggctttaaatggccgcaaaagtgacttcctgcggggcactcaacgcttccctagcaggcctcagaggaagtccttgctggtgtgaggtgcatgctctgcgattatgatgggctaatttatgatttaaatgcaccagggtgcctgtcgcatgtgctcacggtgctggcattcgtggactctgttgcagaagggccatggctgggcctgaggcacgattcatgccaatcctgactccactctgccctcccctcctctcccactggagtcatctgactccttggggccaacaccatctccctcacatgtgcagcttatgctaggggaaggcgcttcccaaactagaaaccagaaacaccctccacccaccccaagcacaccccggagcttgttcagagcctcctgggcccccacgggactttaaaaaggtcccagtaaatcctcacaaagaacgcagcaagaagcaccgactcctgccaggaggactgaggaggaaaaagaacgcttaagatgacagctggaagccactcagtgttgggccaaccccgtgcacgcatgcctggggcccaacaatcctgctccctgtaggaacaagcagggcacacacccatgggcaccgagacactcgggcagccctggagaaacagcccagaccagaaacaccagacgcccgtcaatgggagagtcagaaccagcttctgtgcagacagcaggtcaccacacagcactgagcgactgtccctacggggccaccccagacagccatctctgtgccagggcttggggagtctggtgttggagaagggatggtcacggaggtgggccatgctgggtgatcgtgggggccgggaacgtcctgctgggtatacggagtcacatcatgaaaattcattgtgtgcttttctgtctgtggtattctgtaatacaatgtttactttaaaatatgtattgggccagggacagtggctcatgcctgtaatcccagcactttgggaggctgaggtgggcgcatcacctgaggtcgggagttcgagaccagcctgaccaacatggagaaaccccgtctctactaaaaatacaaaattagctgggtgtggtggcgcacgccggtaatcccagctactcaggaggctgaggcaggagaatcgcttgaacagggaggcagaggttgtggtgagctgagattgcaccactgcactccagcctgggcaacagagtgagactccatctgtaaaaaacaaaaaaacaaaaaaccaacaaaacaaaaacagaaacaacaaaaacatattggacgtgttcaggcagatttcccgtttaacatctgcatgtttctcagggacctgaaaccccagcactccttctggatacaaggctggcaggagcctctctgcctccctctccactgcaaaggagacccacgagggcaggggcttggcacatacggtgcctcttatctggtggcccccaagggtctcacagcatcctccctgcgtccctgtctcaaccgcatacctcacactcagcccactgtggtggtcactgaacatagacctgccctcctctctgttccctttccttgcagtgggggacacctccaagccacaggcagcactgccaccggcacccagggccccgcgggcactgcctgctgcatgtcctgtgtccccaacaagacaggagaccactaaggccacgaaaccagcagccactacgagagtggttgggctgcaactggagactatagagcgaggccaccaagcggctgactgcggccagggtggacacatcttgtgatcccccatctcccgcaagaatccaagaatccaaaatgtgtgtgtggacactggctgaccacccatcactcgatgcctggtccacacccccttcccgactgtacggagcttccagggtgcccaccacatagccatgcgcccaggttgggggactagttgacctggctttcagaggggtcccgggcagctcggagcaccgagcaccactttttcccttgggctgcagcagagaatgctggtggccctcactgcagagggcaggacagagtgaacagggccagtgcaggtggccttgctcctgagcagaatggaacagccctaaggaacatttccaagccagctggaggccagttactcgcaacaaaagtggccctcactgacacctgtcttcagtgtgaaaacccattccagtcctcgtctgtggcccggacttgtcttccagttcacttctgatctagttcaacccctttattctcaaaagggggacgctgaggcccaaacagggaaaagccaactgctccgagccactgggatctttttggaagccgaggcacccatgttgtgacgcaaacgaagatgcgtgcaggcctgcaccgggggcactggcggctctcaggaggggctcacgccacgtgagggcgcgctgtgaaatgcaggcttgcttttacaaaggagagctgtgtgcttatttaaaatgttgggagggagccaatacttcctcacttggaactgcagtagaaaatacgtaaattaaaaaaattcaggccgggcacagtggctcacgcctgtaatcccagcaccttgggaggccaaggcaggaggactgcctgaggtcaggagttcaagaccagcctgggcaacataacaggatcttatcattgttaataaaaacttaaagagatatcacgtgacctgtggcaaacccctagcttgagtcctggcaagtctcccctgcccccttgggagaagcccctgctctcagatcgtctaataagacgcgccgtcacaggacagctgtggggcttcccaggtgagtgggatgctctatggacacctaaggttaagcattccagtgtcacacgacctgtaactcacaggagctggatataaaaccatgtataaaaatgcttttaaaaaacattaggggctgggtgcggtggctcacgcctgtaatcccagcactttgggaggccgaggcagacggatcacaaggtcaggagatcgagatcatcctggctaacacggtgaaaccccatctctaataaaaatacaaaaaacttagccaggcgtagtggcgggcgcctgtagtcccagctactcgggaggctgaggcaggagaatggcgtgaacccaggaggtggagtttgcagtgagccgagatggtgccactgcactccagcctgggtgacagagcaagactctgtctcaaaacaaaacaaaaaaaacatgaggatgctttcccagctctcatggatcccagtgtttggcctgggatataacacagctttccccaacatcatcagctggtttaggcattttggttagggaaagctaagttattaatcgaggtggacataaaaaggctgagacacataattccaggactgtgtccccagccctcaagggtgccagaggcccccggggctttcaggtggcaaaggctgccattgtttttgagacaggtcttgctctgtcacccaggctgcagtgcagtggcacaatgacagctcactgcagcctcgacctcctgggctcaatcgatcctctcacctcaggctcctgagtagactacaggtatatgccaccatgcctgactttttaattttctgttttttggtgttttttttgagatggagttttcctcttgttgcccaggctggagtgcagtggcgtgatcttggctcactgcaacctctgcctcccgggttcaactgattctcctgcctcagcctcccgagtagctgggattacaggcgcctgccaccatgcccagctaattttttttgtatttttagtagagacagggtttcaccatgttggccaggctggtctcaaactcttgacatcaggtgatccacctgcctcggcctcccaaggtgctgggattacaggtgtgagccaccacgcctgactggttttttagttaattttctatatagacgaggtcccactatattgcccaggctgatctggaactcctaggctcaaatgatcctcccgcctcggcctcccaaagtgctgggattacaggtgtgagccaccgtgcccggcaggctgccatcttttgagcctcagccatggtacctgcttcttgaccaccacgttatggatcaagcttatttttatatatagagagagatgggtcctttctctgtcgctcaggctggacttgagttcctgggctcaagtgattctaccaccttggccttccaagtagcagggatcacaggtgtgagccaccgtgcccagctagagcaagtttttaaatggaacactgtactattttgtatgatctattcctaactgtccaatgtggcaaccactagctgtatatggctacttaaaataaaatttgccgggcgcagtgactcacgcctatattcccagcactttgggaggctgaggcgggaggatcacctgagatcaggagttcgagaccagcctggccaacatggtgaaaccccgtatctactaaaaatacaaaaattagctgggtgtggtggcatgcacctgtagtcccagctacttaggaggctgaggcgggagaattgcttgagcccgggaagtggaggttgctgtgaaccaagatcatgccactgcactccagcctgggcgacagagcaagactccgtctcataaataaataaataaacaaacaaacaaatgtaaacgtctagttccttcgttgcaccatccgtttttcaagtgctctgctgccctgtgtgccctgtggctgctggactgggcagggaacatttccatctgtgctgctcgtctctgacacacacatgcttgatccatgatccctgctggtgaggaggctgtgaggccaggaggcccagaacacacagccattccccctgctccctgctcccgcccttggagcagcaccaatgcgtctgtaggctgtttcccacagctgcgctcccggaactcctgactgggattggtctggatgaaacgtggtcacttgtctaacaggagtgctgtctacagaggctggatgcgggtgacagttgcagtccctccccgcaatgcttttgcagtctgcataggatgttagaataacagcatgcagatgaccgcgccatgtcttatcaggaaagcgtactgatgtggaggccaagaagctgctggctgagatttcagaactgggtttctaacctgccgtgggccttggacagcggctgccattcttctgtgcctccctttctccatttcacgaggccccgctatccctctacctccccaggaggtcccagcacaggcactgctcaggaagcaccaccgtgaggtgcgaagggtgtgaaggtacgaaagacaggagggcaccacaggctggcggcaccactcccctcgcaggccagccagaagccaggcagcagtgtggaggctcatcctgcctctctggctggtgcccgaccccagctcttgagccccccaagtcaccgcaacgcccaggccttgtgtttttgccgaagctcgtgcctcagagcctggctccgacgctttcctcctagaagcctcccctgatgcgtcccaggaaccctggcctctccccttgtcctcaccccatgcatcgagcgctccctggactccacccctgcgtgggtctcattcctctttgtgtcctgagggcttggctctaggccgcccagtagaggccggctggatgaatgctgatgggacggtctcatctctgtccacaaaacccctcccccacagccataccctcactgccatgtgactgtgttgacagaagtctgctggcctcagaggtctgcggcccaggaaatctcagctgccatcagtgataaacatgacctccctgtgggcgtcacctccacccctgtgctggatgggccttctcatcgatttcagtgatcatgaagttaatcagcagtcagcactcaaacacgtgcagaatcaatgacaactgaaatgattagaatccgcataaggagggcattctcatgaggtatctggggcttttgaatgttcttggatgaaaccagaaatgaaaggctgctaaaatgaaagcctgaaagccttctagctttttttttttggtatatatatatatatatattttaagtggagacgggatttcaccgtgttagccaggatggttttgatctcctgacctcgtgatccgcccacttcggactcccaaagtgctgggattacaggcgtgagccaccgtgcccggccaagccttctagctttcaagacagaaagggggaacctgaagatgatggtgtgtgtgtgtgtgcacacgcgcgtctgtgtgtgtggtgggggttagagggagggtggtcttggggaagtgagctttggcaggtgcggcctgtggaggcagccggggactggatgactgggaatctctcccgtggaggggacagcctgaagctcgcgggtgtgagctgagaataccagctcaggtgggaagggtggtggtggtgtccacatgggccagctgcgctggtggaggctgcagggcaccaggtcaccccctgcaggcagccccagctcagcccaaccctccaggtcagggccctcggggacagtggtgtgcttaaagctctgctgcccgaggaagtgggaagccggtaagaggcgtgcaccgtgcgctggcagtctcccgacactgacagaatgtcatgatccagccaacgaagaggtttaagaatgaagccaggtcacctttccactccccagtgctaagtaaggaggaatctgtcattactgagtacactgatacttacaaccaggcttcttccatttatccaattccctgcagtaagaatggcggcgacagtactttcttcaccaagctttatccacacgataaatacgctgacaatgacacgttttcattttctaacactgaagactatccagggttggccaaagtgtcagtgctctcacttacaatgccagagctgtgatttttgggggcaagattcttttaccttaaaaggcattatccaacctcaataaagcagcaggctaggcgaacatcaacagctactaacatcacaaaaagagatggacgtccacacgtgcctcctcactggtgaaatgctccagcaaaacacaacagtcaaacaagcaaaacagcaacagactctgagcagggcctgaggtctaactaccaatttacagaaatacaggagacacgggggaacgcagaaaggacaccaacagcaaaatccagatgggggacaccctccaggacaaatgactggttcttctacaaagagactgctaaggacaagaggcagaggggggacctgtagctagaaaaggcctcacgagccctatccaccaattataatgtatggagctgatttggatccagattcaaacaactacactgtaaaccatttttctttttttatgagacagggtctctgtcatccaggctggcatgcagtggtatgatcacagttcacagcagcctcgaacttctgggttcaggctatcctcccaccacagcctcctgaacagctgggactacagacatgtgccaccgtacctggctaattttttatattttttgtctacatagggttttgctatgttgccagtttggtctaaaactcctgggctcaagtgatcctcctgccttggcctcccaaagtgttggaattacacagacatgagccattgcacctggcttcaaagacattttgaatgaagtttcaaaagctagcattcctaaaccaaatcatgccaatgcagtctacaatgaggcaggtctacgttcccagactcctcaaggctcacgcgtaggtctggggcaggcacatcttagaagcacatccgtttcatatcatcaagacactccacacctgggcaccactcacagctgaactaaggccccggacacaaggtataggggcctggctccttcgccccaaagcaagacagctcctggagcgaggggtgcagacaccaccacccagcctcctccccttcacccacaggtctcacaccagggcgcactaacctcagccaacccagcccgggagtgatgtccagccgcgctgctccccaccacgccatcacctcaccttgtgttattctctgcatggcttctagtgtcagtgtttttgtttattttttattgtctgcttcctatcactagaacagaagttctgaagaggcaggcagagtccggccttgttctcctctagctggagagcccacaccagggcctctgtgcggtggcgggaatggatgaactggttccgggagcccaggacctccatgctgggcccccagaggcacgttagggttatctttcagggttatcgttaaccctaaacgccgtgcctagaaggtttagggttaaagataacatccacagtgcctgggagtaaagactttctgaagaaagatgaagttaccacttttaatgtaagcctctcttcagaaaataagaaaatgaaagaaaatggtgattcaatggctagaagactgcagccaggcaggaaagataagaaacctaataaaatctagcaaactagaggcgactgtgtgtaaactctcactgacaagatagagtccacatgaaagaagggctgaagtcaaggaggtgaaaggctgcatgacaaagaagggaatctagaggatcaaaggcagcaagtcccctcctccctcctccccggggacaccactctccccctggggacagagcagagcaaggcggtcaccacaggacctgcgcctcccagtcggggatggcgagtccaggacccaggacgccctgctgcggctttactcacaggagccgcggtctcgggcttggacgctggggccttaaaggtggatgtcgtcctggccgaatctgctctcctgtcggcagctgcccccatggacaagcattccaagtagtcgggtggggggatgacaacactgctattctcagacaagttcacggtgctgatgcttctcactggtgtggggctcaaacccaaaaaggacacagcacgtgttagataatgtctcaccaccaaaccccaaacatcctctgtgtccctgaccaaggacaacagtaatagtacatcaccaatcaaaacctgatcttgatctcacacacacagacacacacagtacatatatcaatacaaaacactgtattttttaaatttttttgcgacagagtctcactctgtcacccaggctggagtgcaatgacatgatgtcagctcactgcaacctctgccttctaggtttaagtgattcttctgcttcagcctcctgagtagctgggattacaggtgcacgccagtgtgcccagctaattttttgtatttttagttgagatggggtttcaccatattggccaggctggtcttgaactcctgacctcagctgggattacagcatgagccaccacacccggcctaaaacactaatgtttttagtggtttctaaacatatcctcacaagaaatttttttttttttttttgagatggggtttccctcttattgtccagggtggagtgcagtggcgcgatcttggctcactgcaacatccgcctccctggttcaagtgattctcctgcctcagcctcccaagtagccgggattacaggcgcctgccaccacgcccagctaatttttttgttttttgtttttttttttttttttttttttagtagagacggggtttcattatgttggccaggctagtcttgaactcttgatctcaggtgatctgcccgcctcggcctcccaaagtgctgggattacaggcatgagcccctgcgcctggccaaaaaattatttaaaagacatgacaaaaggagaggaaaccttttaaattaggggctggctcttgattgatttaatctaaggaaagaaattggagactagcaaaagctggagtgagcaatgagctaagagttaaaaaaaaaaaaaatgtaaacacttgaaattttaacatcctaaaagtgttactcagtttttgttccccagcacaatggcattttagctcttctgctagggatgaagattgcagacagcatcagaccctggggaatgcaacgtcggacctggaggccttctacctggctagctggatgggttatgggggttctgtgaacttcgatcctcccgcctcagcctccagagtagatgggacaatgggcatatgccactatgccctggctaattgtttattttttttgtagagatggggatcttgctatgttgcgcaggctggtcctgaacttgtggcctcaagtaatcctcctgcctccatctcccaaagtgctgggattacaggcacaagccaccgtgcccggccagtttcctcattttttaaagtgggggcccacctcatgggtctgctgtgagaattaagtgaaaaaatcaatgcaaagtcctttggacagtctctaggcaataactactgttagtatctgatctggaatacggatttgggggttttcggcatggaggtgctcagcaaagcccatcagtgtatttcaagccatgggagtggatgagatggcccagcacaggcaggaaggatggacccagggtgactcccaagaacactgatgtttaattgatgggcagaagaggggtgcaaagagctggtgaggcagaagacaaacagagcacaggtcaagcagccggggccagagaacattccagaaaaagcatacaacagcgttaagggctgtaagataagaacggtaagataagtgtaagataaggacggaaaacacatggcttgggtttagcgaccaggaggggcagggcacagggagggagtttcagagggctgcaggactgcgaggagtaggtggcctgggctgggtctcctcacagcagcaaagctcggggacaacagaaatcacggcagacagcactgtgagccgcggtctcatctctgactagtccacgagagctgaggcttagggcagggcctgcgacacagctagatggtggtgtgttacagaaacgacaaggcaggggtttctgtcaccgggagagctcagccacgttcagggctaccttggcgtgggcacggtcactgcttctgtctcattttcttccagcaacttcgtgtacgacgacgggaaccaacccctcctaccggcaaagagggagaaaagaccctatcagcagtagacatgtggacggcaacctccctgaacaacctggtgagagctcagggcagacaggtccactgctccagaaacgcccatgtgtggaggaaatgaaattaaggcttttaataggtaaatatggactttcacatacactgaacaatgtgtattgttaacaatttttttttaatagagacagggtctcgctctgttgcccaggctggagtgcagtggtgcgatcatagctcacagcagcctcgaactcatgggctcaagcaatccccctgcctcagcatccgagtagctgtgactagaagtgtgcaccaccatgcctagctaaaaagcaatatatgttgtatgtataacattaatttgatttggattacccctttttttttccatattggttttatttaatacatctgaacaatctgtctagaaaactgacaagctagttacaggaaggcttgtgcacataattatggctgaaattaagaggattgcattcaaactacctacgtgctaaaccttaacaaagtatatctgatatgcagattatcttcaataaatcaaatgctaattttatttatttttttgagacagagtcttgctctgtcacccaaggctggagtgcaatggcgagatctcggctcactgcaacctgcgcctcccaggttcaatcctgcctcagcctcccgagtagctgggattacaggcgcctgccaccacgcctggctaatttttgtatttttcgtagagatggggtttcaccatgttggccaggctggtctggaactcctaacctcaggtgatctgcccgccttagcctcccaaagtgctgggattacaagcatgagccactgcactggccaaatgctaaattttttttaaaaacaaaagaatgtttaaactactttcagacaggtgacttcatacgctctaataactatgcatgcaccaaatgtatctctacatgcacagacatacagaaaatagcctgggatcgaataacttcagttaactaaactagaactaaaccataaacttaactttggctaaaatgtgagcatgtccacgaagacagtttgcagcttggctgctctggaagggaggggccgtctggtgccctgcggggaccatcacgcccagacttacgccttggacacgtcgtgttctccatagagccagccatccttctcctcggggatgagcagcgtgatgacatctccctgtgcaaagctgagtaaggtcttgttggagcccgcagtgtgcgggaagatggtcttcactttctgcttcttcatcatgttcagtcccgttgcaaccgaaactgatcgctgtaaactgggatcttcggaagtacctgttggagggagtgtagcagtaatggcttttcaaagcatgagaatcaataggcacattccaatgagcaaaccccaggaatccacctgttctcatcttgccaacaatgctccttccacggaaactgaccctgtcctatttcctcgctttgatcattgcccagaaggaacagggactgttgagaaacagaggcagcgtgcagcctgaaggcatgcaccgtgcagaagaggatccctgcggctgcgggctcttttccaggcccaaggacaaggcggtgtgtgccgggttgatctgcactgctttagccaggatggctcttcttagagagacaaaccgctccaacgccaaactgccctcgcaattccaatcgcaaaggcaggctagggccacagttcaaacccaactgccaatgtccacaaagaaaagaagaaagctggaaatgcagttggtcttgccatgctggccgctcagcttctcacccccaggcctaagaaggacaaggtgaggatgagttccatttacagagtcctcaccaggtgccagtcacgatctcaatgtctcacagctgccatcccgccaggctcccaggaggaaggtgctgctatttattatccacaggacagaccccacagctggcaagtggctgggccaggaaccagctagggcaggtttgtcccatactctctacccatgagcacgaggctgtgctgttcatgtctccattcaaacacaggctgatatttccactccaggggaaaaaaggtagaaaaaaatatatatatatgtatgtatatacatttgagacagagtctcactctgttgcccaggctggagtgcagtggcaggatcacagctcactgtagtctggacttcccaggcttaaaggatcctccctcctcagcctcctaagtagctgggactacaggcacacgccgccatgccaggttcatttttaaatttttttgtagagacagtgtctcgctatgttgcccagcctggtcttgacctcctggcctcaagtgatcctcccagcttggcctcccaaagtgctgggattacaggtttgagccactgcttctggccgttttttttttccattcaaattttcccaggctagtaatacaacaagcatctttaatttaaaacaatgcaagatctctttctgctttattcttgcagattcttcatgattacaacataaacctgcgcccccttaacctgccactctctacttcgctggtgttgaacccaccagcagttttctttcttttttgagacagagtctcgctctgtcgcccaggctggagtgcagtggtgtgatctcggctcactgcaacctctacctcctggctgggttcaagcaattctcttgcctcagcctcctgaacagctggaattacaggcgcgtgccaccatgctcggctaatttttgtatttttagtagagacagggtttcaccatattggccaggctggtctcgaactcctgacatcgagatccacctaccttggcctcccaaagtgctgggattacaggcatgagtcaccgcgcccaatcctccaccagcaattttcattctgcttttaccaataagaaccagagtcatctgaatcactgggatgcacagagtattacatactttaactgtgtattttagttaactgacaggacttccttcaaaggcaaatgcctgcagaccatcatcttcctctactgggccatcctagtcatcattctggaaaactctgttcttttgcccaatagcttcacacgctgtggtccagggctctctctcacaaacagcttgactgccgcaaccttcacaccatgggggcctgtgagacaccccacgtggatgggttggggccatggcacaggtctcgagggtcctgggtgctaaagactgtgcagaaggacggggtctgaccagtgaagcagccggcaacatctgcagacagtcactggctccaacttttgtttttgtcactgtgtcacccaggctggagtgcagtggtgcgacctcagctcattgcaacctccgcctcctgggttcaagtgattctcctgcctcagcctcccgagtagctgggattacaggcaggcaccaccacgcctggctaattttttgtatttttagtagcgatggggtttcatcatgttggccaggctggtctcaaacaactgacctcaggtgatccacctgcctcggcctcccaaagggctgggattacaggcgtgagccaccgcgcctggcctccatttatttgtaaatagataattctcaacagtatgtttactctggataaacatcagtcagtgcgtagaactggtaaatgtcagagaaatgtatcacttatcagagcgtctcacagtctagtcctgtatttcttctgaactcacgctctgcaaagccagggctgaatgtatctaccatacctgcttgtttacctccaaaccttgcaatacatttatacaaaatatttatttcacagcttatcttaaaacaaatgtaaaaggtatcttcaaataaatcagactgaatctcttacctgttgaattatttaccctttgtgaattcggggcagccgtggctgggttattaaacatatcgatcaagggactggtatatgctctgcctgaaggagcggggggcatctttggtgagcatttagaaagggtgtcgtaatctttcctaacctgtgaaaaattctttattagtccaatattagtatagtgcagaaccggaattacacagattcccaaggctgttttttttttttaaataataggctatttatttatttattttgagacagagtctcgctgtgttgcccaggctggagtacagtggcacgatctcagctcactgcaacctccgcctcccagtttcaagtgattcttgtgcctcagcctcttgagtagctggataacaggcacgcactaccacatctggctattttttgtatttttagtagagatgaggtttcaccatgttagccaggctggtctcaaacttctgacctcaagtgatctgcccgcctaggcctcccaaagtgctgggattacaggtgtgagccaccatgactggccacatttcagggggtttgagatgggcagaaagagtggatccatgtgttcaaagtacctgctgcatcccaatctccacagagcccaggttcaaagatcagcaaactacaaatgtgtgaattcattactgtgaatactttgatgcctattttttttcctgaagtgccttacgttgtgatgaatgccatcagagtgtgtctaatttattctgagacacctatacttccttacttgggagtaaacttagttggaatgattacaaataaaaacagtaagtatggttgggtgcagtggctcacgcctgtaaccccagcactttgggaggccgaggtgggcggatcacgaggtcaggagatcgtgaccatcctggctaacatggtgaaacccggtttccactaaaaatacaaaaaaattagccaggcatggtggcgggcgcctgtagtcccagctacttggaaggctgaggcagaatggcgtgaacccaggagacggagcctacagtgagccgagattgcgccattgcactccagcctgagtgacagagcaagactgtgtctcaaaaacaaaaaaaataaaaaaaaaacagtaaggataaaatttccaaaacaaagataatagcgccaaacatagtataaaacatgtgcccaacttatggtggctcatgcctgtaatcccagcactttgggaggccgaggcagacagatcacgaggtcaggagtttgagaccagcctgaccaacatggcaaaaccctgtctctactaataatacaaaaattagccaggcatggtggtgcgccccagtaatcccagctactgaggaggctgaggcaggagaatcacttgaacccgggaggtggaggttgcagtgagccgagatcactccactgtactccagcctgggcgacagagcaagaaagactccaccttaacaacaacaaaaaacaaacatgtgcccagctaccttcgcccctaaaggtaaggggatagaggtgcgaaaaggtggtcctggaagtaataaagggggacctgtgattcccaccaacacaggcaaatttggcccagatcaagttaggaaacacacgattgaaatctggaagagaaaactggctcctaccacattgcttctctcgatcatgggtgaagcctgaggagttccagacacgggggtagaggctggggtctttatttcttcgatcatattcatgattttctctggcactttgatggcatcaacacaggtctcctgccaccgaggcagcttggaattcagtagttctgcagactgcaaagccaaaagaagaagactaaagacaaagaagattgtctgaagagctgagaaaaatgacatcacgtcatatcgctgataacagattactggcttagcaccaggagtgtgggggccctgggttaaactcggtgagcactttaagcacctagaggatcagctgtgtctcaccggctgagaggggcaaaggctctgactcaaaaggaaatttcctgatccctcagtgtgaatacagagcatgggactaatacggggatggtaaatggttaagagcaagaacagaaactcaaagggagggagggagcaatctgtatgaatcccgttttccaggtggccccagaaacgccaaccatcactttctccctcccactcctactaaaagcagcacctccaacacaggccacgggccccgtagttgactctgaccgattcagacattagagaagtgaatcagacactgtcctgagagtctgtctatggggaagagggactgggtgagtggtgggcagtgctgagggacgcccccaccacaggccaaacaaggttttgcagagcagacctgaccagcaggggtgagaacccgcaaccctggaggcagagtgcccctccagcacccacaagcctggctctgctcctgacaactggattctcagaggccccccaagcgcttccagtgagcaccttttctgaagagcactctggttgggaaaggggaggcaggagcctgtcctgcggctgtgtgcatggcagtcacactgcttttactcagcctctgagtttatcaagagtggtggggggctgatgtcagtcctggggaagggcaaagaccccctcacaccacccctgtccccaaatgccaccccacccccaactgtcaccccacccccaactgtcaccctgacactctgcagcaccgtggaccagctgcttgggcctgcttcatcccaactccacagaaaggactgaggcgctttagctgaattaagggaagccacaaaaccagttttcagatactcgaagaaacttccagcatagaaacgagcagatttggtctgcgtcactctagaaagcattactgggaccgatggttaagtctaagaaagactctgctgataactggagctccctgaaaaggtgctaggctgcctcatgacacggtggggatatcacgcaggaagagaacctcaaggtcacctctgtcctctccagcctgcgaccctggtgccacaggatgccctcactctgggaagagaagattctaaagtgaactctacattcccgaaactagtacagacatgctgttgacaaaagtgatcacctaatacagcaactatttcctttgctgtaaccattttcttctgcttttttgagagaggattttggctctgtcacccaggctggagtgcactggcacaatcacagctcactgcaacctcgaactcctgggctcaaacaatccttccacctcagcctcctgagtagctggggccacagatgcacatcaccacaactggctaattaaaactttttttttttttttttggtagagatagggtctcgctatgctgcccaggctggtctggaactcctgggctcaagtgatcctcctgccttgggctcccaaagggctgggattataggcatgagccactgtgcctggcctgctgtactaattttaaatcttatttagggagctgaatactcctttttcttcctttttttttttttttttttttgagacagagtcttgctctgttgcccaggctgaagtgcagtggtgtgatctgggctcactgcaacctcagcctcctgggttcaaacaattctcctgcctcagcctcctgagtagctgggattacaggtgctcaccacatgtgattaatttttgtatttttagtagagacagggtttcaccatgttggccaggctggtctcaaactcctgacctcaagtgattcacccactttggtctcccaaagtgctgggattacaggcgtgagccaccatgcgcagtcctgaatattccttaaagttgtaaaaagtttatagaaaatacaacatttgcatacatacaaggccaaagtatttttcctttaaaacaaagacaaagctgacttatattcaagctcttgcaaagcttctcctatattggaacactctctaactttactatgaacaacaatgaatttctgacctcaaccagtgctagttttggatgtttacaaaggcccaacagagttcataatttaaaacaaaggaaaggaaatgtgacatgtgttgcatcatgattcctgggggttcgaacctcacagctgtgtgtgttggaaggagggtgatgaggtcattcagttgaataaaccaggaaccaataccaccaagaggaatgaacgcatcactgagcccagctgtcctgatgcgcgtgaatgggggcccgtgggctggggcagagctgcccgtgacccccggacacggacccatgaagggagcatctcaaatcgcccaggtggggtagacctgggcccgctgggactcaccagcagccatggtgaagacactgatgctgaggacacatcagaaagggcctggggaaagctgactcgcaggtgagaagagcaaacatgtgctatttttcaatgatgaagcattattttatgaaggactttaaatatggatgtattattaatttattaaacattatacatggacgtttgaccatttcagctgtatttctataagtttatatgttcaagttggccaaacacagtttctctggaatcttttcattggcaaaatggcccactgctttatattgggcatgtgtggaaggtgagtggcgtgcatgtgtgtatatctctgtacgtatggactgattgagacagggtcccgctctgttgctcaggttggagtgcagtggcacaatcatggctcactgcagcctcaacttcccaggctgaagggatcctcccacctcagcctcctgagtagctgggactacaggcacatgctaccatgcctggctagttttttttttattattttttatagagacagagttttgccatgttgcccaggcccacctcagcctcccaaagtgctgggattacaggcgtgggccacggcccagccttctggggcatttaaatatgaaataaagttattaatacgctcaaggcaatttgccaccacacccacctgtaagtgataataatgtatgtggtttgcaaagccacagtgcttatcaaccagaaagcagaagcgcctcttctcttcaagcagagcctctttgcaaccatctgcaatgaatttctggatttcactctgacgagaagtaacggtctccacatactaaaaaaaaaaaaataataataataataattatataagcatgacatgagcatcagatagcgtgcagcctgacgtttatcttctgccatctttacacctgctttatttgaataatagagtaaatacatgagaggaaagaatgctgtaacctgacctaagtagataccatcgttctccttgaggtccctgactcgtgtgcagagagaagttgcccaagggcttgacattcccacggggcaatttgcacaaatattactttgtacttcagagatatgatcgtgtcctactggaaagcaccacgggctttggaaccagaaagttccaggttcaaacccagttccaaatgccaacaataggtgatatgctttggctgtgtccccacccaaatctcatcttgaattgtagctcccgtaattcctatgtgtttggggagggacctggtgggaggtaattgaatcatgggggcaggtctttcccatgccattcttgtgatagtgaataagtctcacaagatctgatggcttcataaagggagtttccctgcacaagctctcctttgcctgctgccatccatgtaagacgtgacttgctcctccttcccttccaccatgattgtgaggcctccccggccatgtggaactgtgagtccattaaatctctttcttttgtaaattgcccagtctcggggtatgtctttaccagcagcatgaaaatggagtaataaaatatgatttaacctaagcctcattttccccatctgtacaatgggaatagtaacactgatcatggagagtcccttcttctttcagagccaggataaaaagcccatgttttggcaggaggtcactgattaattatacttaactcagggaaactctacagccttcagctctcagtcaaaatgcttatttttaaaaactgatagattatatatttatagggcacatgtgataatgatcaaagcagggtccttgggtggccatcacctcaaattcttattgtttctatgtgttggggacattccaagacctctcttctaactattttgaaataatgcatcgctgttaactatagtcaccctactctgctattggacactagaacttatttcttttatccaattgtatgtttggacccattaaccaacctctccttcatccactccccagtcaacacaatgaccatcctcagctatctagagaatgacaggtaaccatcattctactccccacttccatgagatcaacttcaaaacttttttttttttttgagatggagtctcattctgtcacccaggctggagtgcagtggcataatctcggctcactgcaacctctgcctcccaagttcaagcaattctcctgcctcagcctccgagtagctgtgactacaggtacctgccatcaccccagctagtttttgtagaggcaaggtttcaccacattggccaggctggtctcgaactcctgacctcatatgatcctactgcctcggcctcccaaagtgctgggattacaggcgtgagccaccgcacccggctaacctcctcttaaactgtgcaaattgtcaacaacaaaagaaaacaagatattgttgaaaagctcacctcaatttctttgtgttcatatttgagtgcgtttcggcttccttggcttttccttctgatcttcttcaactcagcttgggatttctccaaagactctaatttattcttgtgttctgtttggtatctttttagagttgcctgtaagttaaatggctgtgcttattttactgtggcaccacacgaattgtcacacagtttgcctttactcacacttccactgtgtgtggctcaacggggccctgacaccctcacttcacaccatcctcacactggctggggcccccacacccacaccagttcacaccatcctcctgctggccggggtcccatgcccacacttcgcaccatcctcatgctgaccagggccctcatccctcagttcacaccgtctgcatgctggctgggaccctcaccctgcagttcacaccatccacacactggctgggaccctcactcatttcacaccatccttacactggctgggaccatcaccccgcagttcacaccatctgcatgttggctggggacgctcaccacacagttcacatcatcctcacactggccggggccctcgctcatttcacaccatctttacgctggctgggactgtcaccccgtagttcacaccatctgcatgatggctgggaccctcactctgcagttcacaccatctgcatgctggctgggaccctcaccccacagttcacatcatcctcacactggccggggccctcactcatttcacaccatccttacgctggctgggaccctcaccccgcagctcacaccatctgcatgatggctgggacccttactctgcaactcacaccatctgcatgctggctgggaccctcaacccgcagttcacaccatccacacactggttagagccctcacccctcagttcacattgcccccttcatgcaactttaatgtcttggctttgttctaaaggttactgtttaaatgaggagcccccgaccagaagccaagtctctaaggacatcttctctttcttttattccttctttcctcaaaggctttttgatgctgggtggttaactttcttctgccacccaaagtctcaaagttccatccaaagcacttagccaccaaggtggttgcagcaagctgagatcgcgccactgcactctctgcctcccgggttcaagtgattcttgtgcctcagcctctccagtagctgggattacaggcgcacacaaccacgcccggctgtatttttagtagagaccaggtttcaccatgtcagccaggctggtctcgaactcctgaccttggatccacccgccttggcctcccaaagtgctgggattacaggcgtgagccaccacgcccagtgaacacagggtcttaaacggacccgcgtcagaattcaaatccttgttttccctataatctgtgaagtgcagataagaaggatgtctggccggcatggtggctcacgcctctaatcccagcactttaggaggccgaggcaggtgcaccacgaggtcagaagtttgagaccagcctggctaaaatggtgaaaccccgtctctactaaaaaatacaaaaattagccgggtgcagtggtgggtgcctgtaatcccagctaattgggaggctgaggtaggagaatcgctggaacccaggaggcggaggttgcagtgagccccgagattgcgccactgcactccagcctaggcaacagagcaggactccatctcaaaaaaaaaaaaaaaaagaatggtgtctatgttttggagtttctgaaggcatagcaattagataacgtatgtaaatcacttggcatgaaatgcaccttagcagctgtccgggtcctgtggcctcctgccgggagggtgcagccaggcagcagtcctcacgaggacgacaggggagggatgattccagggcaactcgcacactcactgccacatgggggtctgggtgagcaggaaggggactttgggtggcaggagaaagttaagtactctatagagcaagggaagatggcaagagccctcaataccgggtctgtagggccaccctgaaggggacctggataaacctgctgaaatggacaaaagtggatagagaaggggcgccatgcaggagcggtctctgcagatgggccagggcacaccgggagccccggacggtgctctcccgcacaccacccacagcctgaagtgctgctggcttaggaagtgttatgtctgcatcagctgcagcgacagaagcacaaatgtcctacagcgtgaatgtattctgtgaagacaatgctttctggaagcagtgtgatttcctgcaatactttttcctatgccttttttttttttttttgagatggagtcttgctctgtcgcccaggctggagtgcagtggcgcaatcttggctcactgcaacctccgcctccccggttcaagccattctcctgcctcatcctcccgagtagctgggatgacaggcatgcaccaccatgctcagctaatttttttttgtattttgagtagagatggggtttcactatgttggccaggctggtcttgaactactgacctcaagtgatccgcctgccttggcctcccaaagtgctgggattacaggcatgagccaccgcacctggcccctatgctttctaataagatcccaagtgttagcgaaaaccggcccacacagcccaaagagagcttgtcggtttcatgcatctgggcatcatcaacacggagcttctctcctgtctgctgctgatgagtcaacagtgggaacgagttctccccaggctgggaggtcaggcagcccaaggctggggctggaggaaaaccatgcacttacgttcatatatttcacgtcaagttctatcttcttctccagctcatggataatctctttgtggaattttttaaactgttaacaaaaggaaataaattcataccaggtttgagattttaagcaaaataagttctaaaacctgaaatgagtgtattttgtaaatagaaacacagatcacgtacattttcatcaagactctcgttgagtttcttgtgggtacttgaaatctctatgaggacatgtcctgggaacaaaaccagatatgttagcgggaagccattgcgtatttttttgttttgaaatggagtttttgctctgtcgcccaggctggagtgcaaaggcacgatcttggcccgctgcaacctccgcctcccgggttcaaactattctcctgcctcagcctcccaaatagctggattacaggtgtgcatcaccatgcctggctaactttttgcatttttagtagagacagggtttcatcgtgttggccaggctggtcttgaactcctaacctcaggtgatcaactgccttggcctctcaaagttctgggattacaggtgtgagccgccgcgccaggcccattgcacagttttgtaaagtattaggaaaagtgaaacagaacagggaaacacagaaatacactgtcctcagggtctctaagcatcatccctgagacacatcaggagcacaacagggtccccacagtggcttccagggggacacagctgagagcaaacagcttctacaacataattaatcagacaaatgcaaactctgttcaaattcacatgagtctttctgttctgtcttttgttttttgagacagggtctggctctgtcacgcaggctggagtgcagtggcacgaccttggctcactgcagcctccacctcctgggttcaagttatccttccacctcagcctcccgagtagctgggactacaggcgtgcaccaccacactcagctatttttttgggacattttgtggggagggtttttcaccatgttgcccaggttggtctcgaactcctgacctcaagtgatccgcacacctcagcctcccaaagtgctgggatgacaggtgtgagccactgtacctggcccacgtggccctttctatatgcactttttccctaagccaagttctatatatctgattcaaattttgaaattgtctcacaaatgattacttcggtcatcacagtagctaactctaggaataaaaaatgatttatttttatcgaatccccagagtaatctgattatctgtcaggcacgagagataaaggctatttcttttttctcacgttagttcttacaatgttttggaaaatactaacgccaggggaacccgcagcaggaagagtgctcagccctgcctctgctgggaatacaccagcccctgaaaccaagcacagtcacatgatgggcaggatgctccaggacagagaagcctcaccgccgagggcagcaatcacgcccccgggtttgcaatcatatctctgcagtgagtggcagtgcgccagctctctgccacctttctacaggtgacatctgataaaggtgaacaagggcctctctctgccaacttatctgcaggaaccaaacgggtttcctagggtctgacacctaagaaatggagaaacacatagactcatctggaaccaccgttaccaccaccatcaaacaatgccgaccaacagcaagatgtgccggcggaccatcctacagctcagcggccagataaaaatgaattccaggccgggtgtggtggctcacgcctgtcatcctagcacttttgggaggctgaggtgggagtatcacgaggtaaggagttcgagaccatcctggccaacacggtgaaaccccgtctctattaaaaatacaaaaattagctgggcatgatggcacgtgcctgtaatcccagctacttgggaggctgaggtgggagaactgcttgaacctgggaggcagaggatgcagtgagccgagatagcgccactgcactccagcctgggtgacagagtgagaccctgtctccccgccccccaaaaaaggaattctagtggggaactgagaggctgcaggggaggaatcggaatgaggactgtggtagaatatggggagagagagaaagcacagactggactatggcctcggctatgatcaccatacaaatgaccctatcatgtcctgttctaggtacatctgaagacatctgagtctgacactggccacccaggcttcccttgtcccagctcaggattcaacccttgctgaacacgaccacgcagacgtcccattgggcacacctcatcctcgacatgtctcaaagtgacctctctggctgccctgcattctctaattccagctctcagctgccagccagccaaggatcaacttctcgcccatgtgtaatacctgacaatcccttggggataggaggccatcatcggagccacctgtagggtgcagccatgtcccttcctaagctctgtggtctcttccctgcccaggagagaaggcatggggcatggcgtgtgaagtcaccaagacatgttcaccaggtgatctgttccaccagagatggcggaggattctcccatccacccccagcactcacgtcccaccacgtgggctttcgaggaggtcctctctcatgcctgcccaaccccaatgcctgcttccatccctcatcctctctctggactcccagcttgttctttcccagatcaccttcctcacagatgccagggatctttccaaaatgcaggcgtaacatgtcgctcccctgctcccgccatggtgttccagggaaaccagcttccgagctgtacttcagagccctctgcaaacagtgctacctagacaaggtggggtcagaggctctcagataagcagaacttgcagggcttgtgacaggtatataacctagtccttaagccctgtgggattttacagcgctctgacggagtaactcgatggctaaacacggggagtaaagacagaaccatcccagcactcagggctccaccctccgagtaagcgagcttcccactccacatccttagcaacgctggcttcatcttccagaacggggcatgagaaaaccgacagaccagaattcttcacaaaagctgccttcacacagccaagagcataattccattaatatgccattttatagcccctcagtcatttcagatacaaactcagttactttcacatctattttaaacccacaaacaattcctcattggggatgaaatataaacaacaacaaaacccgctccagttatttagaaaatcagacactctattcttggcaaaggagatctacttaaaatacataaataaataaacatctaaaaataatgtggctcaaagcattcggtgatttgagctagaggaaacgcattcacattttttccctcatactgttctctttcatgaactttatttccacaaccttatataatgtggatctctgggaagcatggtgccaaaaccaaggtgtgtgctagggtggacgccaacaccgttgaacctggtgctctggcctggccgggcctctgggcacgctccatgctcctgcccgtggcttcccgcagcatggcggagaggcgcagtgaagcagctctttcactctgcgggcaggcaggcaacacctggccttgttattcctgtccctcactgctcctggaattcagatgccgacctcacagcagctggccgccgcggagtcagcggtcacagaaaggattaacacacatcttggctgcgattctgcaagtagccgaaagagtatcttgaagcggaagatgaaaacaccctttatgttcaatctgcagaagtttcatcttaaatagagcaagtgttactttatgtttaaaatgcgatgccacattggtttgtttgctcttagttcggtaacctactttttcagaaattacatttgaaaagggggaaaaaaaaaacccggagggtggggcgaagcaggcacagcctggactcagaagaagcaaagctaagcatgcgccccaataagaaacacaccactgtgctgtgcacactggggcgcctgcttcctttttcccccggttacgtttggagtcacccttttgggaagaaactcagcgccgtcattacagtactgtgattcagtctgaataagtggcaatatacacgtatttcaaaagcaggaactcaacataactcgaagacattttctgccatcaatttttcctcaatattcgcagaaataattcacacagagtgttagagctctgcaagagcttgtctagcaggttgtggaaatctccaacaaaaaaagaatggttaatggtggtatcactctgattttagaaactgtgaacaaatatgcccaacattttggacactattgtataaagagatgcatttagccaataggtggtatggagttaaaacaaaaaaaggacaaaacttcaggaagattattggtatgaatgcctagaacattttcattggaaacacagggccaggtgtggtagctcaagtcccagcactttttcgggttcaggcgggaggatcgcttgaggccaggagttcaagaccagcctgggcaacacagtgagacctccaccatctctacaaaaaaaaattaaaaattagctgggcttcatggaacatgcctgtagtcccagctactcaggagacagagcaagaccctgtctccaaaaagaaaaataatacagtcattggactattaatatattttcttcatcagttcacagtacaaatttagaggaaccagatggagattactaatgcacctgaactgcataggacatgtaggcataaagattctttccatttatatctgatcatggataatcagaacctgcttcatttccagagaacgcagagcaacgcctgagtcacgcactacttcctacacatcactacaagtggagtcagacagtaaaaagtggaagcagccaatctagtactgttctaaagctatgctgcagagattaaagtaaaattgattaaaaatatcattggaggccaggtgcagtggctcacgcctgtaatcctagcactttgggaggcggaggcaggcagatcacaaggtcaggagttcgagaccagcctggccaatatggtgaaaccctgtctctactcaaaatacaaaaattagctgggcatggtggcaggtgcctgtagtcccacctactagagaggctgaggcaggagaactgcagaggtggcagtgagccgagatcaggccactgcactccagcctgggcaacagagcaagactctaaaataaataaataaataataataataattggaggccaggtgtggtggctcatgcctgtaatcccagcactttaggatgctggggtgggtggatcacttgaggtcagtagtttgagaccagcctggccaacatgggaaaactccatctctactaaaaatacaaaaattagccgggcttggtggcgcgtgcctgtagtcctagctactcaggaggctgaggtaggagaactgcttgaactcaggaggcagaggttgcagtgagccaaggtcgtgctactgcactccagcccgggtgacagagcaagactttgtctcaaaaaatatatacatacaaaaaaaaaataaaaatgtcattggaaaaaggactgaatttttctgacaattttccaagtttcaaatggaatgaggagaaaacagtggaagtaaaagcaaaccgctccccagcacacacacgggatgcattaaacgagcgtgagctctgaagattagagtcaccacactgaatcagtgcggaggcagatgagcaaccacaaacgtgatcaaatttgaaaggctcggtcagcatctgagaacctgcagtccctggacgcagttggaagtgaggtgccctcctggggtcagtaccaacactgcacaagcagcggggtgcaatggctcacgtccgtaatcacagctcccagttttgggaggccaaggcaagaggattgcttgagcccaggggatgggccacacagtgaaaccccatctctccaaaagatacaatgataagctaggtgtggtggtgtgtgcctgtggtcccagctactcgggaggctggggcaggaggatcacttgagcccaggaggctgaggttacagtgagccatgactgtgccactgtactccggcctgggcaacagagcaaggcacagtctcaaaaaaccaaaacaaaaacacgtacaaacaaccaatgtgcttgtaggggtgaccccaaataagtgatagggtgagcattgcctggatcattcctccgtgtctagctgctgacttaaataacaacggcaccacatcctaatcaatgtcttacaaggagacattgtaagttactgtacactgtgctcaaaactaactaactaacttaactaactagcgggtatgccacaagagccggcttgaaggagctagtactggccatgtagaagctcatactgggacaacttgagcaccaaaataaaggcagtcacaaattacaagtcatggaaaagtctaggaatctgcgagtccacagtaaacagattagaaaaaagaaatgggggaccagggacagctcttgctagaagtagagttgcacagtgccaatcagtaaatgaagagggagtacagagatggaaaatcatcaccacagggcagggaagacttgtctggacaaaaatcatcaacagatgctcaactagggcacaagtgttgacaaggaaagagaggtttgtatggtctgaaagtgttttccccacaaattgcttactagtcgtgacaaaaaaaaaaattaactacacagtgtagagatcagacaacaccttcaatggacaatcaaaacaaacataacaaatgagaggaagatgaacactgtgtgctgaaattttatactcagcggacataaaatgacttggacagtattccagctgagaacacacaatctgaatctaatcagggagatctggtatttgaaagtgaggatcccggccaggcgcggtggctcatgcctggaatcccagtgctctgggaggccaaggcagatggatcacctgaggtcaggagtttgagaccaacctggccaatatgatgaaaccctgtctctattaaaaatataaaaattagtcgggtgtggtggtgcacatctgtaattccagctacttgggaggctgaagcatgagaattgcttcaaccagggaggcagaggttgcagtaagctgagatcatgccactgcactccagcctaggcaacagagcaagaccttgtaaataaataaataaataaataaataaataaataaagccaggcgtggtggctcacgcctgtaatcccagcacttttggaggccaaggcaggcggatcacctgaagtaaggtgtttgagaccagcctggccaacatggtgaaactctgtctctactaaaaatacaaaattagccgggcatggtggtgcacacctgtgatcccagctacctgggaggctgaggcagaagaatcacttgaactcgggaggcagaggttgcagtgagctgagattgcaccactgtactccagcctgggtgaaaagagcaaaactctgtctcaaaaaaaaaagaaaagtgaagattttgtattcctgactattcatccttgtttagcatttctgatgtgggttcgtgcctgtgccaattctttattgcactactaaatggatttacttatttctttttagagaggaataaattgatttcatccacctccggcggttaatccagtgtggttgagggaggtaagggggaaatggagaagtgtgttaacaggataaatattattaacgctttgcttaacagtaaaatctctggcaacctcaattttagaaaatgagagacatggctgaagacttggaggtgaaaagccaaaaagagctgcaagcagaaacccgaacattgtttttttttttggagaatgggttcccttttagacacagcacaaatacaccttcattttatatataagtctagaatggattgctcaaaagacattgatttttttcatactaaaaagtcagaagcgactgctgacctctgagtaatagaatacaagatctttaggaagaagagctcatgaggaagatgggaaggctggctgaggaggccggagaagggccaggcaccacgaaagggaaaagactggacgcagcttcagaaggcagaaggttctggatcagcctctatagagaactcaaggacacgaagacggggcaaaggtcacagcatccgcaggaagatgcaatgacatcagacaggcctcttagtacctgtgcatccccgggaagttccctaacctctttctgcagtatctcttggagctgtggtattctcatctgtgtagagtgcctgctccacaggcttcggtgggtactgtgctttccagtgttctggagagaaacactggctgctgaggtgccccagtccagacacgtggagcagatgggttcaataatgcactggcttatacctggagtcccagctacttgggaggctgaggtgggaagactgcttgagcccagaagttggagaccagcctggcaacatagcaagatcccatctcaaaaaaaaaaaaaaaaaaaaattcatgatacacaccaacaaaaatgtgcccacacactcctcaacaggccattttctaggcgagtacttgttttctggaaataaaatccacacatgtgattgttcagcctgtagtcaccattttttggtgcactttacacatatccatctatacactcagctcgacacttctgtcatagcctttctttccccagtcccggagtcctcaaaggaaaaactgtcaatctcctgttatctaagggaacatacctgtagagtatactttattttcctctatcttttaaaaccttaaacagaatactgagaacctcagtctgaagtgctgacatttctcctatagtttaagttgcatccatcaggattgatccatcagagaacacacacatctggtcaccgttgatgcaaaaacaatcgcaaaggcacttccggtttccactccagcacgtctaagagcttagaggtcgtcactcccttataataagaaaaagctaaacaaatggaaacaagctaaaataagaaacagtaattctgagacgcatgacaggactaagctcacagggtgaagatgtaccctgaaaaccagacggacaggctgacgcagagactcacagttcacagggagcagagaccaatgctggggccattcctggcagaaactcttacaccgcagtggaagaactgctgggggcttggcatggaggagtctgagagttgcaaacttcagggggtcagtctttgcgggcggtccccacactttcatgagttttacgtctaggagtcccaccacattctcaaggggaggttggataagcttcccctgaggcttctggtagagggggtgggaggtaaacattctgaaatatgcccagagctttgttctgttccagttatgttctctgtacggaaggccgggcctcaagggaatctgctgtaataaagccttatctgaccagggaaagggcgacttgctaactccagccccctccagtcttcctgtctcaagtaaagggatttaaaaaaaaaaagactcagaaactcttccaaaaggcatcccaggaactctggcctatcaccccacacccatccaaacacagggatttaaacataagaggaagattcttcccctccccagtacttggccaccaagttatccatcaacagggctccgggataatatctgtggattacagcacagagccgtaagtaagacacaggcttcatttagaagaattttcttgggaaaaccaaagacaacagcagcgagaaaaaacaaggacatcagaggaaaaccaaagcctctgactccgttacaaatacagcttcctctatcgttaaatccatgctaactcctagccagataaacataaatcctcacactaaaggctcatctacctcagttcctattatctgacacgtcatgttcagcttctaaaagcagcaaacattacaggcatgctaagaaaaaaaaccagattcagatgtggtagagaatctggaattatcagacagagaactaaccaccaccatgactaatatgctgagggttctactgggaaaaagtgggcaacgtgcaagaagagatgggtaatggaagcagagagatgatgtgttagtccgttttgtgttgcttataaagaacacccgagactgggtaattcattaataaaggaggtttaggccaggcgtggtggctcacacctgtaatgccagcactttgggagaccgaggcgggcggatcatctgaggtcaggagttctagaccagctggaccaacatgatgaaaccctgtctctactaaaaacacaaaattagccgggcgtggtggcgcacgcctgtaatcccagctactcgggaggctgaggcaaaagaatcgcttgaaccctgtaggcggaggttgcagtgagccgagatcacaccattgcattccagcctgggtgacagagcaaaactgtttcaaaaaaataataataaaaataaaaaataaaggaggtttatttggctctgggttctgcgtggtaccagcatctgcttggcttctggcgagccctcaggaaacttctactcatagcagaaggcaacgtgggcacaggcatgtcacatggtgtgagagggagcaagggagtgggaggggtgccctctctgttaagcaagcagatcttatgtggactaatagagtgagaactcacttattactgcaaggagggcaccaagcctttcacgaggaatctgcccccatgacacaaatacctcccactaggcccccacctccaatagtgggggtcacatttcaacataaaattgggagggggctgatatccaaactatatcaaatagaaactcaaagattcaaaaagaaatactagaaatcaaaaacactgaaatgaagaaacaaagaatgcctttgataagttcaccagcagactggacacgaccaagggaagaatgaatgagcttgaagatacgtcaacataaacttccgaaactgaaatgcaaggagaataaagaacaaaaaatgaaacagaatatccaagaactgcgggaaaattacaaaaggtataaatagccacaatggaaataccaggagaaaaagagagaagggaacaaaaacaataaaaactgatgtaataatatgagaatcttccaaagttactggcagacaccaaaccacagacccaaaaagctcagagaacacaggacaggataaatactagaaaatctgcaccttggtatacatattcaaactgtagactagcaaaaagaaaaatctttttttttttttttttttggagacagactttcactcttgtcgtccaggctggagtgcaatggcgtgatctcggctcaccgtgacctccgcctcccgagttcaagcgattctcctgcctcagcctcccgagtagctgggattacaggcatgcaccaccacacccagctaatttcgtatttttagtagagatggggtttcaccatgttggccagactgtgtttcgaaatcctgacctcaggtgatccacctgcctcagcttcccaaagtgctgggattacaggtgtgagtcaccatgcctagccaagaaaaatcttaaaagccagaggaaaagaacaccttgcttctagaggaacaatgataagaatgacatcagacttctatttacaaaccatgcaagcaagaagagagtggagtaaaatacttaagtgttggaagaaaaaattcaccaacatagaattcttcagtaaaatcatccttcaaaagtgaagaagagataaagacattctcagacaaacaaaaactgaggggattggttaccagtaggtctgacttgggaaaagatgttaaaagaagttcttcagagacaaaaatcacataggtcggaactttggatctacataaagaaaggaacagggctgggcgcagtggctcacacctgtaattccagcacttttgggaggctgaggcgggtggatcacttgaggccaggagttagagaccagcctggccaacatggtggaactctgtctctaccaaaaatataaaaattagccgggtgtggtggcgcacacctgtaatcccagctactcgggaggctgaggcaggagaattgcttgaattcaggaggcagaggttgcagtgacccgagatcgctccactgcactccagcctgggtgacagaacaagactccatctcaaaaaaaaaaaaaaaaaaaaaaaaaaaaaagacaacattctagatatttaatgtcaccttttcagtgaggtacaatctagtcttccaatacctaaggtagtacttagtaaagatgtctcctctaaaaagtataacaaagtatacaggcctggcgcagtggctcacaccagtaatcctagcactttgggaggccaaggcaggcgaatcacaacgtcaggagttcgagaccaggctggccaacaaggtgaaaccccatccctactaaaaatacaaaaaattagctgggcctagtggtgggcacctgtaatcctagctactcaggaggctaaggcaagagaatcacttgaacctgggaggcagaggttgcagtgagccgagatcacgccgctgcactccagcctgggttacagaatgagacttcgtccccaaaaaaaaaaaaaaaaaaaaaagttagctggcatctctcctcagttgacaacctccagaagccccatctgcacccggggttaagaggtagagcccttgccaggactctcaaagccctacgcgacccagcctcatgccttctgtctgcagacctcatcctcgcctgcccctcagccacactggcttacatgtgtgacccaagcccactaaagcctcagggcctttgcacttgccagctcccactagaatgttctccccagacacctgcctgatgagttccccgcagtgcacgtccctgaccaccctacctaaaacagctgcatcccaccccttctatcactcagtggccccttgccttattactacctggatattagacttgtttatctgtccaccccactagaatgttagttccctgatggcagggacttctgtttcattgatttatccccagcaactagaacaatgcctacgagacaggagatgttcatttaaatgagcacactgggccaggtgcggtggctcacacctataatcccagcactttgggaggccgaggcaggcggatcacctgaggtcaggagttcaagaccagcctggccaacttggtgaaacctcacctctactaaaaatacaaaaaattagctgggcgtggtggtgggcgcctgtaatcccagttactcaggatgtcgaggcaggagaatcacttcaacctgggaggtggaggttacagtgagctgaggtcatggcactgcactccagcctgggcaacagaggaagactctgtctcaaaataaataaataaataaatataaaataaatgagcacactggtatttaaatatcaaagaaaaactactgcaatttcttgattattagacatttggttttatgtcattttcagaataccaagggataactaccccgcccaccctccccaaactaagggacaattttccccacgaaccaagaagaaacaaaccctgtacccaatcccagtactccagtcttcatcttcctccctggctcacggctccacgatggtgccaaggctcatgtgtggaatgttacattttaaaaagcggtgcacaaagtctataggcacagggtttaattatgtaaaaagaggcatttaaaaataataaagttagaaattgagtttgatgtttattaggttcatttctcagtaaaggtatacatttaaaaaacacataaagtatattttaattcccattttaaaatgaaagtacatttctaaacttcccgggggactcataagctattttaaaatgttaatatgaaatgagaaattaggcagaagaataaacatggcctaagattaaaatgtttaatcaaataagaagaaaaagagagatcttagtaggtaacaaatttctatagttataaaaatggaagctactaacagccctgccttcgagtttaaatgcctgagtcacacagatcagcatcagtgcacccaagagttataggaacaggcttactctggagtctaaaagtccagcttcattgtaaagagctcaccatttaatatgcctcttcagtcacctagtaatttttattttacctttgaactcatacttctaaaatattagtcagtttttttttaataactcaaaaccttttagtcctaataataccaattcttatttcaatttgaaacaagaacatacaaacccagaatctgcagcctggcacacaaaataacgaggctcattaaggggtttttgtttttttgagacagagtcttgctccgtcacccaggctggagtgcagtggcacgacctcggctcactgcaacctctgcctcctaggttcgagcaattctgtctcagccttccgagtagctgggactgactataggtgccccccaccacgcccagctactttttgtatttttagtagagatgtggtttcaccatattggtcaggctggtctcgaactcctgacctcaggtgatccgcccgcctcggcctcccaaagtgctgggattacaggcgtgagccaccttgcctggccaagtttttaaaaatttatccctggctgggcgtggtggctcacgcctgtaatcccagcactttgggaggccgaggcaggtggatcacgagatcaggagatcgagaccatcctggctaacatggtgaaatcccgtgtttctctactaaaaatacaaaaaagtagccgggcgtggtggcgggtgcctgtagtctcagccactcagaagtctgaggcaggagaatggtgtgaacccgggaggcggagctggcagtgagccgagatgacgccactgcactccagcctgggtgacagagcaagactccatctcaaaaaaaaaaaaaaaaaaaaaaaaaaatttatctcccatgatcctctccatgagccctaaatcccaggtcaatggaaatatcccatcccttctctctgttcccttctccagaaaagatcaccctttccacttccaacgctgaccatggggatattacatatcataccctgacactcagtttccctccacccccacataggtgggatcatctcttcctatgaaatcctataggctttgtaccattttactctagcattccatcctgtattaaaactatgagtataaatgcacacgtgtgtgtgtatatatttcatcatctcctttactgcgttgcaggtatcttgaaggtggggaccaagtcttattaatgctgtaaataaggaccttgatttcaagaaagcccagataaatctgattcattggattagagcccaatactcttatctgatacactcattcagtcaatcaacaaacatttctaagctcatccttaactatatccgattctcacatccttgcctcaccagaaatttataactgaggcaggcagcagtggcacaggggtggtaactgctgccagctcccccgctgggactcctctccggcagatgcccctgaaggaccaccgggacaccttccctcagcttcagtcccattcttgagacactgcagcggcacagccgttcacagttcctgtccaggttttacagaagggcttgtcccaaggccattttttatactgaaccaaattctggcttcctggatcctccttcaaccagactgaaggaatgatagacagggggtctaaatcctccttaaaaagggaaatcatgtcctttgcagtagcatggatgcagctggaggccagtatcctaagtgaattaacgcaggaacagaaatccaaataccgcatatctcacttataagtgggacctccacattgggtactcgtggacataaagatgggaacaacagacactggggactatgagggggggtgggagagaggggaataagggttaaaaaagtaactattgtgtgctatgctcaccacctgggtgacaggatcagtcatactccaaaccttggcatcacatgatatacccaggtaacaaacccacacatgcaccccccgagtcaaaatataagttgaaagtaaaataaataaatgcataaataggccaggcgtggtgactcacgcctgtaatcccagcactttgggaggccgagacaggcgaatcacttgaggtcaggagttcgagaccagcctggccaacatggtgaaaaacgctgtctctactaaaaatacaaaaattagctgggtgtggtggcggatggctgtagttccagctacttgggaggctgaggcaggagaatcgcctgaacccagaaggcagagcttgcagtgagcagagattgcaccactgcactccagcctgggcaacacagcgagactttgtctcaaaaaaataaaataaaataaatgcataaatatatcattctcttacatgcccagtcttccagtttttgaagactgctttcatgatttgctccctgcataggcatccaacatttaagggtcgcccttaagaaagagaatacaaaactacaaattgaaaatgaagtgccctacaaggttttagaaggggtggagagactggaaaggcctaaggttgagtgccgtgagttttgtggtgaatatttcactatccatggaatcaaggactttgaatttaaaccccagctttgctccttacctgttgtgtgtactccttagctggatgaaattagacaagtcactcaacctaagcttccattttcttgtccataaaatgggaataatctctcttacctgagaggactgctgtgaaaactaaatgagactcctgaatttcgtatttccattaatgctaataaaattcatttactgtgcaaagcgcactgagtcagggccaactaaaactcttcacggggtcacggcgaggttacgaggcagcgcacgtgggaagtgctggaaagtgtgtggcacattgtctgaaagatctctgaccaaccaggacccaattctggttttcagataccattttttttttttttttgaaagagtctcactctgttgcccaggctggagtggaatggtgcaatcttggctcactgaaacctccgcctcctgggttcaagcaattctcctgcctcagtctcccgagtagctgagattacaggcgtgtgccatcacgctcagctaatttttgtatttttagtagagacggggctttgccatttgtccacaatggtcttgaactcctgatctcaagtgatccacccaccttggcctcagataccttcttgtgtgaacagttgaggagaataaggcagcaatcagatgttaatggcattgctgccagactgcctgaatattccagagtgccagaaaacactggtcaaataactgctactcctacaggtttcatagttgggtatgtggccgggcgcggtggctcacgcctgtaatcccagcactttgggaggctgagaagggtggatcacaaggtcaggagttcgagaccagcctggccaacatggtgaaaccccatctctaataaaaagatacaaaaattagctgggcttggtgacgtgcacctgtaatcccagctactcaggaggctaaggtgggagaattgcttgaacccaggaggtggaggttgcagtgagccgagatcacgccactgcactccagcctgggtgacagagcaagactccatctccaaacaaacaaacaaacaaatatgtacagctagcctcttgagttattacaatgcctattttactgattttagtatgaattcattaggataccccatattggcatacttaactctttttagtggtataatatacaaaagtttaccaagggtaacattagtacattcacaatattgtgcaaccatcaccactacccagttcacaatcatcttcgttaccttaagagatgccgttaggcggggcatggtggctcacgcttgtaatcccagcactttgggaggccgaggcgggtggatcacgaggtcaggagatcgagaccacggtgaaaacccgtctctactaaaaatacaaaaaaaattagccgggcgcggtggcgggcgcctgtggtcccagctactcagaaggctgaggcaggagaatggcgtgaacctgggaggcggagcttgcagtgagccgagattgcgccactgcactccagcctgggccacagagcaagactccgtcttaaaaaaaaaaaaaaaaaaagacatgccgttaagcagccattccccattcccctttctcgcatgaagcctcaaaatctgccttctcccttgaagcctcaaaatctgctttctatgtggatttgctgatgctgggcatttcatataaacaaaatcatacaataaatagcctttttatctggcttctttgacgtggcacataaccaaggttcacccgtattgcagcatatagcggtacttcattctttttcgtgggtaaataatattccattttgtttttccacttatcagcaggtggacatctgggctgcctccaccttttggctattgtgagttgtgctgctctgaacatttgtggtcaagactatgtgtgggtcaggtgtggtggctcatgcctttaatcccagcactttgggaggctgaggtgggcggatcacctgaggtcaggagtgtgagaccagcctgaccaacatggagaaacaccgtctctactaaaaatacaaaattagctgagtgtggtagcgcatgcctataattccagctacttgggaggctgaggcaggagaatcgcttgaacccaggaggcagaggttgaggtgaggtgagactgtaccattgcactccagcctggccaacagagcaagactctgtctttaaaaaaaaaaaaaaaaaaagactttgtgtgggcatatgtttcatttcccttgggttggtgtctagaatggaatccttggtcatacggtaattctatgcttgagttttaaggaactggcagacagctccaatgtggctgctccattttacatgcccaccagcaatggtcaagggttccaatttctctgcatctttgccaacacttgttattgtctgactttttaattgtggccactctattgggtgtgctgtagctatcttgtggtttggatttgtgtttccctaatggctaatgatgttgcgcatcttttcatgtgcttgttggcactcttacttttaacagttttgttaagtcactcggaagaggaaagagtacatagggaagtgcatttactcccaagttgctaaagaccaaaaaacttctagaaccccacctgcactaacgaagactctaaccccccaccagaactgtctaccctccaccgtggcaccatggtgtgcccgggaatgcggctggcgtggccaggcctcactcgcttcatgattctagccgcatccatctttgagtatccctctcttcagcctgtcacgggagctacgccctttgctgctacctgtgcgtgtgaccgcagcagctctttcttggcatgctctcaaccccactccccaatttgggtgtcataacctagtgttttcgttcctgacccttcactgcaggcccagcatggtgctgtgaaaaagttagaaatccacacctatttgtaagaggatgtaagtagcgcttgtgaacaaggatggtgatgatggcagaggcacagccccaggtcctttgcgccaccccccctcgccatgacaggccaattatccggcccagttgttgcagctccttggccagcggtcctttggctgtggctgacagcgtgaggacagggacacttacgctgtctccatcttgagttactaggacacacaatatacttcaaggagaaaaagaccaatttgagtaactgtgaaaactgggtttaaacaattttctgttcaaacacttaaaaatccaaagatttaagagaacgggcaaacataataaagttacaatgaaaaacaggaaatgacgtttcaggttgacacttaggatgtgcccagtgagcaatctggaagcatgaagtgtgaaatggctaatctgattcaatgattcagcttctacataagtaatatttatttctttatttttttgagacagagtcttgccttgtcgcccaggctggaatgcagtggcccaatctcggctcactgcaagctctgcctcccgggttcacgccattctcttgcctcagcctcctgagtagctgggactacaggcgcccgccaccactcccggctaattttttgtatatttagtagagacggggtttcactgtgttagccaggatggtctcgatctcctggcctcgtgatccacccgcctcggcctcccaaagtgctgtgattacaggcatgagccaccacgcccggctatgtaagtaatatttactaattatagtacattgagtatatatatactcacttcaaagctgagagaaggaatgttcttcttgtaacaacttttgtaaacaagtacaatttataacacagaacatcttcctaaactttaggaatgtacacatacttacaccaatgcgcctacacgacacatggacttccacagtacatgctcttacaggtttttttttttttttgcaggggacagagtttcactctgtcactcaggctggagagcaatggtgtgacctcagctcacctccgcctcctgggttcaagcgattctcctgcctcagcctcccgagtagctgggattacaggtgcctgccaccaggcccagctaattggttttttttttttttttgtctcttacaggttttataaattataaccctacctttctaattattctagctgagacctttcctgttccaaaagggagaagaaagaacatccacccaaaaattgagatgagaaaagccaccttcaaggtctaaaggcatttatcatgtgcttgcttccaggaaaaaaattattttccaaaccccaaactgaaaatactcaagaaaaaaagctggaataatgatcgcattataaatgcttctaagtaaaaccagcaaaattgtgattacagctgagaaaaatccaacaaaatacagactcatactcacatggttagtcagcatggaccatatgatggtttgcaatttaacacaatcctttattttgctgaactctaattggcaggaaaatctgacagccataaagtaaagccgttagaaaagcacagtccaggtgcagtggctcatgtctgtaatcttagcactctgggaggctgaggtgggaggactgcttcagcccaggagttcgagaccagcctgggcaacacagaaagacccccatctctaaaaaaaattttttattttttaaaaaagcacatcttttggacatatagaaaattaagttggcagactaggtcatatacctggtaggtagcctggggtccaatgaaccagccactgaccagatacgcgacctcagcaagttactgcctttgtacctcagtctcctcatctataaaacggaaataacaagcatgggcctcacagtgctgtcatgatgattataggagttaatattacatttataatgtgcttagaactgtgcctggcatatagcaggtacagtgttcagtaaataaaatctcctcttgtttctttgctatttttgtggaagaattttaatctctttaaagtgagtctaacctgtaactaaaagataagtgattttggtcaattataactgctgtggctcagctcagctctttccctactgtggtatgaattcttttatccagatcttaggaatatatttgtaatattgttgtgaattagtaacatttcaaaaatgtttcagaaatttttttctgatttttttttttttttttttttttttataaagacagagtcttgctctgtcatccaggctggagtgcagtggtgtaatcatggctcactgcaacctccgcctcccaggttcaaatgattctcatgcctcagcctcccaagtagctgggattacaggtgtacgccaccatgcccagctaacttttgtatttttagtagagatggggttttgccatgttggcctagctggtctcaaactcctggcctcaggtccacccacctcggcctcccaaagtgctaggattacaggtgtgagccactgcacccaggctgagccaccgttcctggcttctgctctaatttttagaccaaagactgtcagattggattctgagtatcagcaagacaaatctataatgtagtttttaaaaattgcatgatccataagcattctatcaatgattaaaggaaatctatgattttctaggttccctgatagtgaggagataaaatattctgttttgtgcccaatttcagaaactggcccaaacaataaatgattcaaaatgcaatggctgactaaactacaacaaaataacatagcctaaatttacataatggtgagctctaaaaagctcaaagcaaatttataaactccccaaagaaagtcttatttcctgagaagtcaatgagaacatcctttatttttctctgctttaaggatgaaaaaactgactcaaaggttcttctaaagattttggcaaaacattttccccttaccatttctgttttccctttcaccttttcaatattttctgagttataaaaataaaccttgcttgatttaggaacaaaactggaagtttatgaaaatgtcagattccttttttaaatgggcactgctgggtagctgtgctgccttgaactgaactgtgtacaggtaatgaaggattaacctttatcacgtgtgataaaggatttaactttatcacacgtgataaagtcacatgagtgactttaggtacacccactgacaatctgttgagtggcatgaatttgaccccatgacctattatttaacaattaaacagtgggagcggccaggcgcagtagctcacgcctgtaatcctagcactttgggaggctgaggtgggtggaacacttgaggtcaggagttcgagaccagcctggccaacatggtgaaaccctgtctctactggaaaaaaaaaatacacacacacacacacacacacacacacacacacacacagacacacacacacactagctgggtgtggtggcaggcgccagtagtcccagctacttgggaggctgacgtgggagaattgcttgagcccaggaggtggagcttgcagtgagccaagatcacgccactgcactccagcctgggcaacagagccagactctgtctcaaaataaataaataaataaaaataaacagttggattaaaatatgttactggccaaaccctgactactgatctctggatttgggttgacggtttgtttgctctgcccaacaagacgaagaggttaggacttgagtatcccatgctactgtggttgttaggattatgtcgttaatgcaccttaaatccagacacttagctagctggtagtaaagaagtgctttttctttggagaaaaggataccaaatccctcacaagattatcccaattgaagcaagcaactgtatgacacaagagatcttctactgtctgggtaagggccaaattgcaaaaactttaggccttgtgggccaaacgtctctgctgcagccactcagccctgctactgtatcctgaatgtaaccccagacaggaacaaatgggcacagctgtgttccaataaaactttcctggccggcacaaaggctcacgcctgtaatcccagcactttgggaggccgaggcggacggatcatgaggtcaagagatcgagaccatcctggccaatatggtgaaaccccatctctactaaaaatacaaaaaaatcagctgggtgtggtgggtacctgtagtcccagctatagggaggctgaggcaagagaatcacttgaacccggtaggtggaggttgcagtgagctgagatcgcgccactggcactccagcctgacgacagagcaagactccgttccaaaaaacaaacaaacaactttctttacaagcaggccctggtcatccctggctgtagtttgctcacccctgcagttaaggtacatctggtaaaggtgatattttagcaaaatgaaattgaaaggtttcaaattatatgttaactcttatcttcaagtcattgagaacattcagcatgaaaacaactagaatttggtatttctctttaaatcatcaatatttttctatcactttcaaatatacttgaagaaagagcaaggacacattttctgaatcatctatctaatagaatagattctattcataaaggaccttttattttaaggaggaaaatcaagaaatgagttctctggtgggggtaaaatgtaggtctgacagatttgccgatcatttaaatccatcattatttcctaaattttagatactaacttgcaaattttgcatatgtatattaaagtgtatcttcttcctaagaagtaggctgggcgttgtggctcacgcctgtaatccagcactttgggaggccgaggtgggcggatcacctgaggtcaggagtttgagaccagcctgaccaacatggtgaaaccccgtctctactaaaaatgcaaaaaattagccaggcgtggtggcacatgcctgtaatcccagctacttgggaggctgaggcaggagaatcacttgaactcgggaggcggaggttgcagtgagctgagatcgcgccattgtactccagcctaggcaacaagagcgaaactctgtctcaaaaaaagaaaaacaagtgaactatattatttttcagagactcagagaggctctcccattgcttggcatttctacttttcatttcctggtgatttccaatggcaaaacttttacatcttccatgaggctgaggcaggagggctgcttgagcccaggagttcaagaccagcctaggcaacatagcgagaccctgtctttaaagacacaaaaaaatttacatccgcaataaagaggacaaccagcctaacatggaagagaacaataagaggacttgacaaaacccttacagaaagaatccttcatgaacggccatcaagagatacaataaaaacacctagcagaatttgactctcaagaacttcaagcaacggaactgctttataaatgacaaaagtcaatttgcaaactcaataataaaaaaaaacataatttaaaatgggcaaaggatctgaacagacatttctccaaagaagatatgcaaatggtcagtaagaacatgaaaagatggctgggcacggtggctcacgcctgtaatcccagcactctgggaggccgaggcgggtggatcacctgaggtaaggagtttgagacgagcctgaccagtatcgtgaaaccccatctttactaaaaatacaaaaattagctgggtgtggtgggggggtactgtagtcccagctactcgggaggctgagggacgagaatcgcttcaacctgggaggcagagattgcagtgagccgagatcgcaccactgcactccagcctaaaagtcaatttgcaaactcaataattaaaaaaaattaatttaaaatggtcaaaggatctgaatatacatttctccaaagaagatatgcaaatggctagtaagaacatgaaaagatgctcaatgtcgttagtcactagggagatgtgaacgaaagccaaaatgagagcccacttcacactacaggatgtgtaaaatcatttataggatggctatactaaaaaaaaaaaagagacaataacaagtgttaaagatgtacagcaaatgaatggttggatacggttggagttaaatgggaagcaactgctaatgggtgagggtttctttttgcggtgatgaaaatatcctaaagttaattgtggtgataatcacacaactttgtgaatatactaaaaaccagtgaactgtatactttaaatgggtaaactgtatctcaagctgctataaaaataaatacaacaaaaaattaatttgcagatttcagaaaagaactaaataggacttccagtaacgaaagacaggcactaaacaattcaatggaaccagcagttaggaaataaaaatttaaaaataccatttacaataggacaaaacacataaagaatgagtctataaaaaaggaggagacttccacaataaaaaatacaaagtagtgctacagaaacgaaagaaatctcaaataaatgaaagcatctaccattttcatggattagaaaatccaatattgctaagatgtcaactccacctaaatccacccgtaaattcaatgtattccaatcaaaattccaagtgaattttttaaagtggaaattgacaagctgattctaagatataaacaaatgcagaggtcctagaatatccaaggtactctcaaataaacacaaagctagaggacttatgcgactagataccaagattagacagttgcagtaattaagacagtctgctattggtgcaaggacagcagagcatccccacagacagccgagtgtgtagctgcgttgcctccttgtctcccagtgataacccaggcgatgttacaaaaatgagtaactacaagagaaactgctaacaaaactgaagacacagaaatgaaatgggaaaagtagcaacactgagtcaaacgtagatggaattagagaagaaacagctgactggaaatgctgacactgttggcctttgtggcactggatgaacggccacaggaactgagtgaggccaaaacttaccaacataattgagccaagtggctgtgatgaaaaggatgaagatgtttcagggaaagcgatgccagcaaaacaacaacaacaacaacaacaacaacaaaacaaaacaaaacttcaccttaaaggaactcttgaagatacttcacaacattgtaattgcaaggatgaaatgttggaagctgatccaaatttggcaaggagtatggcaatttgctaaagcatagaaaagatgctcgccctatcctaagccatgagaaggtggtaagccctatttacaccactcctggtaggatttttacaaataaaaactctaattcccaatgtttctaatgctttaaagtgtacaaatattagttttactattttttaatttccctatacatttataactgacagtgagtgcgtttttaacaaacatttttaaaggtcatagaacaacgtaattttgcagtatcaaaatgactttgtgtggtttcagcttgcacatttttatgatgccattaccatgcaaaacagggctgcctgtttttaaaattagtgagttaaatgtaccacttaagaaattagaaaggccaggcgcagtggctcacgcctgtaatcccagcactttgggaggccgaggtgggtggatcaagaggtcaggagatcgagaccatcctggctaacatggtgaaaacccgcctctactaaaaatacaaaaaattagccgggcgccgtggcaggcgcctgtagtcccagctactcgggaggctgaggcaggagaatggtgtgaacccgggaagcggagcgtgcagtgagccaagatcgcgccactgcactctgtctgcccgggcgacagagcgaaacaatgtctcaaaaaaaaaaagaaattagaaaaagagcagccataagaaaggatgagttcatgtcctttgcagggacatggatgaagctggaaaccatcattctcaggaaactaacacagaacagaaaaccaaacaccgcatgttctcactcctaagtaggagctgaacaatgagaacatggacatagggaggggaacatcacacaccggggcctgttgtggggtgggaggctagggaagggatagcattaggagaaatatctaatgtagatgaccggttaatgggtacagcaaaccaccaaggcacgtgtatatctatgtaacaaacctgcacgttcttcacatgtatcccagaacttaaagtataataaaaaaaagaaatgagaaaaagaataaaagagtcatttcaaagatacatgaaagagagtaaaggagagaccaatgaaatagaaaacaaagacacaatggagagacttgaacaactggttcatgaataatcaagaaaaatatatattctggccaggcgcagtggctcacatctgtaatcccagcactttgggaggctgaggtggcctgatcacttgaggtcaagagttcaagaccagcctgggcaacatgacaaaaccccatctctactaaaaatacaaaacttagccgggcatggtggtgggcacctataaccccagctactcaggaggatgcatcacgagaatcgcttgaacccgggaagcagaggttgcagtgagccgagattgcaccactgcacttcagcctgggcaacagagtgagactctgcctccacaaaaaaaaaaaaaaaaagaaagaaagaaaagaaaaatgttatatattcttttattacttactttatgagaagaatgtcaatgaagaaaattgtcactgtttttaaattctgaaatatttgcgaatgtgtgaagtagaaagagagaggcatccttctagtctttgatacagaagccacaaggcacatcatctcatttcatctaatgacctggaaggcgtggctgtcacctccatggtgagtaaataacccactgccgaaggtgaagtgttgcccggggtcacacaagttaacagcaggaatgtggcaacgtcaccactcccgagcatctcttaggtgccaggtggcatgctatccagcagtctcaggggaaagtgagatgtggcctggccttactgtcctgggtcaaaggatctttcccggactcgcctgggcggggtgagctctgcaacccaggcagcacccatgtccctaccatccctggaggggtaaccacccccacagtccatgctctgcctagcttggctgcaaaaccccttgctggggacatgtgacccaatgtggttgcccatggaggttatctcttaggcccatgtagaaaaaggtgacagctacgtttacccttagggcctatcagccaccctgaggaaaaacactgcactctgcaacccctgaggaagaagtcacccaggaggctactgaggatgaaatgagacaacagaagtgcccggcacgcggtggacacatccggagacccgtgtttctgtatggaagcacgtggcgcaagggcagggaaatacttctaagacggcacaagagcggagcaatacttctaagaagagccacgcccacgctacgcctctgtgatttccactatccttaccccgtaactcctggcgtttatggttggaaccccagtgaaaccaccatttccaaggggactgtgaccgctaatcatgacacctgccagccattcagacactaacgataacctctcatccccttcttgaaaagtcccctgtcagcctgggtgcagtggttcacacctgtaatcccagcactttgggaggccgaggcaggtggattaccttaagtcaggagttcaagactagcctggccagcatggtgaaaccccatctctactacaaaaaaaaaaaatacggccggggatggtggctcacgcctgtaatcccagcactttgggaggccgatgggaagtttttgtttgtttgtttgttttctgacatggagtctcacctcagggcggatcacctgaggttgggagttcgagaccagcctgaccaacatggagaaaccccatctctactgaaagtacaaaaattagccaggcatggtggcgcatgcctgtaatcccagctactcgggagactaaggcaggagaatcgccaggcatggtggtgtatgcatatgtcccatctacaagggaggctgaggtaggaggatggcttgagcccagaagatcgaggctgcaatgagccatgatggcacagcccgggtttcaaggtaagaccctgcctcaaaaaggggggaaaaaaaaaaagaacatactgactggaaaacaaggctagaaagaaagacaaggatgataaagcgtctgccttagagtgctcacatctcgggtgatggtttttaattttctctattccccctgttttcaaccacgagtcagtggctgctgaccagaccattcaggtaccttggcagcgagaaagatgagcaggggaaatgcaccagagtccatggttacaagatatccaaaggcttaaaaaaaaaaacaaaacagcagaaggctgggcacagtggctcatgcctgtaatcccagcactttgggaggctgaggcgggcagatcacgaggtcaagagattgagaccagcctggcaaacatggtgaaacaataccgctcctactaaaaatacaaaaattagctgggcgtggtggtgtgcacctgtagtcgcagctactcaggaggctgaggcaggagaattgcttgaagccgggacacagaggttgcagtgagtcaagatcgcgccactgcactccagcctgggcgacagagcgagacttcgtctcaagaacaaaaacaaaaataaaaaaacaaaaccagcagaaaaaacctacagctaccctaaggccccctaccccacagcccctatttcttcctctgtgcttagatctccccttcccaaatagaaacagactggaaaggatggctgtggtcttctgggggaaaaaagtgggagggccctggaaaaacagcaattatgaagtttttgtttgtttttttttgagatggagtctcactctgttgcccaggctggactgtagtggagcgatcttggctcactgcaaactctgcctcccgggttcaagtgattctcctgtatcagcctctcaagtagctggaattacaggcatgcgccaccatgcctggctaattttttggtattttttttagtacagacaggtttcaccatgttggccaggctaggctcgaactcctgacctcgggtgatccgcccgccttggccttccaaagtgctgggattacaggcctgagccactgtacccggccacaattatgaagtctgaagtatatgcatgctggtaaaaccacacaccagcccacgagggagaaaaacatcactccactcagacacacaaaaaacgcggaagcaccatgtacacccagagcaccgctaacatttctatcagtcctgccctttcactgaaagttgttgaaaacagacctttaataccagagatgccgacgtgggggctgtcaccaggccatctcctaacagccacatcctctctgacctggtgttccttggctcatgcctggggagctttgctagcagctgggtcctgggagtgtgatctaaattgggccgtggggtataaggggctgtgtgctggagctttggggcaaaggttgtcagcacacctgagaagaaattccccttcctgcctttggagacaatggggagagagaggatgtgatggttggagaggcagtggcagccatcctggcaccatgaggaaatgagtatgaggatgagaagacagagagaaggaacctgggtccctagtgatgataaactgacaacctgctgctcctcatgtggaataataaagatgctgattgcttaactcactgttcattgggtattttattttttacttttaggcaaaagcatcctacattattcacacagcagtgagtgagccgatgccaggagagagctaagtgtaagtatccactgctagacatcagaaatggcaccgctgtcacagaggccgaccctcgaggcgcacagaatgaacgttttgaaatgattcatgattttcatgtatgtgataacaccccttcgagttttctcatatgagagttataaagtttcatgatgaagttgtgaataccaaataccaaaacggagtaactagacaataaaatcttcttggaagatgagaaaaatacaatctatctttggtctttttttttttctatgaattgtccatgactcttccatacagggaatttaaacagatacggggtgcctttttagtctgaactgtatcaataaaagaaaaatggagccagtcaaggaagtaactcctcctgagatagcattgtaccatggaattgttcgaaacgagaagaaaaaccagtaactacatgagatagcaagtattaagcaaaaggacagcttgaaactaaataaaacagaaagttatttctgttccctctgaataaaatacatacgcacaagtggctgggcacggtggcacacacctgtaatcctagcattttgagaggcgtaggcgggtgggtcacccgaggtcaggagtttgagaccagcctggccaagatggtgaaaccatgtgtctactaaaaatatgaaaattagccgggtatggtggtgggcacctgtaatcccagttgctcagaaggctgaggcatgagaattgcttgaaccctggaggcagaggctgcagggagccaagatcacgccactgcactccagcctaggtgatggagtgaggttccgtctcaaaaaaacaaaaacaaaaaataccccatagatatatacatgcacatgaaagaaatttcaccatcacaaaatactttcctcactgaaatgaaagttctaagcctgtgttgtttataccaacatcgttgctgtggaaatagctgtttcaacattaggaactcacgactgactcaagtaaggtgtggagcagaagtcttatttaaacagtggcaggacccataaaacattaaaaaggcaaactgggtgtggtgagtcagagcaccatatgttttaatgtaagggtcacacatgttttctttctgatgcatgacaccaataggatgtttctttttattcatgctatttttggaaccctataatcatctcaacgactcccccaaatatcctaggttttgctgtctgcttctgtctacatccggcagcctccgtattttattaaattcattgtgcttagaacagagttactacagttcagtcctcgctggcacatgcaggattatggcaccaaccagggcacaagcaggattttggaaaacttctgcatgtaactgagtctattaaatatagcagtactgggctgggtgaggccagtcatcctagcactttgagaggccaaggcagggggaatcctagaggccaagagttcaagaccaacctggccaacacagagagaccccctaaaatatatataaatatataaatatatttatatatttatatatatacacatatatttatattatgtatattataaatatacataatatatatattataaatatatttatattatatataaatatatatacatacatatttatattataaatatacatatttacattataaatacacatatatttatattataaatacacatatatttataaatatacatatatttatattataaatatatgtatattaatattataaatacatatatatttatatatgtatattatatgtatatttataatatacatatatttatatatgtatattatatatatttttatatatataaataatattatggctgggcgcggtggctcacacctgtaatctcagtactttggtaggctgaggcaggaggatcacctgaggtcaggagttcgagatcagcctggccaacatggcgaaaccccgtctctactaaaaatacaaaaaaattagccaggcgtggtggcgggcatctgtagtctcagctacttaggaggctgaggcaggagaattgcttgaacctgggcagcagaggttgcagtgagccgagatcgtgccactgcactccagcctgggtgacagagcaagactctgtctcaataaaataaaataaaataaaataaaataaaataaaataaaataaaaaattaaaaaatacatagatcgctttctcgcagtactgacttattcactaacaaggcatcacttccagcatatggtctaccgtgtgcctatggctttatacggagactgtgaggacccagatcgcctctgcacccaacagcccagctcctcaactccactgtcaggcctctcatttgtccctgtcttttatgggtcagttaagagcttcccaaacaatcctaaaaaccctcaggccaaccccatcgagaaaccatgtgacttgcccgcaccttcccttggtgatgcccccactcctctgcttccccttcctacttcttaactggacatggatgcacttttctttaaatacgcacacactttaccatgattttcctccggttaagccagaaattttaccctttgtacaataaaacatattcaacaagttttttaaatgagagtgctgtgtggggccgttttaaaagcccacctttccctaacccccgacagtgaagtgttctataaacagaagcccagatcccctcggcagcgggcactgcccagggtgtaaccgccctctctgcctgcacaggagagcgattcataccagcagaaccggaaaaatcacagctgaaagcaaccagggaagaggcaagggccaagagagcaatgtaaaggagtcggattttctactaggtgagtcacaggaaacactctggccacagcccgaggccccaggaggcccggctcgcccatcaggaatgtaggtcaaactcccagcgggaagggtgagagcccaggcacccagggcaaaagctcaagttcctaggagaacagggaggctggccagaaaacaaggcctccactcgccctccggcaccagtcccagcccaccctacgactaagcatcaatttccacagaccgcggtgaagtagaaccacagcatgctggcccagatctctcctctgttctggactgggccatcccacgcgtttctcttggggttcacaggatgacaagtggggtttatgtataaagggacagatcgctcacccagttcagttgacacgggggacccagtggcaatctcaccgatcttggccactccatcgtagtaggcttttcctgccaggatcatagctagacacaaaaggtgacacacaaaatcgtcacttagacaaggaaaggaggaagcaacacaagttttcttccaaacaccccctggtcccttctggctgcaggaaggtttgggctgtggcaggtgtggctctcaggaggtaagacctgtgttgagagtggtgccggggtggaggccctccagccaagggacagccccatgagatcctcgtctctgaccagccccggggaaccttcagcagcaggtgctgaaagtccagagaaggctcagcttgctcctgatgccagtttcagagtggatgcgttcctaacgttgaactagggctttgcctgggcacggtggctcacacctgtaatcccagccctttgggaggctgaggtgggaggagtttgagaccagcctgggcaacatggtaaaaccccgcctctacaaaaaaaaaaaaaaatacataaattagccaggcatggtggagtgtgcctgcagtcccagctacttgggaggctgaggtgagaggatcgcttgagcccaggaggcggaggttgcaagtgagccgagatcatgacactgcattctactctgggtgacacagccagatattgtctcaaaaataaatataaaaaaagaagatacatcctctccagccagaaatcttttctgagctagttcttctccagcactccaggtctgcaacattcttagttaggagttgtgtgaggtggactaggagcctggtcctttgatggcagtgcttaatttttctattgaaaaaggcattttgagccacaaccaaccaacctatttgttgccaggagagaatatatgaaatttgaaatatattatcattccaaaaagcaacacaattgtctgaaaaaataactgaatgctctactttttcttttttggcaaagacaagaaaacttttattgctacaaggtgggttctaattatcttaaaaatagtactgcccccttcgaactgattctgaagactaaattataactatgtaacctccaggggcaaattacttaccctttctgaaacaaaggttgctcatccttaaaatgccctaagaatgtgagtgacagatgaacaaatggaagctgctaatacacttttttcactttacaatctaggtttgagggtattgaagatgtatgatagagacccagcctggttagtgtaattttggagaaaagcatttatttggaattttactctaagattggtttcagacatagaaatcagtttctcctggagctttggagaccacacagttttggagctaaaagagccctcgggaatcccagaggctataccagctgcaatgccgcaatgtataatgggcaattgttttaacaaggtggattttattttattttatttttttagaggcagagtcttgttctttcacccaggctggagtgcagtggcaagatcatggctcactgcagccttgacctcctgggctcaaaggatccttctgcctcagcctcccaagtagctgggactacaggcacgtgccaccattcctggctaattaaaaaaaaaaaaaaaaaaaaaattgaaggggctgggtgcagtggcttacacctgtactcctagcattttgcgaggctgaggtaggaggatcacttgagcccaagagtttgagaccagcctgggcaacataaggagacccccccatatctctactgaaaacaaacaaaaaaaactagccaggcatggtggtggtggcacacgcctatagtagtcccagctactcaggaagctaaggtgggagaattgcgtgagcccagaaggtcaagactgcagtgaaccacaactgtaccactgtactccagcgtgggcaagagtgaggcccctgtctcaaaaaaaaaaaaaaaaaaaaaaaaaaatatatatatatatatatatatatatatatttttttttttttttttttaagagtaggggtctcactctgttgcccaggctggtcttgaactcctgggttcaagggatcctcttgcctgagtcacccaaagtgtttggattatagttgtgagccacagaattaattcatgtgcaggtccagctgaaggtatgaaaagccaaaacagtagtatattttttctggcacattaatctactttaggatttattgtagagttaaaaatttatagccaggtgctgtggctcacacctgtgatcccagtactttgggaggctgaggcaggaggatcacgaggtcaagagattaagaccgtcctggccaacatggtgaaatcccgtctccactaaaaatacaaaaattagccgggcatggtggcacatgcttgtaatcccagctattcgggaggctgaggcaggagaatcgcttgaactcgggaggcagaggttacagtgagctgagattgcgccactgcactccagcctggcgacaaagtgagactcagtctcaaaaaaaaaaaaaaaaagtacatatatatttatatatatataaaagttatggtttttaccatatacatatccaactttaggaaatgcaatattctatctactgcactattataagactcagaacaaccttaaagtgtaaatgtaaaaagaacaatagcaattagcatttatatacatacttagttaatctatccaattatgttgagacacagtccgtaatgtcatcagcccgttgcgctaagggcagcggagtggagatattctgggacatacccaaggtcaatgttgagtcagcgggaaggcacacagctctggctgggcacttcacttcctcagctctaaattatggtgctttctgattctttggtctcgtctagaactaagaaagaagtgactccacctaaaaacaaggtgtgtagccaggaaactgtcaagttgtaagatggaacatcttagtatgaagatgttaagttgtaaagtactgatcatctgaaaagcaaattagtgcgggaatggaatgcaggattacacaatatttaagcaaaatgtttggtttgcatccacacatgaaatcacaatttttcattaattgttgacttacattgaaaaccatgtaaccttctcggtcttgtaaaatatctttgctatgatgataaagttaaattaacttgaaaattataaaatttagccagaagagataaataatactttcataattttgcctcccttttgtgagcacattaagatattttctactacttattgttttaaggaaagaagcatattagttttttgtttttttttttttaagagtcagcgtctcactctgttgcccacactggagtgcagtggtgtgatcatagctcactgcagcctccacctcctggactcaagccatcctcccacctcagcctcctgagtaactgggactacaggtgcacgccaccacacctagctaattttttattttttctagaaatagggtctcactatgttgcccaggctggtcttgaactcctgggctcaagcgatcctcccacctcagcctcccaaagtgctggcattacaggcataagccaccatacctagcatagttctattttagtggttggccaactacttcatcagtctagaccaatctatgtacttctacttgataatttttccttaaaatatggtttcattgggtgaacattctgctcaaagcctttggtgtcctcccactgcccatgaggtaaggtcacacaccccagagcccgtagtagatttttacagtaatggccttccaggaatcacacctcccggaattcccagcgtatgtggtcccctaccaggtggtgtggccatgggacctgctttgacccacgggttatcagcaagcatgactcctgcagggacttgagaggtgctgggcactggggcttatactcttaggacaccactgctactgagtgaggacagagtctggcctccttgaaggggaaagaccccattgcagggctgcatccagcccacagccccacacgggccgcagaagactgcaggtgcaggagtgagcccggagggtctggagaactgccctgccttataggagaaataagaaactgttgctattcaagtgcacagtgatctgaccctatcccgcccacgccccagcagtgtgccacccatgccagtgtggaccccaggtcctggcttacttgctgtcttttttttttttttttttgagacagagtcttgctctgtcactaggctggagtgcaatggcacgatctctgctcactgcaacctttacctcccgggttcaagtgattctcctgcctcagcctcctgagtaggtgggattacaggcacccgccaccacgcctggctaatttttgtatctttagcagagacggggtttcaccatgttggccagcctggtctcaatctcttgacctcgtgatccgcccgcttcggcctcccagtgtgctgggattacaggcgtgagccatcgcgcccggccgacttgctgtcttttatgcgtgcagtagtgtctgcctgctgaaacctaacatctggcagatagctcatctcctgcagggcctcctccctgttccaggccacaccaacccacaccactcaaattcttgtgacactggtctgtacaatgctcctagccattcacctgtagacctgggtttttttttttttttttttttttaatttttttgagacagggtcttgctctgtctcctaggctggagtgcagtggtacaatcacagctcattgcagcctcgaacttctggactcaagcaatcctcccaccccaggctcctgataggtaggaccacaggagcatgccaccatgcccagctaatttttttttttttctgaggccgagtctcactctgttgcccaggctggagtgcagtggcatgatcttggctcattgcaacctctgcctcccgggttcaagtgattctcctgcctcagcctcccacgtagttgggatcacaggcacgtgccaccactcccggctaaattttgtatttttagtagagacagggatttaccattttggccaggctggtttcgaacttctgacctcaggtgatctgcccacctcggcctcccaaattgctgagattacaggcgtgaaccaccgcgcctggcctgagctaatttttaaattttttttgtagtgacggggtctcgaattcctgggctaaagctatcctcctgtctcagactcccaaagtgctggaattacaggcacgagccaccacgcccagcctgccttgtgttctaacgtaactgtggactgcacacctggcagcctcaactatttccaaattctcaccaaggactttacacatttacctacatttctcaatggcttcagcaaaggcacaaccagatggcctgcagaaattctggaaataccttctgaagtatttactccccaggaggtgctaaagtgtcaagagccctttggggagaagccttgttagcaggaagctaagctgtaggcagctcactggctcaccttgtaaaactctgcagctcatgctagaaagaaaaaaaaaaaaagaggcagctcatgctagaaagaaaaaaaaactgcaggtcacagtgatttccttcacaaggacatctaaagcaatgactttgtggccttgtgactaagcaatcttcgagggagagtcagcagtgcacagctctggctttctggaggacaggggcacttgcagaagtcacggggaccactggagggcaagggagcaaaatcccagacctgctgcatttcctgctgctgaaatctccgaaagcacagcaaggcagaagagtaaatgagcagtatacttttccagcgactacacacaatggtgctcctcctcacccagagtccacagtctagccagctcacaccctttcctggggcaggttcatgctgagcgagagtgaggccacaggtttattttcaaaatatcaacagggagcaaccagtatggcaaaaaagataagaggctgggtgtggtggcttaagtttataatcctagcactttgggaggctgaggggagtggattacctgaggtcaggagttcgagaccagcctggccaacatggtgaaaccccatctctactaaaaatacaaaaattagctgggcatggtggtgtacacctataatcccagctacttgggaggctgaggcagaagaatcgcttgagcctgggaggcagaggttgcagtgagccgagattgttccactgcactccagcctgggcgacagagcaagactctgtctgggaaaaaaaaaaagaaagaaagaaagaaagaagagataagaagatgtaaaacttgatctgaagctgccttcaaatctgtcagaaactacatttctacttatgttacttggtgacaaaagtagagcggtgggagagggtgaaactggggtctgagtgttttggggtgatacttgctacattttggggaagaactgtcttgcccatgttagaatttggtgattgctagcgtttttaaggtgatcactgatgcattttaatcacaaagacaggccaatagcaatactcaagttcattttaaatgaagcatatattttgaaatgagaacctaagtccaactgtttaatttagatgtttttccattcaggctaaaaaaaatttcttcttttttttcttttttgagacagacccttactctgttgctcaggctggggtgcagtggcactatcacagctcattacagcctcagcctcccaggcacaagcgatcatcccgccacacactcctgagtagctgggactacaggcgcgcaccaccacgtgcagctaatttcattcaagctaaaaatattgtttctcatgtaactatcaaaagtgacacatcggggaaaaaaagatgaaaaaagtgatacatctaaagacaagaaattcttttatatacataaaaggagaataatttctgtgctgtaggaccctaacttataaatgtctcatgtacacattttatatttgttagtttaccaagaatttggttttaaaagtagaaagcacggttttatagttaaaagacatcacttagagtaccctcactttcattcaattgacttgtttcaaatacgctaatatcattgtgtactgtcattgcaaagttctgtagattaaattcattgtgaacaatttttaaccacttaaaggtatttaaaaattcaatactaagcatttaaaaataattacatatttactgagtggctttatatataatcaattcagaaaaacagacttaccgtttacagctttctcataatttttccccaggtttattaaatttcgcagcccaggattgaactgttccataacattctgccaaacaaacaaaacacacaaattaataaaataaaaaataaaccaagtcatcttcagattttgtcactgtgtggcccaggatagctatggatgcctaacagcacagtctacaaagtaatgaatgctgatgtaaaaataatgaagcacacctattcccttacctgatggaacagggctcacaggtggcaaggtgcccgtaaccctggcagttctcagttgcccaagaggctgcctggaatctgctataagcggagcaggcagcagtcattcatgtctctaccataccctgcagggactgtaggcctggcatcctcttgggtttgagtggattgctaatggttctcattctagtgttaaggaacgcctgtggaggatcagctacctgtacttacttacaaaggcaatgtttcaaatagatttcgatgaatttctatccactgaatagaaatttccaggagattttgtttttactctgcctaattataggggtgtgggcggggagggacgtgaaagggggcattggtagcatgttgctgatggccccaggacacaggcctgcctggaaacttctggatgtccctggcattttttctttttttttttttttttttttttttgagacggagtctcactctgtcatccaggctggagtacagtggcacgatctcagctcactgcaacctccgcctactaggttcaagcaattctcctgcccctgcctcccgagtagctgggattacaggagcccaccaccacacccagctaatttttatatttttagtagaggcggggtttcaccatgttggccaggctggtctcgaactcctgacctcaggttatccgcgtaccttggcctcccaaaatgctgggattacaggcacgagccactgcgccctgcctccctggcattttcccactgattggtttattcaccaaagttgtgtggagtaactaccatgggccagaccctgtgcacacagctaaggattagaaggcacagtttccctctcatggatttcatggtgcagccagtgtccaggtttcatttcaacacgtgttattcctgtatcagcagaaagtcataaagacaaatgctaggacaagtataagacaaataactatttaggacgtgggtctaaattttaaaataccctaactttgaagtacagacaataagtcattcctacggtactcagacttcacgactcacaacacgtggcgattgttatgtgtttgttccatctaggaacaataagcttcatgatattaatcaccccaaagagaccattcaagtctcaccgaccccttccccaaatgcatgctccatttatatagacgaccagatgcaaaaaagaatgaacaactacccaacattcaaagaggcaggtgctttacacacatacccttcagaataaatgaatcaggaggagagagagaataggacgactcttgtttttaatcaaactgtgataacaatgaaaaacaacccatgcctcgacctttccatagccctggtcttatgcccgagagcactttcaactatgctcctatttttgtatttattgctgcagttttgaatattctttttttttttaaatattcttgatttcttgattttggggagtaactgcagcttcctacgacagcagatgaggcctcaggtctctatacctctcactcttcctttccaatggactttctatgcaattagatggcaatttgctgatgaaactatagtcagtgttcattatgactttgcactaaggctgatggttccctttctcagtaaagcctggctgtttttcctgggatggacaattgtttctttccgccccgccacctttgcttagttttctgtttatctaccttaaacttgtccccatgctgtattagacttggctgaggcctatcagtgttatttttcaaatgtacaaaactctcagctaatctcctgttccgtttttcccttgacttcctctaaggactctccaccatcttgctcagtgtggcttgactgtcacgattgccctagcatggccctcctggtggcctgtggcagcgctcttgtcagccaggtaggtccacgtcttcctatttctccaaaatggagatcacattccaaaaatgatctaagaactaatgcgtgagaggtaaatctgagtccccgtgtgtctgaaattatctttaccttgacgtttgctattttgctgagtagagcagagtagattgaaactattttccttagaatttttaagacatcacttggtcaggcgtgatggctcatgcttgtaatcccagaactttgggaggctgaagtgggaggatcaccacttgagcccaggagtttgcgaccaacctggacaacatatcgagactcccatcgctacaaaaaataaaaacaattagccaagggtggtggcttgtggctgtggtcccagctacttgggaggctgaggtgagaggatcacttgagcccaggagtttgaggctgcagttagttgtgactgcaccacttcactccaatttgggtgacagagtgaggatatgtctcaaaaaaaaaaaaaaaaaaaaaaaaaaaaaaaaagagctattactccactgtctttagcatctgggtctgctgaagtcagctgccatttcttcctatgtgacttttttttaaagcttatttctggaagccttctctttattcctgtgttctgaaattgcaccatggtctgtcccagcattttttttgtttgtttttcatttattttaccggacactcagtgggacccctagccatgtggaaaattatgtccttcaggtacaaatatcattcctgttttatttcttgtctcttcattctttctggaactctgatgaagattttatatatcctggatttattctctaatcttttttgattttccactttcagtagttttgttctataacgctaacagatatcctcaactttatgttccaattctattttttgaatttgatatatcttaatttctaagagcatgttcatgtttcttgattgctctttttgttttggtttggtttttgagatggagtttcactccgttgcccaggatggagtgcagtggtgtgatcctggctcactacaacctcggcctcccaggctcaagtgatcctcgtgccccaacctcccaagtagctgcggggggtggatcacaggcatgcgccaccacgcctggctaattttttgtatttttggtagagacagggttttgccatgttgcccagactggtctaaaactcctgagctcaagcaatctgcccgccctggcctcccaaagtgctgggattacaggtgtgagccaccacgcccagccttttgattgcttctttttaaaagtactctcctgttcttgttttatagatgcagtatcttctcctgtctgaattttttggtgtgttttattctagttcccgtatcatctcctgattacctttcactgtttgatatccctgtctttcatgttagagactctcctcaaacgtgtggtgatccctgatggccagtttgtattgaggcgtgcagcccgtcactgccggctggaagctgtgggtgtgtgcacagggtagtggctgacttgctggcttcattccaagccaatggccactctacagtcatcaggggccactgggcttctgctgagaagtttctaatttcctgtcattgggtgggggacaatcatcggatggtcagctttcgcagtcaggaagggggccgggactggacagtttggagctgattttcaggaactcctctgttttcagctcagagttctgcctcctccacccttggctgctgtttccaagtctagagcacctcagattatcctgaggttaaatctctgctctgccagagggagctgctggtggtggtggctggggtagggaagggaagccaggagctccgccaccctgtgcaccagactccgattcctgcccccaccttctgcggcccagtcctcagcctctggggcccctggggtgaatggctcagtttccatcagactcctttccccaggttcttcaggctctctgaggtcactgagcactctctgtccatttcctatcaccccagatttctttaggtctcttgtcaatggatgttttccaggtctttttgcactgtggatttattgggtattgtttttaattcctttgccatcattttaatgggttctcaaaaggaagaaaataaaatacacaaggtgcctctcccatgcctgcctggaagcccgctcacctggtatcactagacgcagtcaggtgcttggcacctacgcgcaaccagtggccaggaagccccagagccagccaactcccccacgatcctctctacaagatggcaaagcctcattacgtagccacagctgctctttttctttgctttgctttttttcttttcttccctccatcccttcttccctcctttcttccttcttctctttctgagacagggttttgatctgtcacacaggctggcgtgcagtggcatgatcaccacacactgtagccccaaactcttgggctcaagtgatcctcctgcttcagcttcccgagtagctgggaggtgtgtgccaccatgcccaggtaattaaattttttttttttttttaagagacagggtcttgctatgttgtccaggctggtctgtccacagctgttatttctgtcatctcttctcaattcttttgttttggagcttctttgaaatagtttaagactcataagagttgtaaaaataatacacagagttcccaggtatgcttcctgcaatggtatcttctataaccatagtatattatcaaacccaggaaactgtcactgctacagttctattaactcaactacagaccttatttggattttcccactttttgtatcactcatttttgggggaaggtttcatcatttcttttttctttgtttgagacagagtcttgctctgttgcccaggttggagtgcagtggtacgatctcagctcactgcaacctctgcctccccggttcaagcaattctcctgcctcagcctcttgagtagatgggattataggcgcgcaccaccacacctggctttttttttttttttttgtgagacggagtctcgctctgtcgcccaggctagagtgcagtgacgcaatctcggctcactgcaagctctgcctctggggttcacgtcattctcctgcctcagcctcccgagtagctgggactacaggcacccaccaccacgcccggctaattttttgtatttttagtagagacgggtttcactgttagccaggatggtctcgatttcctgaccttgtgatccactgcggccagcccaatttttgcatttttaatagagatggggtttcgccatgttggtcaggctggtcttgaactcccgacctcagatggtccacctgcctcggcctcccaaagtgctgggattacaggcgtgagccaccacgcttggccgggtttcatcatttctatgaaattttatcatacatgtaggttgccacgaccatcaccgcaagtaaaatacggaactgttccactaacacacacgcctcttttgtgctgccacttaataatcatgccctcctcctcaccaatcctcacctctggcaattcctgagctcaatctatgattctgtcattgtgagaatgttatataaaaggaatcatggccgggtgcagtggctcatgcctgtaatcccagcattttgggaggccaagttgggcagatcacctgaggtcaggagttcaagaccagcctggccaacatggtgaaaccctgtctctactaaaaaatacaaaaattagcgggcgtggtggcgtttgcctgtaatcccagctgctcaggaggctgaggccggagaattgcttgaatctgggaggcagaggttgcagtgagctgagaccgtgccattgcactccagcctgggtgacagagtgagactccatctcaaaaacaaaacaaaacaaaacaaaagaatcatgggaggccgaggcgggtggatcacaaggtcagaagatcgacaccattctggccaacatggtgaaaccccgcctctactaaaaatacatgaattagctgggtgtggtggtgcgtgcttgtaatcccagctacttggggggctgaggcaggagaatcatttgaacctaggaggcggaggttgcattgagtcgagatcgcaccactgcactctagcctggtgacagagcaagactctgtctcaaaaaaataacaaaaaaggaatcgtatcgtatgtggcattttaagatttgcccttttcacccagcacaatgccttaagatgtatccaagttgttggatgtagtttatcactttttattttttttttttggctagtagcattccatggtatggatatattgcagtttgtttatccacatacttgttgaagacctggcttgtttccaggttttgacaattccaagcaaagctgctatgagcgatcgcatacaggtttttatgtgagcttacgttttcgtatctctaggataacctgggggttcaatggctgcgtcacatggtaggcacgtgtttaactttttaagaaactgccaaactttttttttttttttttcagaacagctgcaccattttactttcccattagcactcggagatttcactcattttcaaaatctgataatttcattagcacacagctactttctaattaaaagacaaaactattttaaagttactgaaaattattacaggccatgcgtggtgactcatgcctgtaatcccaagcactttgggaggccgagggaggtgggctgtttgagcccaggaattcgagactagcctgggcaacgtggtgaaaccccatctctaccaaaaatacaaaaatttgctgggcacggcggtgggtgcctgtagtcccagctactcaggaggctgaggtaggtgaatcgcttgaactcaagagacggaggtagcagtgagatcgtgccgctgcactccagcctgggcgataaagcgagaccctgtcttgaaaaataaaaaattcatatgatattcttatgaggctgggtgtaggtaaaaatataagaaaactgacagagagccgaccctgcccaataacatatgagcaccacagaaagcagcccagatctgttctttcctgcggatattccttctccaaatacaataggaggaaagtctcatttgatttcctaattttttttttttttttttttttttttgagctagagctttgctctgtcgcccaggctggagtgcaatggtgccatctcggctcactgcaacctccacctcctgggttcacgcaactcttgtgcctccgcctcccaagtaactgggattacagatgcctgctaccacacccagctaatttttgtttttttagtagagatggtgtttcaccgtgttgcccaggctggttttgaactcctgaccgcaagtgattcatccgcctcagcctcccaaagtgctgggattacaggcatgagccatcatacccaaccaatttcctgatataattcttaaaatgttcacatataaccctaacatcttaaaatacgaagaacaacaaatgaatgagaacttccacagttaacaccatacacaaatccctatccaaatgattctaccagagggggaaaaaaaaaagttcaactaagacttgagactaggctgggcgcagtggctcacaaggtcaagagatcgagaccatcctggctaatgtggcgaaaccccatctctactaaaaacacaaaaattagccaggcatggtggcgggtgcttgtagtcctagctattcaggaggctgagacaagagaattccttgaacccgggacgcggggttgcagtgagctgagattgcgccactgcactccagcctggcaacagagtaaggctccgtctcaaaaaaaaaaaaaaaaaaagatttgcaactacagtttgtagtcaatactgagtttttaagcttgaaaagttcaacatatatacttctttattactgtacgtaggttcagctacagaaatgttccctcccagaaattttggctttttttttgagacagagtctcgcactgtcgcccagggagtgcagtggcgcgatctcggctcactgcaagctccgcctcctgggttcacgccattctcctgcctcagccccctgagtagctgggactacaggcgcccgccaccatgcccagctaattttttgtatttttagtagagacggggtttcaccatgttagccaggatggtctcgatctcctgacctcatgatccgtccgcctcggcctcccaaagtgctgggattacaggtgtgagccaccgcgcctggccaattttggtctttctaacagtggaaaatccattcctatattggctcttcacctagttattttagctgaagtacatgttatttttaaacccagggacaaaaaaagcaatgctgcctttgtattccagaatctataaagttttatagtagttgtggacacacttgtgaatagaaagggtcccacattttgggggagagctgtagttgaggcaaaggtcggtgctactgcaaggcttgtgaagacctgaattgttaaacagcctacaatgttaagagtcatcaggagtaatgaacaaatccattttaatttaagtttggcactaagaattaaagggcttaggataccaagtgaatcttaacaaagtgaacagaaaaattataaatgggccaagcagcactgttactaagaaaaaaaaatagcaatagcttagtctatatctctatcgattactgcctggcaaggatactctgccaaactggttttaaccagaatgagtttcatttccatccagggaagggcatgcatagttatggttgcacaatacattctaggctaatggtaatatcactcttctacttgtgctgagtcgcataaaaagaagcttggttctaccgcaaaaccttagcggtactggaaaattagtgattagctattctaaataaaatgttggagaacagttccgctggaaccagcacacactattcaccagatttctagctgccctgtttacctcggcatttctactgcctctgtaaagttacagatcataattatgaattaagaataattatgagaaatgaatgatgcaatcttatgacggttttaacttccttagcatatggactttttataactcattttcaaagaattaccagtatggaactatacataaattaactgtgtacatttataataaagtatacattaattcaattatgactagccagataagctgagtggactttaaacttttaaaaattagtttctcttttagtttctttttttttttttctgagacggagtctcgctctgtcacccaggctgtagtgcagtggcgcaatctcggctcactgcaagctccgcctcccgggttcacaccgttctcctgcctcagcctcccgagtagctgagactacagatgcccgccactgcacctggctagttttttgtatttttagagagacggggtttcaccagtgttagccaggatggtctcgatctcctgatctcgtgatccacctgcctccgcctcccaaagtgctgggattacaggcgtgagccatcgcgcccggccctcttttagtttcttttagtagttctgtataggccgggtgtgttggctcacgtctgtaagcccagcactttgggaggcaaggcggtcggatcacctgaggtcaggagttcgagaccaacctgggcaacatagtgaaaccccctccctactaaaaatacaaaaattagctgggcatggggacgggcgcctgtagtcccagctactcagcaggctgaggcaggagaattgcttgaatccaggaggtggaggttgcagtgagctgagatggcgtcactgctctgcagcctgggtgacagaacgaaactcagtctcaaaaaaacaaaacaaaacaaaaattctctatatgaacaaggacaaattatttgatattttagtgctttgtttttctcagctaaaagtgtaacatttatgataaataagcattaaaagtggtttaagaatctctaagtaaatatgcagttctgtggcttgtaacgtatgtatccttgaaattttatatattattttattctatactatctcatacaaattaaccgagtgacatcacaaatgttcaaaccaatcaaggtacatgctaatgtcatgtagcaaaaatagctgtaatgagggttaactgaggatatgtcaagatcgattttggtttttttttttttttttttttttgagacacagtctcgctctgtctcccaggctggaatgtagtggccagtggcctgatctcggctcactgcaacctctgcctcctgagttcaagcggttttcgtgcctaaggagtaggtgggattacaggcacccaccaccacgcccagctaatttttgtattcttggtagagatggggtttcgccatgttggccaggctggtctcgagctcctgacctcaggtgatctggccgccttggcctcccaaagtgctgggactacaggtgcgagccagcacgcccggtcaagatcaattttatttgtaggaaatcttgcttccttcttccttaagtgttgctggaagctgctgttcctggactaacatcaccaatacttgatcacctgctcttcctttagggaaagtattagtaagcaaatctggcaaggagacagctgcctgtgggctaacagatggtcacaagagtcatgctgttcatacccatcatgaatttggagcacaagccaagtacagaaaaattagacaactgagatgtttcctttgaggtattgagttagatcagaaatactcattgaaatatataaacccacaaaaatgctttttgttggtcaaatatgagtaatgttttggttacctattggtctatattagctattatattagctatcttgcattatgtattagtttgcattatctgtaacttataagatgccatctcaatagcaatgggcctggaaggtgtggggaacttggcagaaagaaaatttggccttgaattcttgggcaaatcacatcaccacctctgtgagcctctagaaagcctgagtctcttcctgtctacaatgggaatcatgatactttctagctcatgaggggcatgaggattcagtgaggcagcttaacattatggagtgcttatcatgtactctgcaagcacttgatactcagtacacactgaaccaactgtagtaattaatattctaagagaaaagctctaaaatatgagtcaagtctccaaacagaggaacactcctatttacacaggtatctccaggaacctccacttcctgttaactggtatcagctcttccaccctggtgtcatcatcaggacgagggagatcatgaacacagaacctctggagaagggtacgggacaaaggacattgaaggtgttatgatcttctgctttattcagttgagaacatttatttattttgagatagggtcttgctgtgttgcccaggctggagtatagaggcaagaacatggtttactgcagccttgacctcctgagatcaagcactcctcccacctcagcctccgagtaggtgggactacagacgcaaaccatatccgactaatttttggattttttgtagagatggggtcttgctatgttgcccaggctggccttgaactcctggactcaagcaatcctcctacctcagcctcccaaagtgctgggattacaggtgtgagccaccacatctggccctagaacatttatgtcattaattttttccatttgaggcacattttaacatttacagagggctactatgaatccggctctatgtctaacattttacatggattgtctcaactgatcctaacatcgtggctgttattaatcccacttgatagacaagataccaaagctttgaaatgttgcattttaaaaccctgctgaaggtcctaccagcagcgagaggtggggtggagtcagctccaggcagtttccctactgtcctttgccttaggcctcaatagttccttcaaatgaatggtgaaaaaaagtgagatgaaaatgcattttatgagatcagagcactgacatattttagtatgagtgattgtaggtgtctctatagtacttttttttttctttttagaagctttcttataatcttactcctgatttttggtgaatataattaatctaatagcataatgtcgagcaattctgcctgggcaaatacgtctgaccctctctctcttctttcccataaaaaaaataaaataaaatggaagaaagaaaaaggtgaatctggccaggcatcgtggctaatgcctgtaattccagcactttgggaggccaaggtgggaggatcgcttgaggtcaggggttcaagaccagcctaagcaacatagcaaaaccctgtctctaccaaaaattcaaaaaattagctgggcgtagcagtgtgtacctgtggtcctggctacttgggaggctgagggaggagaagtgcttgaccccaggaggcggaggtttcaatgagccgagattgtgccattgcactccagcttgggtgacacagtgagaccctgtctcaaaaaaaacaaaaaacaaaaacaaaaaggccaggcgtggtggctcaccccataatcccagcactttgggaggctgaggcaggtggatcacgaggtcaggagtccaagaccagcctggccaacatagtgaaaccccatctctactaaaaataacaaaacttagttgggcctggtggtgagagcctgtaatcccagctactcgggaggctgaagcaggaaaatcacttgaacctgggaggcggaggttgcagtgagccgacatccggccactgcactccagcccaggcgacagtacaacactccatcttaaaaaaaaaaaaaaaatttgtgagagtgtagaatccacaaccacctgtagtccccacaagaattactaacagttggccaggcgcagtggctcatgcctataatcccagcactttgggaggccgaggctggcagatcacctgaggtaaggagttcgagaccagcctgaccaatatggagaaaccccatctctactaaaaatataaaattagccaggcatggtggcaggcacctataatctcagctactcgggaggccgaggcaggagaatcgcttgaatctgggaggcggaggttgcggtgatcacacccccgcactccagcctgggcgacaaaagcgaaagtccatctcaaaaaaaaaaaaaaaaaaaagaaaagaaaaaaaattactaacagttaacagtcacactggttccctttgctgaaaaagcactaaagcactagagataaaaggacaggatgccttagtcaccccatccaagtctcataccctttcttttctcccctgggggagccactaattcagactgctgttaaatatctagccgatattttatattttcacacacacgtatatatttagtcaagattaacataaaattttgctttgtgtgttaaaaaatacttacataaatccttaaatggtatcacataatacatttcactcttacatcttatttctttattcagtgttatacttctgagatctgctcaccttggtctgtactgaccaaggttcttcctatttaacttctacacggtatccctttatgatggtttaagtgtccacgtagcaaagctacagtattcagtcaattaaacactaatctaggctaggcacgggagctcatacctgtaatcccagcactttggggggctgaggcaggaggactgcttgagtccaggagttgagaacagcctgggcaacatagtgagaccccgtctctaccaaaaacaacaaaaaaaattagccaggtggggtggcatggcgtgtgcttgtggtcccagctacttagaggctgagatgggagaattgcttgagccagagaggtcgaggtcacagcgagccacgatcacacaaccatactccaacctgagcaaggcagagggagaccttgtctcaaaaaacaaaacaaaaccaacccattggctgggagcggtggctcaagcctgtaatcccagcactttgggaggccgaggcaggcagaacacctgaggtcaggagttcgagaccagcctgaccaacatggagaaaccccatctttacaaaaaaaaaaaaaaaaaacacacaaaaagctgggtgtggtggcgcatgcctgtaatctcagctactcggggggctgaggcaggagaatcacttgaacccgggaggtgcaggttgcggtgagctgagattatgccatcgcactccagcctaggcaacaagaacaaaactccatctcaaacaacaacaaaccaacccactaatctaacacggtgttgtctaaacacagcgttgctatgaaggtattttgtagatatggtcaacatctacactacaacttttatttaaagttgactttaaataaaagagattatcttcaataatcagggtgggtgtaatctaatcagtcaaaagcctgaggacaaattgaggtttccctaaggaagaagatattctgcttaagggctacagagtcagctcccaggctgccctacagatcttggactagtcagccccacaatcatggaagccaatttcttgaaataaatcttttcacttatatatagatatacatatacatacatatcccatcatgtaaagagactgcattttacccatctatttcttgactgacaggcatttacatggcttacgagcttctgctaatgacgacgacgtggtagggaatgatacatgtctccttgtacatacaggtaagaatttacccagaaacagaactgcagagacacagggtatgtgacatatttctccattttgttagatactcccaaatttgaagacagcaactgtagccatttccatgcctgaaaccaccgtgtcaaagtgctgttttgccatgttctccccaacacttggtactgtcatactttttgcctgtttgataggcaaacaatagtatcttttaaaaagtaccatacactaggccaggcccggtggctcacgcctgtaatcccagcactttgggagaccaaggcgggtggatcaccagaggtcaggagttcgagatcagcctggctaacatggtgaaaccccatttctattaaatatacaaaattagctgggtgtggtggcacgcgcctgtaatcccagctactcaggaggctgaggcaggagaatcacttaaacttcaggaggcagaggctgcagtgagccagtatctcaccactgactctccagcctgggcgacagagtgagactcaatctcaaaaaaaaaaaaaaaaaaaaaaaaaaggccaggtgtggtggctcacacctgtaattccagcactttgggaggccgagacgggcggatcacctgaggtcaggagttcgagaccagcctggccaacacatagtgaaaccccatctctactaaaaaaaaaaaatacaaaaattagctgggcatagtggcgcatgcctgtagttccagctacaggctgagaactgtgggaagctgagacaggagaatcgcttgaacctaggaggcggcagttgcagtgagctgggattgtgccattgcactccagcctgggtgacagagtaagactctgtctctcaaaaaacaaaaataaaaacaaaaacgaacaaaaaaaaaagtaccatacactatttctcatcagcattaaaaaataacacgactggaaatagctaagcatggggagagaaatgatgaaaggtagtttcctggtgtgttttagcctcagttctcgtgtccatcataagtgaatgtcatcagtgacttctgtccttttaacacagggtgggaagaggcattgaaagccgggacattccctgcagctgcatgctccacctgggtttgggctgaggcacactggcctccgggctgttctccaaacaggtcacatccattcccacaaactctcagagacaccttccttgacctcttccacaaatggtggcaaccccagcctctctctagctctgttcctggcttctctttctttaaagtacttatcatactgtataagatattccctgtttactctctgtctccttggtagaaactacatgtaatcaaggctagggatgtttttttttttagactaagtcttgctctgtcgcgcagcctggagtacagtggcatgacctcggctcactgcaacctctgcctcccaggttcaagcagttctcgtgcctcagcctctccagcagctgggactataggcacacgccaccatgtccatggctcagcactttgggaggccaaggcagaaggctcactctttttttttttgagatggagtctcgctctgttgctcaggctggtgtacagtggcgtgatctcggctcactgcaacctccgcctcccggttcaagcaattctgctgcctcagcttcccgagtagctgggactacaggcgtctgccaccgcgcctggctaattttttgtatttttagtagagactgggtttcaccgtgttagccaggatggtctcaatctcctgacctcgtgatctgacctcgtggttggccaggctggtctcgaattcctgacctcaggcgatccgcccgcttcagcctcccaaagtgctgggattacaggcatgagccaccgagcctggccaaagctaggaatcttaatgtaaccaccaccgcatttccagcaccaagaacactgcctggatcatctgattaatgcctcacagtgttctcagcagcagcaggttctgacacctgtatttcataagagatgcctgcacccacggacgaaccagctgcaggctgtaccctcagctccaccagctcatctgaacacatcgctacagacacaaaggccccgtgggtcaatcagcctcgaaaattgagcattaggtaatggtgccactgcttgccacttccctagctcaaggcgataactccaaccaaggttcacaaaagctgccaggctcggccttctacctaccaagtcctaacaggcttacaaatctgcaaataccagggctgtctgtgaattttgcttcccaatcctatgtttttctaagctgtcatttaaattccctgtgaaatacaaggcattaatgtggcctcttaaaaaaaatcttgtttagagacaacccacatgtccatcaactggtgaatgaacaaaacgtggtatatccatttaatagaatattattcagccatagaaaaggaataaaatattaagacactctacaacatagataaaacccattacgctaagaagccagtcacaaaagaccaaatactgtatgactctatttacaaaaagtacagaaaagacaaatctgtagagacagaaaatctattagtggttgcctggagctggaagcgagaatgagtaatgatagcaaatggggatgaaggatctttttgaggtgacagaagtgttataaatttaaattgtggtgacggctgcacaactttataaatttactaacaaccattaaattgtacgcttaaaatgcgtgaattttataacgtataaattacacctcaaaaatgctttttttttttttttgagatagggactctcactctgtcacccaggctggagtgcagtggtgtgatcagacctcatggtaatctcaaactctcagactcaagcgatccttctgcctcagcctcccatgtagcagggactttaggtacgcaccaacacacccacctaatttttaaattttttctagagatgggctcttgccatgttgcccagtgtatcagtctgttttcatgctgctgataaagacatacccaagactgggaagaaaaagaggtttcactggacttacggttccacatggctggtctcagaatcatggtgggaggcgaaaggcacttctaacatggcggcaggaagagaaaatgataaagcagcaaaagcggaaacccctgataaacccatcagatcttgtgagacttattcactaccataaggacagtatggtggaaaccgcccccatgactcaaattatctcccaccaggttcctcccacaacacatggaaatcataggaatacaattcaaaatgagattcgggtggggacacagagccaaaccatatcacccaggctggtttcagactcttggcctcaagcaatcctcctacctcagcctcctaaaaagtgctgggattacaagcataagccaccatatccggtccgttttttttttttttttaataaaaaaaaaaaggaaccaccaccaccgccactaccaccaccaccatcgccaccacccaaccacccaacccccgccccaccccttcttccattacaggctgctaaggattcagggatctaaatccctaatgttatggaatggccacaaagatgtgtatgcctttgctcattctttggtggtctctaactagcctgcccacagcacagcccagcatactgagacgcacaggtcatcccccgtcctttgggaacatgggtcccagacagctggacacgcaccactggtctgcaaagcatttatgcctatggagccgtccacagccatttccccttctagggtgaaaatcaatttgacccattagtagaaaatgataacccagctgttttgaggcagatctccggctggcgtagcagttgtttttccagctatgattgggtagggagtttggcaaatgtttttccaggcaaaagtccttactgtgtccttctaaaaggcggggtttcctaggaaatcttcagcgcatggagaaaactctccgtgagaatttcattatgacataatcattgttttgccttcattcttcctttcccatcttcacccacaatctaggttttggtttttacagaattattgctacaaagattgtccttccaggtgcaaaggtcatagcagaaaggaagccaagaggcctgcaggcttaccaggccccatccctagcaacgtggcctgagcctccactgggcgtgcaggtacagtctttgggcttagcctgtcatagaagaatattctcagagtcctgggagcacctatgagagcctgagctctctaaggccaaccaagcaattgggaccagtgtgatcactgaaagacatgcaccgctgcttcttctgatatattactagacgcaatcacgttgctgtgacctttcattcagttgcttaaagagacagatttctgtgacaaactcttggcttcctactccctactcacttaggcagcaagaattattctgcagctaaagcataattaagccaaaaaatggccccaatacactgaggtaagaaagaaggatgtcctacaactgttcacatcttctggacaaaagtatcaagcccgttaagaaaattaagtcccagagctacccccacccacattagggtaaaaatctaagggtttttttttttttttgagatggagtctcgctctgtcacccaggttggagtgcagtggcgatatctcggctcactgcaagttccacctcctgagttcacgccattctcctgcctcagcctcctgagtagctgggactacaggcgcctgccaccacgcccggcttttttgtattttcagtagagagggagtttcaccgtgttagtcaggatggtctcgatctcctgacctcgtgatccgcctgcctcagcctcccaaagtgctgggttataggcgtgagcaaccgtgcccagccaaaatctaggttttcaattgttaatttgaaaaaagagtggggagggagaacaatgtacaggaaaactgagctcagcccatctgagaaggtaacttgaaggaaaaaataatggtctttaacctagttcaagattagaaaatttcagccaggtacagtggctcacgcctgtaatcccagcactttgggaagccaaggcaggaggattgcttgaggccaggagtttgaaaccagcctaagcaacacagggagactgtgtctctacaaaaaataaaatttaaaaaaagactagaaaatttcattctattttaattactagacaaaggttttacatttgcctatgaatggaatggttcaaaatcactttcctttgtagtttaagtgtggatgattatactgggtttaaggtccacagataccataactctatatagttatgtttatttcttggcaatgccaggaaagcgttcaggttgaagctttggcaattagcaagctatcaaactttggaacaatgtctcgtccacaccggcctccatcagatgagggattgtggaaccctgccccagaattcaagcaggttttaaattctgaacttcatagggaataagtaatgcctataagactgaagtaaaaatcatttcttcaaattcctactaggataataccagtatccacgtttgctttgttcttagaggtacatgttcttatttgaaagaatgaaacctgaggtcaggagttcgagaccagcctgaccaacatggcgaaaccctgtctctactaaaaatacaaaaaattagccaagcatggtagcacgtgcctgtaatcccagctacttgggagggtgaggcaggagaatcacttgaacccaggaggcggaggctgcaatgagctgagatggcgccaccacactccagcctgggcaagagaccaagactctgtctcaaagtatcaaaaaagaaacaaacaaacaaaaaaaagaaaagaaaagaaagaatggaaacacaatccttcctattctaagctgctataccaagatgactaccatgtaatataactttcaatctttttttttttttttttcagacagaatttccttcttgttgaccaggctggagtgcaatggtgcgatcttggctcaccacaacctctgcttccctggttcaagcgattctcctgcctcagcctcccgagcagctgggattccaggcatgcgccaccacgcttggctaattatttttgtatttttagtagagacggggtttctccatgttggtcaggctggtctcgaactccagacctcaggtgatccacccacctcggcctcccaaagtgctgggattacaggcgtgagccactgcgcccggccataactttcagtcttaaaagtaacatttcaaccagaatctgaaaatgtgcctcttttctgggatctcctctttgtgtaagtttgtgcatgtgtgggagagacagagaagtaacatgtgaatgtgtgtacttacgtttcattccaccaactctgtaaagtctcacatttcaggctttcaaacacataaaaatctacacatttctgcaacatttattattatgcctacgttgagcccaccccatcctggacccaggaaacacaaagatgaatgaagaaagagctccaggccgggtgtggtggctcacgcctgtaatcccagcattttgggaggctgaggcgggcagatcacctgaggtcaggagtttgagaccagcctggccaacaaggtgaaaccctgtctctactaaaaatacaaaaattagctgggcgtggtggcacgtgcctgtaatcccagctactcaggaggctgaggcaggagaatcacgtgaacctgggaggcggagattgcagtgagccgagatcgcaccattgcaatccagcctgggcaacaagagtgaaactccgtctcagaaaaaaaaaaaaaaaagaaagagctccagtccttggaaatgtaccgtcttacacggaaacaggtacaaagaaataccaaggcaattcacagagacgtggtgaaaataagaaatgcaaacacctgaaatattacgttatcatttagaaatataaaactacagataaatggcatgtattaaggaccagtaactgattagttactgattctgaaatagctgttaaaagatacatactttgaagaccacagagtatactaggctgtttgactaagtgctcttgcctgcctagttactgtttttaaaaggtgtgtcctggaataaaaaagcaatcaataaatttacaggaaaggacatcttatgcactgggttacgttgtttagaaagccccagagcactgaacaggtaacaggaactttatcggatcaaagtacactgacttactgcactagttctttccaaatgctacttttatagtagtatctggaatcattctagctaacttccttcaaccagactctgtgagacagatcattctaccttttttttttttttttttttgtgagatggagtctcgctctgttgcccaggctggagcgtaggtggcacgatctcggctcactgcaacctcggcctcccaggttcaagcgattctcctgcctcagcctcccaagtagctgggtttacaggtgcccgccaccacgcctgggtaatgtttgtatttttagtaaagatgggattttgccatgttggccaggctggtgctgaactcccgaactcaggtgatccaaccaccttggccacccaaagtgctgggattacaggcatgagccacggcaatcaacctcattctattgtcttaaaatcgcagctgggtgggtgcagtggttcatgcctataattccagcactctgggaggctgaagtgggcagatcacttgaggccaggaattcaagaccagcctggccaacatggtgaaaccccatctctactaaaaatacaaaaattagccaggcatggtggcagggacctgtaatcccagctactcaggaggcagaggtgggaggattatttgaacccaggaggcggaggctgcagtgagccaagactgtgccaactgcactccagcctgggtgacagagcgagattctgtctcaaataaaataaaattgcggcctttgcgatctgaggaattgttcaaaaactccaaatgatttaaaaacagtttaaattctttacttttatttctcagataccagtaaggggaaatcatttctttttcttttgagacaggttcttgctgtgttgcccaggctggagtgcagtggcgcaatctctgctcactgcagcctcgacctcccggactcaagcgattcagcctccagagtagctgggattacagccacacgcccccatgcccagttaatttttttgtttttttcgtagacatggggtttcactatgttgtccaggctggtctcgaactcctgacctcaagcaagctgcctgcttcagcctcccaaagtgctgggattataggcaggagcccccacacccagccaggaatcaacatttcttttttttgttgttttttttttcacaaatagcactctttatttgccactatttgaagtctgaactttaaacagattcttggactggtggttcatatccatcagctcgttcaactttagcacctgtctcgtccccagtggcttttccagaactactgccttcaccatgaagctccatgagctttcccaattcaaacttgggcttcttcagcatttttacttttctaacgaagacatcatggagaggataaatagactggcaagccttttctatgtcttttccaatgctgtctggaatcaatttattgaccacttctttcaagtcatttgtctgcacctctcgggtcatgatttcgatcatcttcttccggatttggcggacctgttggtgctgagcataagaggtcttccgtatctgattgttgcgttttttagtaaaaccaacacagaacagacgaagcaagtaaccatcggtagtcttgacatcaacgtgagcttcaatcattgtctgccattttttgaccatggaacacattttgtcacgggtaagatccatgccatggaagttaggcagtttttaccctgaacatcttcagtaatcagcctgaattttctaaatgcaacttcatcattctgcaaatcagcaagactcacttcaaacacacgacccttgagaccatcagatgcaattttggttccttgggtcctggtgacgagcgtctttccaatatttcttatactgaacatagcaggtgctttcacatcataccaatctttcttagaaaatggatcaaccactttcttcttggctccctttttgccgcctttcgtaaggcgcttgttcttgccaaccgccatggtgctggtcagagagccaaaagcaggaatcaacatttctacaatgttctttccgagaacttttttttgtctctcatcgacttctctcctatattcaactttccaaaggttttttttttttttttttttttttggtgacagagtctcgctctgtcgccaggctggagtgcagtggtgccacttcagctcactgcaacctctgcctccaggtttcaagtgattctcctgcctcagcctcccgagtagctgggactacaggcgcccgccactgcacccaactaattttttgtatttttagtagagacggggtttcaccgtgttggccaggatggtcttgatctcttgacttcgtgatctgcccgcctcggcctcccaaagtgctgggattacaggcgtgagccaccgtgcctggccttccaaagacttccttaaagactgtacatcgccttaaaactcctctcaaacttaacctacacgcgtattaagcttttccttctttcttcccatattgagacaaaaccaagtccaaatattgaagttgtaaaggccagcccccgctgggacagagggtagggaaggagcaaggatgtttaatttacgacatgggcaggtccaggcggaggagaggggctgcggctactagaacttggggttgctgtcctgtcacagctataaactctggatgggcacagaccttctttgtcttttctccagcgtggtttctggtggtaaccatggtgcttggcacagctgtggtgctcaagaaaacagctgcgggaagaactcatgttggtggtaaaagctcagcccgtacctaacaggtgctcacaacatggcagttgttattactgacacgatctcagtgccaccaaagagttggtgatgatttcagtcacccctgtgtgatcagcacaggtcttcagcatttaaaacacaaaattcttgagttcttactatgcgccaccacgataagggattaaataaaccttcaagggctggatgcagtggctcatgcctttaatcccagcactttgggaggctgaggtgggaggactgcttgagcccaggagttcgagaccagcctggccaacaaagtgaggcaggccctgtctctacaagaaaaaaaaaaaaaattagctgggcgtggtggtgcacgcctgtagtcccagccactcagaaggctggggcaggagaatttgcttgagcctaggagttggaggctgcaataagctatgattgtgccatttcactccagcctgggcgacagagttaagaccctgtctcaaaacaaaacaaaacaacaacaacagaaaccaacaaccaaaaaaaccttcaaggaccatatagctccttcagggagataaaaatgtgtgccaatattttcaacactattctcttatcaggtatttactcagctccacctatttcagtcatttgtaaataaggaggcaggtaataaacagatgaaaatcaatgctcttggtgggggtggggagtgacagtctagtaaacacacgctatgcctactaacagttagccctaattgaatacctacgatgcgccagatgctattctaagagctttcatgtatgactgcgtttaatcttcacagcaaccctaggagctattatcatccttatttacagactaaagcacatcaaatgaaagaatagggcattatcaagtacatacaaccatcggggatgacacaaaggatgcactggttagctgaagaagccttctcagagggcataagagtaagactgagtctctaagcagatgcctgtaatcccggctactcgggaggccaaggcaggagaatcgcttcaacccgggaagtggaggttgcagtgagccgagatcgcaccactgcactccagcctgagtgacagggcgagactccctctcaaaaacaaaacaaaacaaacccatgttttgcatgtttaaactttttggtttacaggcatattgttcctgcatttattgttcagtcacatattgtactgtcagacataactgatgtcctgtatcttaagctgctcaaagtgtaacataagcccatgctatgatgagacataccatttagtccattaaataatcacaactgggccagatgcagtggctcacatctgtaatcccagcactttgggagaccgatgcaggcagacggcttgagcccaggagttcaagaccagcctgggcagcatagtgaaaccctgtctctatgaaaaacataaaaattagtcagacttggcggcacgtgcctgtagtcccagctacttgggaggctgaggcaggaggaacgctttagcctgggacgttgaggctgcagtgagccatgatcacaccactgcactccagcctggacaacagagaccctaagaaattaaaaaaaaaaaacaaaaaacaaaccattcaagttttatccaaaaaatcctggcccctaagtatgaggaattatcattgtgactttcctgatttgtcacctgaggtttttgtggccagaaacagattggtctattaactaagactcaggcaattgtgtcagacaggcatgtgaaggtgacagggggccctgtcttctgtactcctctcccctcccccaacaggcaggggcttccctcctcctaactcagcatggggctgctggattagggtagctggtggttggatctgtcatctgggacctattccaacccctaccccaatcttttctgcacatttgttcgaggccttattttttattttttttgagacagagtctcactctgtcacccaggctggagtgcagtggcaccatctgagctcactgcaacctccgcctcccaggttcaagcaattctcctgcttcagcctcccaagtagctggaattacaggtacccaccaccatgcccggctgatttttttgtatttttagtagagacggggtttcaccatgttggccaagctggtttcaaactcctgacctcaggtgatccgcccgtgtcagcctccgaaactgctgggattacgggcatgaggaggccttatattttaatcatctgagatttcccccatacttttgacaggttattaccacgcttgtacctcttcttgtccctgttgtcacctgcttttgtgcctttcaaagatacagccatgcttttaactgcttgcaacataagaaatgactttttgctctacacattcagagaaacttctgaacaaactatagaaatgacccctgaaagtaaagtcttgacttttaaaaggcagttttaagaactggaatttgagtattttcaattttgttcagctagttgcctgttgcacgtgtagtcttgggttagtaaatttttttttttttttgagaggtagtctcgcactgtcgcccaggctggagtgcagtggcgggatcttggctcactgcaagctccgcctcccgggttcacaccattctcctgcttcagcctcccgagtagctgggactacaggcacccgccaccgcacccggctaattttgtgtatttttagtagaaatggggtttcaccatgttagccaggatggtctctatctcctgacctcgtgatctgcccacctcggcctcccaaagtgctgggattacaggcatgagccactgcgcccggtctcgggttagtaaatgttaaacatgtattcccatacgtaaaaatcaagacagaaatcataagatttaaaattaggtttatctttaaatgggtaatttgcaaacagaggtaggagatggcgaattttagcttagttttaaaaacattatgtccattaaaacggaatatatatatttatctgctttacattaaatattataaaagtaagcaatttacattaaaaaatataaatatggccgggtgcagtggctcacgcctgtaatcccagcactttgggaggccgaggcgggcggatcacaaggtcaggagatcgagaccatcttggctaacacggtgaaaccccgtctctattaaaaatacaaaaacaaaattagccaggcatggtggtgggtgcctgcagtcccagctactcaggaggctgaggcaggagaatggcgtgaacctgggaggcagagcttgcagtgagccaagattgcgccactgcactacagcctgggtgacagagcaagactctgtctcaaaaaaaaacaaaaaacaaaaccaaaaactcctgccctagagttaactagtgcttaattgatattgtttagggactttttagcctccaaagtaccatatgaataaacacaagtttttttgttttgagacagtctctcgctctgttgccaggctagagtgcggtggcgtgatttcagctcactgctacctttgcctccccggttcaagcgatcctgcctcagcctctggagtagctgggactacaggcgcactccaccacacccagctaatttttttttttttttgtatttttagtagaaatggggtttcaccatgttggccaggatggtctcgatctcttgacctcatgatctgcccgcctcggcctcccaaagtgctgggattacaggcgtgagccactgtgcccggcccataaacacagtttaagcaggaaatctgggggcatcttcacccacctgctgttctctcaaaagcacaagcactctaggaggtgaaatactggttagatctctgacttgggctcatctattctgctccctggtttgggaactcattctggtaatattttttcttctattttttaaagaaagagaaaccggcaacattttatctcatttatatgcatctcacttttatccacaaagacttcaggcagctgttacaccaggaactaaaaccattaaaatctaaaacttggccaggcacagtggctcacgcctgtaatcccaacacttttgggaggatgaggcaggcggatcacaaggtcaggagacagagaccgtcctggctaacagagggaaaccctgactctactaaaaatacaaaaaaaaattagccgggcatggtggcgggcacctgtagtcccagttactcgggaggctgaggcaggagaatggcatgaacttgggaggtggacgttgtgagccgagatcgtgccactgcactccagcctgggcgacagagtgagactccgtctcaaaaaaaaaaaaaaaaaaaatctaaaactcaagtcactaaaatcatgataaaccagaaggactcaaggttaggaagacaaacagaagtataaaatcaaggctgaggaaaataaaaacagaaatctaacgtctgaaaggtcacagagctgtaattactctgcacatatctacaagttctaagtttatggggaaaagtatgcctagttattaataggcatgaaatcgtaggtgttctggccaatgtccatattctatatggtacacatgcttaaatactgaaaacacacacacatcccttctatgtgttattaaaaaggaagtggttttaaaagatctacttaattgagctgggaacgacggtgcacgactgtagtccctgttacttgggaggctgaggtaggatcactggagcccaggagttctaggtcagcctgggcaatgtagcaagaccccctcgctaaaaaaaaaaaaaaaaaaaagtctaccttagctgggtgtggtggcgggtgcctgtaatcccagctactaagggaggctgaggcaggagaatcgcttgaacctgggaggcggaggttgcagtaagctgagatcgcgccatttcactccagcctgggcgaacaagagtgaacctccgtttcaaaaaagaagtctacctaactggctagagttcagggaaaggcgcactctcacaccatgcagacaacagcatcatttggtgcatgctttctggagggcattttgcaatgtggagcaaacaggctttaaaatgtacctgccctttgacccagagctcccttctgggaatgtggcttaaggaaaacatcatggatctgcttacagatctgtgcaaagctttgactgcaaccatgcccatggctgagctgtaatagcaaagtactggcaatgatctatgtccaaccacaggggctgatcaataaattatgatgaaaaatggagtcctgtgcagtcatcaaaatgatagagcacagaaaactgacatggggatatgtacggaaaagtatcagaaaaagcgacagcaatagttagtgttatctctggtttgcaggattctgggcacacttatttacacttcttgttctttttgagacagattcttgctgccacccaggctggagtacagtggtgcagtctcagctcactgcaacctccgcctcccaggttcaggcaattctcctgcctcagcatcccgagtagctggaattacaggcacccgccaccacgcccagctgatttttatttatatatatagatatatatatgtaatttttgtaatttttgtgtatatatatacatacacacatatatatacatatatacgtgtacatatatgtacacatatatgtatacacacacatatatacatatatacgtgtacatatatgtacacatatatgtatatatacacacatatgtgtacatatatatgtacacatatatgtatatatatacatatatgtgtgtgtttatatatatatgtaatttttgtatttttggtagagatggggtttcgccatgttggctaggctggtctcaaactcctgacctcaggtgatccatcctcctcggcctcccacagtgctgggattacaggtgtgagccactgcacccggccatgaaagggttttattacataagggatgttgaaagcacagatgaaccctatttaaactggagctcggagtggggtgcaaagttatggttaactgcattttcttgttaattaaatattaatgaaaataccttccttttctttttatgtaacttttctatttatttatttttttttgagacggagtctccctctgtcgcccaggctggagtgcagtggcatgatctcagctcactgcaagctccgcctcctgggttcacgccattctcccgcctcagcctcccgagtagctgggactacagcctcccgccaccgcgcctggataattttttgtatttttagtagagacggggtttcactgtggtcttgatctcctgacttcgcaatccgcccgcctcggcctcccaaagtgctgggattacagacgtgagccaccgcgcctggtttatgtaacttttcttgaaaatgtacctactttggaccaggcgcagtgaggggctcatgcctgtaatcccagcactttgggaggccgaggcgggcggatcacctgaagtcgggagttcgagaccagcctgaacaacatggtgaaaccccatctctactaaaaatataaaaattaggccaggcgcggtggctcacgcctgtaatcccagcactttgggaggccaaggtaggcaggcagatcatgaggtcaggagatggagaccatcctggctaacacggtgaaaacccatctctactaaaaatacaaaaaattagccgggcgtggtggcaggcgcctgtagtcccagctactcgggaggctgagacaggagaatggcatgaacccaggaggcggagcttgcagtgagcagagatctcgccactgcactccagcctgggcgacagggagactccgtctcaaaaacaaacaaacaaacaaaaaaacccacacataaaacaaacaaaaaatccctttcatgcatgcagttatgatagttttagagtctaatgaacttcagtttatgtcttcctctagtgactaccacaactgtatggcctctcagaccagaatttcctaggtcttggtttgtcttctgacatgaaggatttcccacagggctccctgccaaggttacatacaccctacagagaaacggcagatcatcagcaggcctggaacaaacgattttgtttgtgtttactttaaaatttttttgcacatacccacaggaatggcaaaaattaaaaggatgggaaatagcagcagctggcaaggatgaagagcaactggaactctcatactctgctggtggaatggcaactggtgcgtcactgtggaaaatcaatcagcagtttctcctaaagcaaaatatttgaatgtctaatactcagccagtctgctcctgtgtctctatccaagagaaatgagggcctatggccatcagacgtgagccagaacattcataaagcacgactcataatatcttggaatagtctgaacataatcccagctgggcacagtggctcacgcctgcaatcccagcactttgggaagccgaggcaggcggatcacctgaggtcgggagttcgagaccagcctggccaacatggtgaaaccctgtctccactaaaaatacaaaaattagccagcgtggtggcaggtacctgtaaccccagctactcgggaggctgagacaggagaatcgcttgaacccgggaggcaagggttgtaatgagccgagatcacaccactgcacttgagcctgggtgacagagcaagactccgtctcaaaaaaacaaaacaaaacaaaaccaaagaaagaaagaaaataatcccagccaggtgtggtggctcatgcctgtaagcccagaactttgggaggccgaggtgggtggatcacgaggtcaggagttcgagaccagcctgaccaacatggtgaaacccgatctctactaaaaaatacaaaaattagctgggcatggtggcataagcctgtaatcccaactactcaggagtctgagggaggagaatcgcttgaacctgggaggtggaggttgcagtgagccaagactgagccactgcaccccagcctgggcgacagagcaagactgtctcaaaaaaaaaaaaaaaaagttaggagaggggctacccttggaggggtgcagcgactgggaggtggcacgagggggacttcagggagtggccatggtttgctccttgatctgggtggtggttacacaggtgtgttcagtttgtgacaatttagtgagctatgtatacttaagcacaactttatgtatattgctattcaataaaaagttttaaaaacaaattttaaaatatatttgcatgtgtcagcagataagttaaactaaattttatgcagcttttataacttatttttaagctggaatattgagttggaattattacagctttgaatacaggcctgtaatcccagcactttgggaagccgaggcaggcagattacttgagctcaggagtgcgtgaccagcctgggcaacacagtgagacaccatctctaccaaaaataaaaaattagccgggcatggcggtgcatgtggtcccagctacatgcctgtagcttttgatttacatttgtgacactatttcagttttgggtattaattcttgtcttgcacagacctccaagggaaacctaatgtgcatggaattaaaacaaattggatttttattttcttcaacattccacacagtttttagtcaaaaaataatcattttttcttgagatggggtctcactctgttgcccaggccagagtacagtggcaccatttcagtactgcaacctctgcctcctggcctcaagtgatcctcccacctcagcctactgaggagctgggaccccaggcacgtaccaccacacccggctaatttttgtatctttgtagaggtagggtctcactacattacccaggctggcctcgaactcctgggctcaagcaatccacctatcttgaccccccaaagtgctgggattacaggcatgagccaccgctcctagcctcattttattaagagagtttgttcaaaacatgccaatgatgatgaattaacagaatgacagaaaattccagtgacaccttagatcgccacattatgaaaatgtattcggtttgtgcatctttggtcactggaaactaaattaccatacaaacaaaggcatggtaagtgggatgtggcagccggtcactaagagactctaggactcagtttctcaacctggttaacaactatcctggccaacatggtgaaaccctgcttctatcaaaaaatgcaaaaatttgccaggcgtggcggctgtagtcccagctactcgggaggctgaggtgggagaattgctcgaaagtgggaggtggaggttgcagagagctgcgattgcaccactgcactccagcctgagcaacaaagcaagaccctgtctcaaaaataaataaataaaaatagttaagccaacacaatccacattcacctggatggctgatgtttacttagaattaagcactctatgaaaagtatcatcggagggcgccaggagcctagcaaaggacaggtgcttcacacattaaatggataaatgtccattcattcaacaaatatgcatgcctactatgtgccaggaactgttttaagtgcttggaatacaaaaacaaaaacaaagctcattgccttgtagagctcacattctagttggggtgggaagagagggaaagaaacataaataaatacatcacatagcctattctaaggtagtgttatgggggaaggtaatgtagtctaaggtggggctgggagatggatggaggcgtctgcaatctgagagtctgagcatacttccttgaggtgacactgaaaggcttctgtgatatctcccctttgactctgttagcaagattcctgtaggtaggacatccctcgatgctgccacacccgttcttcctccacttcttaagcccttttttttttttttttttttttttgagatggagtctcgctctgtcgcccaggctggagtgcagtggcgccatcttggctcactgcaacctctaactccctggttcaagcgattatcctgcctcagcctcccgagtagctgggactacaggcacgcgccaccacacccagctaatttttgtattttcagtagagacagggtttcaccatgttggccaggacggtctcgatctcctgacctcatgatctgcctgcccaccttggcctcccaaagtgctgggattacaggcgtgagccaccgcgccgggccctacttcctaagtctttaacagttctaggaaggctgtggctgctcttaattaagggtttttttgaactacttcttctaccatgagagcatatactcatcagaaaaccatgcaaaatcacagcaagcttttgagggcaaattatgggcatgctataaagtgtggagtggggagggatttttggctgaactctaattagtaacagcaacattactggacattttggggcttataacatcgtttatgaagtagtaaaatacacacatcctcctgggagttagcatggatctcccataatcatttgcctacgtatacattttagacatttcagcaaatgtgtacacagcatatatttaaggatatttgatattggctacagaggatcattctactttataattcctccttttctctaaagtattcctttatttcataattggagaaacctgagtatttaaaaacaaaaaactaaaacccatactagcaagtcattaaaaaatcatttgcaggtggcttttgtaaacacacctggttgtgttgcatttctattagtaaaatatggtagatggttaggtaatatagaggacatctcttcttaaaagcactagattcatcaacactgccagatttttgccatattaagcttaaactgttttcagcttgaacatcatggggcagggctggatagggggaagaacccaatacaggggcgggaaaaggtttttcagactcctgaattaaaatttcactttgcactgccaaagccaaagcatgggctagcagccttcactatttcatagattacataaacttgtagtctgatgctgtaaatatcctaccacctggacattaaaaaaaaaaaaggtcccaaaacactaacaaggaaatagtaattaaaacgaacaaacatttagtgagctttccagtttgctttcagacacctggcaatggaaaactatcaggtactggtctttgatctccatttacagtgccttacgtctacaaatacgtataaccaaaatgatgaaatccacactttttccctgccgtttccgttctttgggtaataagacatgcccaagtggttggcatttgtgacgctgcaattcgccttggtacggtccctctaaggagttattactaaaagtctacgtcaggaagaagcgggagaaaaaaagcagggtttaactcagaacacctgactgctggtctcaagttgcaatcgcagctcagactgggaagatacacagggctgttcttggaagaagggcggaaggcagtggtgttctgtatttttgcaccccagtggacatcagactctgcctcaaatttgcaatggcctgccttcctcaattacacagtttttccttcactgacagtcaacagagcagccactacttactttccaggtctgagtctggcagaaagaacgttttatttacacacttggtcagtaccccacacctcatgcagcaacgtcttccgggtcatttaaatagtagcaatctcaatacaaatgtaggaatttctcaaatttcgaatttctcaaatttctaaagatcgccctctatgaaggcaacacacgaatagaagagtttttggtcacagtgactgagcatcaaaaacgctgtgtcaactgtgtctactctccctacctgtaaggcataatttatatgtgacagtatacactttgtgtgttaagataaacggaacggatctcttggatttcaatacataacaaaaatgttcatgttcttctcttactttcattcaacaaaagttaatagactcctctgattttaggaattcagaccttgaaaacccagaaactaaaattttaggtttaaaaaagtctatcaaaatgactaaacttcctgattcaagcaccagggacagaaaaaagataaaacacaccaaccaaccaaccgaccaaccatttatttataaccttaaacatgcctatacatgaacttagagaacgttaaagtttcaagggttcgaagcgcctaggctgaattaaaacaaaagttgttttgtgttctattaatagcagatgattaacagatatcttatttcacctggaattcatttgtaagtatgtaaactaaacaggccactaatcctaagtctctgtctgtgtctggaaaaattctctcctaatacatgcaagttaagagaccggctatcaacgcattccttaaggttaggtcaatttcattaaaacctcggttgttctttgacttcaagaacctcaccaaataacccatatataaaagccaagttcaactgaaaggtgggagaggaagggtctaaggaggagggcgtttcccgggagaacgcccagagctcggctcacctggcgatcctaattacaggggagtttcacccccacattcttgggcgctttcttttcttagaggaaactcgagcttgtgtctttggtcccggagggcttaagcccggcagccaggacagcacgggtcactgattccaagaagttgggaggaggacgtgggccccaccgacgcacaacagacccctccccaacttaagtgcactagttgtaaaatgtgtagctggtcaggggatggggggtggtctccagagctctgagggtcagggaagaggagaagggacggggaggagaagggacaggggaggcggagaagggccaggagaggagggggagacacacggggaaggaggaagaaccaagaggagggggagggggagggggagggagggggatagactggggagaagaagggacaggggaggagggggagacacacgggggagaaggaagaaccaggaggaggggagggacagtgtcgaggggcaggggaggagggagagtgaacggggagcggaggggcagagggagaggtacagcggggcgggaaagagagacagggaagaagcacagggaggaggggagggaaggaggaggaaaagtaggggggaggggatggggagggactgggaggaaggagagggccaggggaggaagaagaggggctgtggagggccaggggaggagtgggagagaccgggagaggtggaaggacgcgggggaggggagctggagggagggaaagtaccttcccgcgtaaagtccccttctgaaccccgaggtggaaagccctgacctccctgagccccgggccctgggcttacccggtaggtgctctccgtgagccggttcacctcctcgggcccccgggacatggctgcggccgccgggcgagcaagcgcgggaggacgcggctgggcctcgtggccgccggactccgggcagcgggagggccggggcgcgactaaggggctctggagggtcggccgccgccgcagccgtcggcccgagagtgcccgcgcgcgtctccgctgcgaaaatgtcaaaacttgcggcagcgccgccctggccttcttcgaggagcagaggagaagcggccggacgccgccagaggaagctgggcgggccgggcggccccacctgaggcgggcggggcagacgggggcggggccgcagggccggaggggcgtggcgtacccacctgaggcggcctggtgagcggggcccggccggggtgggcggggaggaggcggggccaggcagctggaatgggcgtggccagagggaagcgggccccccgagtgggcggggtcaccccacctgtggcggacagggcagcgaggccacggtgcgccccctcgcggctctcccagagctccggcgacgtagggcccgagaccctggagtggggaccggtgtggagtgggctgctcgctttgctgttttgctagggcaagggcagcctgggggtgtttagactgtggtcctggagcccttgtttgcctcgcgtggtgctggccccggggaccccgaggcccacttcctccatgagggcttccttcaagccctgcgttttggggaccaagggaaggggccacattccccagttgtattgatttccctgattgatctcttcttgccccgccgctcactgaccccaaaagttagagggacccgtgggggcatcggccctcctaggtggagaaaacgggctgccacttgcagttttgaaagctcctgatatatcaaaaaattaataaatgccagggtctagttaccgaaatgttagtacttttttttttttgagatggagtctcactctgtcgcctaggctggagtgcagtggtgcgatctcagcttgctgcaacctccgcttcccaggttcaagcgattctcctgcctggcatgagccatcctgcctggcccccagatagaagctttttgtttgtttttgagacagagtttcactcttgtcccctcaggctggagtgcagtggtgctctctcagcttgctgcaatctctgccccccaggtttaagcaattctcctgcctcagcctctcgagtagctgagattacaggtgcacgtgccaccaagccaggctaatttttttgtatttttagtagagacggggtttcaccatgttggccaggttggtcccgagctcctaacctcaggtgatccgccctgctcagcctcccaaagtgctgggattacaggcttgaaccaccgcgcccggcccagtagtacatttttaaactttacattaacaacgacctttaactcaatgcagtgtaaccatgctactcacgagattgttgtagggtttagaaaaccacctgagctgaagtgttagggaagcctctcttcttgtcatcactcaaactctgtggaggtgtgtggctcctgggctccctattttgtctccatcccggcctcagccctgcccaagggtgaggcagctgccttctttgggcctctcttccaggattatgtaccttgggctgggtgacagccttctccccagtaagaaccaccatttagctacctgagacccgcacccaacaagggcagaggtcttattctgattttttaaaacctctgggcttggtggctcatgcctgtaatcctagcactttgggaggccaaggcaggcggatcacttgaggtcaggagttcgagaccagcctagccaacatggtgaaaccgccctgcccccgtctctactaaaaatacaaaaattagccaggcatggtagcacgtgcacctgtaatctcagctactcgggaggctgaggcaggagaattgcttaaacctgggaggcagagattgcagtgagctgagatagcaccactgcactccagcctgagggacaagagcgaaactctgtctcaaaaacaaacaaacaaaaagcttctatctgggggccaggcaggatggctcatgcctgtaatccgagcacttcgggagaccaaggcaggaggactggttgagtctaggagttcgaggccagcctaggcaatatagggagcccacccccatctctgcaaaaaatataattaaaaacattagccaagtgtgatagtgtgcatctgtagtcccagctattccggaggctgaggtaggaggatggcttgagcccaagaggttgcagtgagctgtgatggtgccactgcattccagcttgggccacagagtgagactctgtttcaaaaaacaaacaaaaatgccaaaacgtctatgtgagtgcaattgcatcttttatgggctgttaagatgtgagacttctggccaggcgcagtggctcacgcctgtaatgccagcactttaggagactgaggcaggcagatcacctgaggtcaggagtttgagaccagcctgaccaacatggagaaaccccgtctatactaaaaatacaacattgaccaggtttgatggtgcatgcctaaatcccagctactcagcaggctgaggcaggagaatcacttgaacctgggaggctgaggttgtggtgagtgagatcacgccattgcactccagcctgggcaacaagagcgaaaatttgtctcaaaaaaaaaaaaaaaagaaaaagaaaagaaaagaaaaaagaaagatgtgagacttctaaactaatcttgtgataaagttcactaggaaatatacacaatgaaggcactgtgtggcccagatgggaacatcaagagggtgagtaccactggacttagaacagaaaccaccacctggacttggggactgttttattgggttttgcaaactataaaacacatcatgcagctaggcacagcggctcacgcctgtaatcccagcactttgggaggccaaggtgggtggatcacttggggtcaggagttagagatcagcctcaccaatatggtgaagccccgtctctactaaaaatacaaaaattagccgggtgtggtggcaggcacctgtagtcccagctactcgggaggctgagacaggagaagcgcttgaacccgggaggcggaggttacagtgagccgggatctcatgccactgcactgcagcctgggcaagagagtgagactctgtctcaaaacaaacaagcaaacaaaaaaaacttaccattcttgggaaccaaaatgttatgtcttcctgatgttagggggaaataacacatcagtcccaagtttctggcaatggaagcaggtgccttcttctttaacagatttacagtatttagttcatgaggtttgccaactgggtttcacttcccatatgggagatgcattcatgactttataatttctaccattatgtattcggctctgcaagtatgtctgttggtttttattgaaacttgaaaataggctgggcgcggtggctcacgcctgtaatcccagcactttgggaggccgaggcgggtggatcacaaggtcaggagatcgagaccatcctggtcaacgtggtgaaaccccgtctctactaaaatacaaaaatcagccgggcgtggcagtatgtgcctgtagtcccagctacttgggaagctgaggcaggataattacttgaactcgggtggcggaggttgcagtgagccgagatcgtgccactgcactccagcccgggcgacagagtgagattctgtcacaaacaaacaaacaaacaaacaaacaaacagtagtgcagttctcagctcagtgcttggcacatagatgcctgggaggtcttggctgaacaaaatacaaatgagtattgatgatctgctgtgcaggcagggagtctgctgggggctgcagtgtgcagaatgaactgggcttgaaccatgcctgtgcagaaggtagaatttgaggactacagtgaaagccatccaggtacagccaatcatgccataggtggacaagtggatgtgatctcaaaaggccatttgttttagactcttcaagtacatttgctggtttcatctaaacttgaaaatccacagtctgttattctgagacttcatgatgctcagagataaagaaggcaaatcaataggaagggatgactcaggagaaggtgagaatagcagcccttgttttgctgagaactccctgcagtctctttcctcctgcatagaagagctgcagaagagctggtctggcctctctgtaaatcagtccaatgccttcccagagacaggcaaccaagatctcctccttcagctcctacttcagcttaaatagagactatctccaatttacgatggttcacctttgacggttttgactttatgatggtgcaaaagtaatatgcattcagcggcaattgtacttttttgaattttgaattatgatctttccctgggctaggaatatacatcaggatgcttgcttgcttgcttgcttgctttctttctttctttctttctttctttctttctttctttctttctttctttctttctttctttctttttgtgacagagtctcgttttgtcacccaagctggagtgcagtggcgtgatctttgctcactgcaaactttgcctcccaggttcaagtgattctttgtctctgcctcctgagtagctgggattacaggtgcgtgccaccacgcccggctaatttttgaatttttagtagagacggggtttcaccacattggccaggctggtcttgagctcctgacatcgggatccgcctgccttggcctcccaaagtgctgggattacaggtgtgagccaccgcgcccggcagtaggatgctttctagcaatgttaggcaggtggagtgagctcccaggtcagctgtggcatcatgagggtaaacagccgatactgtgcagtgcactgtggtaccagatgattttgcctactgtaggctaatgtaggtgttctgagcatgtgtaaggtaggacaggctaagctatgatgttttggaggttaggtgtattacatgcatttttcaacttaatgatgttttcaacttacaatgggtttattgggatgtaacccctattgtaacttatagggcattggagtaaaaaatcctgtttatgtcaacaaagtttgtaagacacaatggcagatgacaatgtcaataagttttgttttgttttgtttttgttttgagacagagtctcactctgtcacccaggctggagtgcagtggtgcgatcttggctcactgcaacctccgcctcctgggttcaagcgattctcctgctgcagcctcctaagtagctgggactacaggcatgcgctaccatgcctggctaatttttttaatttttagtagagtcggggttttgccatgttggctaggctggtctcgaactgctgacctcaattgatccgcctgccttggcctcccgaagtgcttgggttacaggcatgagccaccacacctggccgtcagtaagattttgaagtccacagttaaaacaagttcttcttttggggtttctctcttctttcaaacttactatgtggtgtgccagtggcttcctttgccctggtgggtacttgagcaaggggaacccatgaagatctcactgtattttgtgacaaaagaggtccctgctgataacagtagtttggggcacattcctgtaaaaatactaataggcaggatggagctttaacctttgttactctgtcgcccaggctggagtgcagtggtgcgatctcggctcactgcaacctccacctcccgggttcaatcgattctcctgtctcagcctcccgagtagctgggcttataggcacgcgccaccacacccggctaatttttgtacttttaatagagacggggggtttcaccacgttggccaggctggtcttgaactcctgacctcgtgatccacctgcctcggcctcccaaagtgctgggattacaggcgtgagccaccgggcctggcccgtttgggttttttttttttttgagacagagtctcactctgttgcccaggctggagtgcagtggcctgatcttgcttggctcactgcaacctccgcctcctgggttctcctgcctcggcctccagagtagctggaattacaggtatgtgccaccacgtctggctgatttgtgtgttattagtaaaatgaggtttcaccatgttggtcaggctggtcttaaattcctgacctcaagtgatctgcccatctcggcccccaaagtgctgggattacagccaccacacccagcttttttttttttttgagacaggatgtcactctgtcacccaggctggaagtgcaatggcccgatctcggctcactgcaaccctcgcctcccgagttcaagtcattctcctgctgcagccttcagagtagctggaattacaggcacgtgccaccatgcccggctgatttttgaattattagtagagacagggtttcaccatgttggccaggctggtctcgaactcctgacctcaagtgatccgcccatctcggcccacaaagtgctgggattacaggtgtgagccaccgcgcccggccagagctttaagttttcttgttctgaaaggcagatgtgaatttaaaactcattgacttttctgtacttttcttctaatctcaacagcattgagttctcctgcatgccaagctcatttctgccctcgagtttttctttttttttttctttttctgcgacagaatcttgctctgtcactcaggctggagtgcagtggcaccatctcggctcactgcaagctctgcctcccgggctcacgccattctcttgcctcagcctccccagtagctgggactacaggcgcccgccaccacacccggctaattttttttgtatttttagtagagacggggtttcaccgtgttagccaggatggtcttgatctcctgacctcgtgatctgcccaccttagcctcccaaagtgctgggattacaggcgtgagccaccgcgcccggcctcctagagtttttcactagctatttcttctgcctggaatgttctcctccctgcccccctaccccaacccaggtatttcctgtcatttggagttcagtttagatgcagcctcatagaggcctttcctgaccactcaacctgaagtcgtatttgaggccctctctatcataccattctactttattttattttaatgtattattttattttttttgagacagggtcttgcaatgttgcttaggctggagtgcagtggtgcaatcatagctcactgcaacctcgaactcctgggctcaaatgattctttcacctcagcctcctgagtagctgggactacaggcatgcgctaccatgcctggctaattttttaaaaaattttggctgtgcgtggtggctcacacctgtaatctcagcactttaggaggtcaaggtgggagggtcacttgaacccaggagttaaagatctgccggggccacatagtgaaaccttgtctatacttaaaaaaatagttttagagataggatcttgctatgttgtccaggctggtctcaaactcctggcctcaagctatcctcctgcctcggcctcccaaagtgctgaaattataggcatgagccaccgcacccagcagcattctatgttaactctaatagtgcttagcgctagctatggcacgttgaataagggatccccaaagatgcccaagtccgaatcctcagaacctgtgaatgttcatgatatggtttggctgtgtccccacccaaatctcatcttgaattgtaattcccacagttcccatgtgtcgtgagaggaacccagtgggaggtgattgaattataagggtgggtctttcctgggctgttctcatgatagtaaatgagtctcacaagatctgataatcttaaaaacgggagttttgcctgggcacggtggctcacacctgtaatcccagcactttgggaggccgaggtgggtggatcacaaggtcaggagttcgagaccagcctggccaatatggtgaaaccccatctctactaaaaatgcaaaaattagctggatatggtggcatgtacctgtagtcccagctactagggaggctgaggcaaaagaatcgcttgaacctgggaggtggaggttgcagtgagccgagatgctgccactacactctagcctgggcaatagagcaagagtctgtctcaaaacaaaacaaaaacaaaacaaataaaaaatgggagtttttctgcacaagctctctctttgcctgctgccatccacataagatatggtttgctcctccttgacttccaccatgattgtgaggcctccccagccatgtggaactgttaagtccaagaaacctctttgttttgtagattgcccagtctcgggtattctttattagcagtgtgaaaatggactaatacagttcaccttatatagcaaaaaaagtctctgatcattttatacttaacatgattacgtgttcacaagtgatcacatgatcattttatacttaacatttttaggaactgctaacctgttttttctcattttctatgtcttggaagagtttatgaagaattagtatttactttatttaaatgtttgatggaattcaccagtgacaccaggtgggcctgagccttgcttttgggttgtttaaaaattagtaatgcagctgggggcagtggctcacacctgtaatcccagcactctggaaagctgaggagggcagatcacgaggtcaggagttcaagatcagcctggccaacatagtgaaaccccatctctactaaaaatacaaaaattagctgggtgtgatggtgggtgtctgtagtcccagctactcgggaggctgaggcaggagaactgcttgaacccggcaggtggaggttgcagtgagctgagatcgcgccactgcacttcagcccagacaaaggtgcgagactctgtctcaaaaaaaaaaaaaaattagtattgcagtctttttactggattagatctttcaatttctttttcagaatgttacttccttatagcttctattcctgcatctctttaatcacatacaatattattttatagtctctaccaggatagttctgtgtgcttttgtttgctttgttttgtttggtttggtttggtttttattcttactcagccattgttgcgtctgctggttccctatcacagtggagtttttccttatttgtttcggtaattttttattatgaggtcatctttggggtggaggggggaagaacctttttttttttttgagaggaagtctcattctgtctcctaggctggagtgcagtggcacaatcttggctcactacaacctctgcctcccaggttcaagcgattctccttcctcagcctcctgagtagctgggactacaggtgcctgccactatgcccggctgatttttgtatttttagtagaaatggggtttcaccatgttggccaggctggtctccaacttctgacctcaagtgatccacttgcctcggcctcccaaagtgctgggattacaggcgtgagccactgtgcccggccaagaaccattttttctataagaatcgcttgtggcccgatttgtaaaatattcctccagaaaagttttacatttgtctctaccatgcactccaagaagttcaccacgagattcagcttctgaacctgctccgtctcacaggcttggtgggataatttctcttaggatattgtttttttctacccagttaagtcaagctcccttgtcctccaccaatgccaataaatattttctttttttaagttttttgagacagggtctcaattcattgcccaggctggagcgcagtggtggaatcatagctcactgcagccttcatctcccaggctcaagcgatcctcccactttagcctcccaagtagctgggactgcaggtgcatgccaccacacctgcataattttcttgatgtttagtagagacggagtctctctatggtacccaggctggtctcaaactcctgagctcaagcaaccctcctacctcagcctcccaatgtactgggattagaggcatgagtcatttcttccagctccaaaaaggattttcttttcttttcttttctttttttttttttttttttaagatggagtctcgctctgtcgcccaggctggagtgcagtgatatgatcttg

SEQ ID NO: 180 - DNA, 59185 bp, Homo sapiens
tccaggccttggggtcaaaggtggcccgtctcttgagccagaactcacccacctcctctgggcgtgatgggataaagcagaacatgaagcagcggcactggcttaccttgcagggcaccgatatgtctgtgggattggggatggatggtagggttaatctgataggaccttgccttctcatgccaaccccatcctccatccccaccaccccctatgcacgcagacatgctttttttttttttgagatggagttttgctctgtcgcccaggctggagtgcagtggcatgatctcagttcactgcaacttccgcctcctggcttcaagtgactctcctgcctcagcctcctgagtagctgggactacaggtgcgtgccaccatgcctggctaaattttttgtatttatttatttattttttagtagagacggtgtttcactgtgttagccaggatggtctcgatctcctgacctttgatccacccgcctccgcctcccaaagtgctgggattacaggggtgagccaccgtgcccagccacatgctctctctcatacttcccaagacatgacagagtacagttattcctccacactcgagaggggctggtcagttctcccctacctgagatgatccggtgctctctcaacaagtgtccacaaaagcatctggactcatccccaatccggaaacagtcccataggtaatgggggcagcgccagccaatgtagagacctaggtatgcaggattaaaagtgagaagtaaaaaaattctaagctcccccgaagtgttcttacctatcccttgatggaggtgagggggtggggggaacttacctctccccacccccaggtatctttatctccacctggaagtcctcacctctaccccttagattttctttttcctcagggttttctcattaccccagaagtgtcttcagttctcttcctacccaggatctactccatctttgtcagcctgccagagatgactcaagagagtggtttctgagcaggaagattatagatgaaattttgtttgaggatgaacatgaatctcactgagttctctgtgaccacagggattctcatctcctctcctcatcccactaaagcccaactttgctttgttttcttgaagtgtctaaggtgagggaaagggaagatgattggccagatgtacagacaatgggattggctcctaaggagcatatttattgaaggtcctgaagaggagaaggaggttggatagctctggtgctggaaggtaggaggagggcttcctctcacgtctccacgttggtaccttaatacctccctctgtgttcctggtgctattgtaccaatgctctctgtgtacctaagaagggctgccaaaggttcttcaagggtcaggagaaaggggtaggtagcagtcatgagtggtgaagaccaaaaattatatattttgaggctaagcaaggaggcgtggaaaggaaagtgaggctaagaagtgtccctgagagtaggcaccagcaagaggtcacaaccctcgagagctggtgttcagcagtgaggtctgaatccctggcttcgtgactagtcttgaggtgagggtggtgctgtgcaactgagggaggataaccagatggcacctccaattcagattttctcattctccatgagaactgagagtaccccaacttctagccaagaatcctgtatgaggccccatgcagtgggactgccaggtgtaggattcttagtcccaattaaaggctcaactgaaatgtcacctccaccaaaaaggtgtccctgacttcccctgtctgtctgggcccctcctattgccatccatagctccttgtgctactcctgttgcagtacactgcattataatagatcattcccttgtattcctattagtccatgagttcttcaagggagctgtcttttcacccgtatctctcatcctagcacaaggcctggcacaaaatggttgctgagagaacgtagattgcctgattaaacaattgagctcattccttcaagaggaagagagagccagtattcaggcataaccctgaggttccataacatgaataaggagagtggcatcatctggtctttgactgtggtcagggccacaattcacaattccgtgcctcagattaagttttcttgtcttacccatagtctgtcaggatctaaagcctgtctagatgtggcttttggctttgcttcttctgtcttgatgctgattgcctgtagtgccagtgcccccttacaccagggaggctttgttgagagagcaaggtataggcagtcacaatgcaggtgggcgggagccaggattccactagaggagttccgaattctgtctggagtagcaggatacattaaaaaagcaggaggtgaggcccaaagatcaaggcctgctcggagggccggggggcagtcaagtccaagcactagtgtaggaatcagtgcccagcattcagatgaagaagactggagtttgaacagggagactggcaactatacttcagattctgttacaagtgttagtgctcttaaagtgggacaattggaaggtggctgtggattccagtgggaccctctactctctgtcctgattccaaactcccttcctgttgtgggtggacaaggcctggcgggggaggagacattatttgggatgccattttgattctgtctaacacagtccagttccacaatcacataatcacatttgcatgatgacatctctttatgcatagtatgtctccataaaacacatggctgtctttacaggaacaatgtctccagcctagccctctctcctgagcttcagacccatatagccagctgtctactagactcttgggccagcatgtttcataagcacttcaaatgtcttatgcccaattattccctccaaacctggctctcatcctttgtcctctgttcatccaacacatgcctaccaagcatctacccttttctaggcattcagttaatggcaccattatcctaccacttacttatgccaaaaactggtggcactccaggcatttccctctctcttatcctatacatccactgttccaatggtcagtttcactttgttagcttttcttttcttttccctacttttcttgtttcttttctttcttttttgacagagtctcgctctgttgcctaggctggagtgcagtggtgcaacctcggctcactgcaacctccacctcctgggttcaagcaattctcctgcctcagcctcccaagtagctgggattacaggtgtccgccaccacacccggctaattttttgtatttttaatagagacggggtttcaccatgttgtccaggctggtctcgagctcctagcctcaggtgatccaccccttggcctcccaaagtgctgggattacaggtggtagccgctgcgctcggcctgttagcatttcttgaacctgtccacttctctccacctaagcccatctacttctttcctggttatgaccagtgcctcacaatgtattcacttgcctttccatacctcctctcttagcctcacaactccagtcttgtctttctccagtctaccctattgccagagtgatcttgcagaaacagaaattcgttcatgttattgtcctacttaaaaccttctagtgactctcagttgccctcaggatataattctagcttttaacttggcacagaaattcctgcacaattctgcccttctagagcagagtgggctcttctccccaccactctatgcatcaggcatagtgcattgctatagattcctgctgtgccttgccctgtcatgtctcatcttacagcactctttacttggccacctcttcttactcatcttacagatatcagctgagaagtcattccttccaaggcttactattcctcaagcactccagataagatgccccttttttttctgctcatgcagcagtctaggataaccttgattatagcaattattagagtgaattataattgtccttgtacttattggtatctctcattagagtgccaagtattttgtctttgaacccccatcagcattaccacttccatagctagctcaatgcctggcacatagttggtgctcaataaatgtttgtcgaatgaataaaaacaaaggttacacttgatatttctgtacacatcacatatactgttatggactacccaggactcaacatccccactattaggaggggacctcaaatataattgttcggggttgaatgacatgaatttctttataaaacttcctgtttaaacaggaagatgaagaagttcaatttgaagaagaaaaagaaatacagtgggcttgaggagtagggagtagacaggaggttctgagtaggggaataagaggactgaacacatcctgcatttttttttttgagacattctgtcacccaggctggaatacactggcacaatcacggctcactgcagccttgacctcctgggctcaagtaatctgcccacctcagcctactaagtagctggggccacaggtgtgcaccactatgtctggattattttattttatttttgtagagatagggtctcactgtcttgtcctcactgtctaactcctgggcaattaagtgatcctcctgcctcagcctcccaaagttttgggattacagatgtgagccaccttgccagccagaatttgcaagaaaataagagtaaccgaatatgttaacataagcaaacaaagttggtggtggggcgggagggcaagggtggggaggtggagggtccctgcatgggaaaggggaaagtaaatttcatggaggagggataagcatttagaattacctgcttgtctttatgttttaggcctgtcatcgtagctctattcccatcataaagggaaaggaagtatgaaggaccaaaataaatgtcataacatctattgaattcagtctagaaagaccagaatccttatagcaggtcagggtggccctcttactgaaggtaatccctatagacatgaatttccataacacaggtaggcatgctcatgcataggatggcatgtttttgcaagttcatctgtacgcagcatgccactaacaggactgtcaagagtactaatcacaggctgaggcttggaaacagcagggccagaggacacaggtctcccctttggtaacagaactcaaagcttttgggtacccagcatgggcctggcatgcaggggtgacagccttttaatggagttccaccaaagggactaaggtctttgtcatgtcagaacagcaagtctcctggggactgtccagggtcctgggccatctctgctttagggtctgtaggctctctgggccctatatctggggtgggccatgacccttctgtttttttttgttttttgttttttggtttttttttttttttgagacggagtctcgctctgttgcccaggctggagtgcagtggcgcaatctcggctcactgcaagctccacctcccgggttcacgccattctcctgcctcagcctcccgagtagctgggactacaggcacctgccaccacgcccggctaattttttgtattttcagtagagacggggtttcatcgtgttacccaggacagtctcgatctcctgacctcgtgatccgcccatctcggcctcccaaagtgctgggattacaggcgtgagccaccgcgcccagccgacccttctgtgtttaataattttagttcagctacctgtctctacctgggctttatatgaatctccccactttttgtctgcatccacccttgtattccttggcccacttgcctgctccttttccaggcaggtggtatagccatttccaaaaggggaagctatctgctgaatgttcaggttcccagatcttttggattagaggatgcccatgggcctgtcacaggcctctgaaaggccacatgggctcacctgtctggatggcattcagggctgcatccttctcccactggaaaagattgttcacttgagcaccaaactcctctctatgcattgccttagccacttccaccagctctgtctgcctagcagggaacactgggcgggctgtgttacctaggatgggagaggatgagtaaccagggggaagtgagaaggccctaaaactaagagaaggggccatgtccaagagtaacccagtctcctcctcctggggcaagtcaaggacagtgaatagtagtgagaacaggacaggggagaggacaggtacaattacagctaactcctttcttcttcttcttcttgcctagttggtgtccaggttgggctgtgtgagcagtgctgtcactggcatctactcccttttcaacctctcctgcttcttcctcctgcttttcggttgtgtccacttggacctgggatgaagggcctgaaagacagtgttctggaaggctctcagattcagagagatgggtagacctccttgtccatgggacctcattggaagaagactcagaggagaggtcttccttcagagtatcagaagaagacagacagacatagtctcgtgattggggaggaagagtaaggtgtttctctggcaccactgagatgggactatccaatgaagcctcataggtaggggtctctgaaggagtctcagagatggaaggctcctgatgggtttcaggggaatgggcctctaaggggatctgggaaggggatggcaccaaaggggattcagaggtatggggctctaacggggtctcagaggtggaaggcttcaagaagctttcagagatatggttctcctgtaagtcctcagcagaggggtcctttgaaggggggtgcttctctgcatccatggtgatatgaggctcttctatgatctcatgtgcttccatctagtggtagaacagggtacaggcttcattaggttggaaatagagggccggcaagtcagggcagagcccagggttcgcagtgcattatggaatttggataaggatatcagtgcagctgagatataagagggaaacaacatgaactctgggtcctagagtgtgatgccaaaaggttcacccatgtgtccagacctcatatggcatgctgctgtggcttgttagggagctggaacttaaagattgaaagactgaagtagttcgaatcccatcagtagatggtagcagagaaccatgtcccaggagggagtctgaacaacaccacttgggcagtccaagagcagggtccttggcatatcttaaaaccctggaggtcagaccatggagttctagagactggcaataccaagccaaagttggggttggctcctgagagtgcaggggaatgctgtcacataaggcaagacactgcacgcagcctggttttgtctaggcaccacacacatcctcctcccttaatgatgtcattcatgttcaaagctttaactacttccagttgtgtaccaatgactcctaaattcacatttctagctcagacctttttcaacctctgtacttcacactcatacccacctgcctgctggccttctcttctcttctctttttgtgatggagtctcgctctgttgcccagactggagtgcagtggcgcaatctcggttcactgcaacctccgcctcccgggttcaagtgattctcctgcctcagcctcccaagtagctggaattacaggcgtgtgccaccatgcccggctaagttttatatttttagtagagacggggtttcaccatgttggtcaggctggtcttgaactcctgacctcaggtgatctgccctgcttggcctcccaaagtgctgagattacaggagtgagccaccgtgcttggcccctgctggtcatttctaactgagtgtttccacagacagcaaaactgaactttgggaattatcctagtcttttccttttcccttagactccatcttcaaataggcaccaataactctatttcctatcttctaaatattccccaaatgcattctctcctctcccttccaattttattcaagttctcatcatcttcagcctttgtgtaataactttgcccctctacttccatccacagcattttaatccattcacccattctttcatggatttatgtaacttatacttttacaatgagcctaatctgatgcttttactgacccgctgtgctaagctctagattgagttgagtctaggagagagaccgattaaccaacaatggcaatacaaataaattgatgttgttctggggtgagtctaggatacggtggggagggggatatacctaatttatcctgcaaggatgtagtcctccttcctgacccaatcaggatctttctaaagtgcaagcccaacaactggcactttgtggcttaaaaacattccatgactcagtctaaaggattaagtccaaatttcttggccctggcattcaaggcctgtcatcattttcaacacagcctgaggattcctgccttaactttccgtgctccctactttacccccatgttccagagacgctagatatatcactccttaaatgcatcagagcctttttgaaggggatgtttgggaagggaattaggggcagaggtaggattacagggaggaagatgaccagagtcagctagagagaaaaggggcctaagagtggagaaccagaagatgggaggtgaggaaggggaaagagaaggggaggaggaaattgggtggaggaggagagtaaggatgaaaagtacagaatgtgggccaggcatggtggctcatgccagtaatcccagaatttgggaggccaaggcgggtggatcacttgaggtcaggagttcgagaccagcctggccaacatggtgaaacccagtctctactaaaaatacaaaaattagctgggcatggtggcaggcgcctgtagtcccagctactggggaggctgaagcaagcaaatcacttgaacctgggaggcggaggttgcagtgagcccagatcgcaccactgcactccagcctgggggacagagcgagactctgtctcaaacaacaacaacaacaacaacaacaacaacaacaacaacaactactactactactactactactactactactactactactactacaacaatgtgaagggactgaggggtgggagaaagacagatgtctttgagggaagagggcaagggccgttggagaaaccacctaccctctgggctttggcttggttgttacaagtccttaggtcaagaccttgacttaggatggcagggggaggtgttgatcctcagggaggaaaggctcttggttgtggatgtgcctcagctgcaggtgctgagtgttgaaatgccttgcctgaaagtctgctatctgggaaggggacttggatatctgcagaacttcgcaaaggagctctggcatgacctggggaagtgggtagggacaaggggtctagggccaatgagggagggtcttgactgaagcctccggaacccgggccaggagagtaggcgccggtcaccagggcaaccggaacgcctagtagtctccgtggcaacggcggtctggtcacctccccggtgggtaaggtctcctgaggggcttgcattgggcctcgagggggcgagcccagagggtttacttctgaaaagtggggtgtgtgttgcgggatctctgtgagcgagtgtttgggtaggatctgcggagatctgtgcgtacgtccgggggagtctgggattgtgaggatagggttcctttgagacatctgtggggcggtcgttgggggctgtgaggatctgaggggacctcgggctctgtgcttggggtgagaaaggcagggtctcgggtagctgaggcgggggcggagtctgtgtgtcctcgaagcccagcaggactaagttggggaccaatagagtagggcgggggcgggctttactgacagggaccaatcgagccggccggggggcggggcgtcacgccgacgtcaagtcgaggccgccgccgcggggcctggttatcgccggttcagcgcagcccggagtcgcccaggcctgaactcctacccaggtccccggcccccgccccgggcccgcgaggacaccggaggccaccccccgggggtggggagcggagccgcgggccagctctgcgagcgccccgcgctggcctgtccggccccgcccccgccccgggccatggcccagcccttgtcccggcccctcgtcctatcccaatccccgccttggcccccagccccgccctcgccccgcttcccacatcggccccagcccctgcctgggtccccatccaggacccccttccagtctctgcccctggcctggcccccatcccggcctcggccctcgttccaccccctgtcacaaatcccagcccaggccctgtcccagccccattcccagtgtttgcttaaggccctggctcaaccccgtcccttgctgcagtccccatcacagcccttccttccatcccactccctgcccttgttcaagccccagtgtccagcccagcccaacccattatctcagcctttgccctcatctctgtgtttacccaagtctctccctctagtcccccctatctctcatactctgcccctctcccagcctagactcaagtctgggtttcagctgccgccagccctattgctgctgttgctgttctctgtccttggcccaggggctggtgagtgcagaagcagggaagattgaggcaggaatggggttccggcagggaggggtgggctggagagattcaggagaggtgggacctggggaactagatcattggggagcaagtgggagaaatagagagtagagaggtcttacacaacagggattggcagggtcaaaagagtggtaattaattgggtttgaggctcagcaggtggcttacagtttctagcacagagactccaagattttttctggtgtctgtcctgaccccactttgactcttgcttttccagggaaatgttgtgggctttgctcctgctcacaaagtttgatgggggagagacagtcccacaccagaagcccctagtgtagtgtgggaatatatagcccaaacctttgagatattgggcatgcattcaaacggcatgaagaagagttttaaagataatatgtagcaaatagatgaatatggattagttgccattataatgagttttcttcttgtaatgattcttgttccaaagaagattgatttgcctaggaataattcctgatacttttagagcagggctgaaactcggaggctattttacagatggggaaactgaggctcagggagggagcaatttgtccaaagtcagagagcttgtgaatggcagtgtgctggggctagaaaaaaggtttcctaattcctatttcatactagtgtgtttttttttatccactgcaatgtatacttaatagaaaaatagacccaagtggggaaaggctcaaagcataacctcccttctccccggtctgcccacaagggtgctttatccacaaactgttccttatttgccaggcgtcagccaagggccaccctccggtggggaagtgacttggacagaagagagagaggtccaattttttaatggttggaatgtgggaggaggagggggtgtcctggtctaggggatgtgccatgaagatggctccatcatggagtgactgtagtcttcatggcccaagtctgtagccacctctggtgggtgtcactctagataggatggagatgtgcctgatggagtctttggaaataacagccaacagaacagctggggggtggagaatgggtatcagtgagctctgggggcctggttcagtgtacaaacttaaggagacgaatgcacgtgaaaggtcacaacccctgcagagatgtctggtcacttatgtgtatgtgtgtaactgagggattgtggggaggctggcagcatgtgtacatgcttgtgtgttgttaagtgtagacacgtgcatgtgtgtggggtgcatgtgagccagtgtatcttctgagcgcctgtgttatggtatgaaggggaggggacatgttgtggcccatgtacattcctcttcagctctgcctcctcctcatatggacagatcactgaagctgtgaatggggctggagaccctttctcagcagttccaagggtgagggcagtgttgcatgcctcccataacgaatataagttatccatccatccccagccagtgcctttgaaggaaggagctgtggaggcactctgtgttgattactgctgctggcaaattggacactgggcagaggcagtagccagtcaggttttcagttttggtaaggggaagtttatgctgttgggccaagttcctagcttccatcctctgccatcatggcttcttcatgtgcccattgagcaagcattgggctggtgaggggagcagggtgaccgacagccacagagcatatacagctgaaagttgtggataaaaacactgttgcccagaagcaggttcaggtgctttggggagaattgtaatgaagttggaaaagagtaccaatacacccaaatggaggcagggctgcctttagtgctgttaataatgaatgccttggcaattttggaccaaagtacagggtgctctgtgacctaatggtggtgatgggttttgtctgaggagaggctggcagtgtcataggaccatcatggcacagggctgcacagtgcttattggttgcttcggtttcatttcaggaatggaagttatctcttgggtctagtggtcccactcctgatccttggatcttttccttgggcttagttgaggactcacacgtgccttgctattcaaaaaaaaatgggcttttattctacctagtgctattactagcagggccagcctcagcctatgtgtgtaggtgtaggggtgtgtgtgtgtgtgtgtgtgtgtgtgtgtgtatgtgtatgtgtgtatggggtgggtgatggtcggaattaccctagcttcatcatagaaatattggggaacctggaataagttcatctgaactcggtaagggccttactcatgcttcttctggacacagctctggtaggccctgttcaaaccgcaaaccaaagtttggagtgaatggggctgtggaccctttctcaagcatctgccctcagaacttcttccaagttcctcctagcattcccagctgctgctcactcctttatctcactggcctattctgtgacctctgtagcccctggccactgtggggatggcttagctagttccccagttccccaggccatactgtgatcctttgaattacaaggatctttgtgcttgtctgtccatgtttcccaaaggtcattaaactgcttttcaccactagccctcatctgagggtctgcaccgagggactgaccaacatttctcctaacggtagcaatggttgatcagatgacccatccctggtaccagctttgaggaggatcagcccttccctaaccccagcagaaggtgcgctagagttctgatttcttctaacaatagtatccaggctgttcacctcttagccttctgcctcctacttagcacagctagggttcctaggaaacccgtctcttccatcagtcggtcccatttccctttatccctctcggctgcatctctatcactctctgaatgctgcactggtagcctctctgggttcctaggcagtgctcagcttgcaaggtgacaggttttccttcctgacagttgagactgatcatgtggtctgaactggacagactagtccttgagtgtaaccgtggcctccaatggcccccacctatgtagggcagctctctggggtgactcctggggttgctctggttcagtgttcgtccttcagcagcctccccttccctttctttgttatttcaaaaacacctcatttttggagttaatctctcccatctccagagagggagatgattggactaggttagccctgagggtatttcctgcttggctgaaaatgcccctccagagtagtccttattccagccccgggtctgtcctgaagctgctgagttccccaccttctcacctgtcctggaggtgtcatcttgggcttcttttctggctggtccgaagtctccagagcagtcagattccctagaggtttactttgagagaccttgcctgccatttgggaccctcttcccctgtctgctactggttgcctccactgtgacagctattctagtcccttgcctggctagctgctgacacaacttctgctcaccttggctctgctcctgacaatcatgatcaggtatcttggcattttaatgagggatgaccacttcctccccacctcccaactcggcctgctctgaatattcccaaggggcttgaaatccactgggtcactaactcactgcctcactgggcttccctttgggggaacattcccccggcccccacctactagctgtgcattctgacctgggaggcctgatgactctcctttcctggggactctcatggtggcctgccagctcctgtccttgcttttgccacccaagcaggcccctggcagccgtaccacactttcccctcccctctcctgccctgagccagtatacaggcagcgcttgtgaggctgctgagggtttttactgctcctaaccacaggggaacagaaaggggaagaaaatcaacaaggaagttacacagttccatgctgactcccaagccccacaggtggagtttcagcctgctcagtggcttaagacgccatgccaaaatacacacacacacacacacacacacacacacacacacacaccttccacacatctgttttttttaggtttggtaagtggagaaaatggctcctaagtgaggaggcagctgtgaagtcaaagggtcttagttttggatttagagagagctaggtttgcatcctcagtttggtctaggtttgagcctcagtttccttatctgtaaaaggagggtttttttgtttttgtttttgtttttttttaaataagattaacgtaaggattaaaccagatgatggctaggtttcagatctgcagcctgaaacccagttcctggctcagaggagagcatttgtggagttgatgctattggtgaggaagactggcatgcctgttgcttaatggaaatgccctctgtcctgccctgctcctttctctctctcctgcttcccaggaggccttttcctgactgattactccacctgctcaccccgcaagctgagtcctttccgctcctttgccagcaccgagctcttccacttccatgttcctgaggacacattcctggctgtttggaacctcatcatcttcaaggagcaagggggaacttttggggaccactgcccagaccaaagtgtgactgtgtgagtgtctgagttaatttcccaaccccacttccaatccctgaccactttccagactaaagtgtgactttaactgacctcccgaccctgaccccaacccgcgtccagattgaagtgtgactgagtgagggccatgacctctgtcacatgaccacttccggactactgtatgactgtgcaagtgcttgagctgatctctcacctgtggcccctgacctggaaccactttgttgaatgtgtcagtatagggaatctatttgttttatcggtgaagagtgacagttcttttctttctttctttcatttcctgcctcccaccccattgtctgctttcctcctctcctaattctggtcccccaggtatttccggtccggggcaccccctgtcatcaatcccctgcatacacacttcccaggggacacagctgtgcctggggttttctcactgaccctcagctggacactgcccaaccgcacctcaggcatctttaacgtcagcagccccttacctggggactggttcttggctgcccaccttccccaggcccacggccacatctctgtcaaggtgggttgatgttgcccaggctcgggggtccagaactgcccttccatctctgctgaattccccccacaggctctctggcacaccagccttgtgtcagggtgggcagcagcacaagggtggctggggcggggcatggctaaaggccagcaggtcacccagtgggtcagaggccatgatctggaggaggcaacttggcagccccaggaggacatgctgggtccaggtaagctgaagggaaagttgagaatctggagtcagaggctctggcacaggggagtagtgccgcctcctagtggaaggcacaaatgttaatcaaggtgaacagaagccagctatgggctggtccaatctgctgcacacacccaggactggttttattttacatcttgattgacaatagccctgaagactctcttaggccacggcccagtatttagtccatctgggagaatgtattcctcttgcatcataatttcagacagcttcctacacctttcagaagaccacaagagaagctctttcctgctaaaaggaggctttgggcagctagtgtccatcctggcctttgcctcacttttctccaaatatcagccaccccaagcacttatttcacagaggttgttaaagactgaagggcaggttcaaaggtcagatgtctctctggtttggagtggaaggaaatgctgcaatgttttcctgccactctcatggattaggccagacaggtctcctattcctgttcactggaggagaagcagggggtgtgctgagctggctgttgtcagagtgggatggccacgtgcatggggcctgtggtgagggtgaagaaacgagcaagaacagagtgaggatttaaagaagaggactcttagcactcagaaatggggtgaatagtgcctttgaatgagctgagactcacataaggacaagggtgctggcactgctattgtcagagatgggaagtagggctgaggtagtgtctctaggcctcagtgacagggccgtttttcctgagagtgatgtggatgtgcaagagaactccctatcaaggcctgtgagcctgctgaaggacagcatgttgggagctagcttggaaagggccctaggttctaggtaggccttgactctcatcagaactgagggttcttctgttagaaggaatgccttcgtaggtctttggcaaaatcccaacagggatgttctttatcccaactctgatccttgacccactttgtaagaactgacagggaaaatcctcctgaagcctggctctagttatccaaaaacctttctaggtgagcaggaacctagggcctaggcctgggctgggattgtgggagctgaggcccagttagaagtggtcaggattgcttatggctaccagattgggacaatggggaatagagatagtagtgcagagaaaagctgctcagaccctaaagggtgattcaagtgcccagaccaagggggagctgggcagtgaggaaataactaggtctgacatgtgcatttgcatctagacatgggaagcggggcctggggaacttggtaccaaactggaaccctggtcagagcttccccaggtgtgtggtgaggctagacagaagaggaccatcccaccgtgcccacgagtggcagtgggtctggacgccgtgagagatgtagtgcttccatcagccctgtttgagaggttgatggggcaaggatcttgggtctggtccttctaagaattagattaacttctgtagtcttatatggtcctcaaagggttcttcagctctccagatcctggttaatttccaggattccagcctgtgggttaattgtctagagcattcctccatcttctcaacttgtttccttcccctactatggcatgcttcctgtaaggcttgaacacaggaatttatgtgggtttagggttatcctttggtgggaactgaagagtcccagcgataagaaggcagtgtgtttctagggtccttctcagctttggggatgagctcagatctccctttagccttagtcctttagtacctgctttgtgccaggccttgggttgtgtgctggggacacagagaaaaataagatgcatgtcggatataggaaatgttttaggaggataaaggggagatggctaactcagcttgctagcgtggtggaggtggtattggaaactgttaagcggtgaggtctgaggttgagaaggcagggaagggcattccaggtggtgggagtagcatggcccaaagtttagaaggaactgaagtggctcagtgtgggctggtgttggggtggtgaggaaggtagagggttgagcagaggccagatcacgaagggccttgacatttgaactgtatcctgagcgtgatagggagccctgaaaggttgtaaaaaagaagtgacttacctggtccgggccaccctcgtgaactctagtcccacacttctgccagaccctgtgtctgtgttatttactacgtattcctagcctccagtgcagagtctggcacatgatgccttttcacgtcctttccttgtccctttcttcctatcagccactctgtcttgtccccggcctccatctccttgcctttcctgttttggatcgtgtgttcattctaaggtgcccagttgccagtctgctctggggggctggcctttgggttgtggataccatttggcacccaaatggctcatgaggggaaagtactcccaaatgtctagagtgcaggttctcatccttcctcttcctgtgtctaagatttgaaaaagtaggtaaaataatgaaagcaactacgaggaaagtgaagaagtcgactgtacaggagaaaggattctgttgaatccaccgactaggaccacacgtgactcaatatctcagctgaggtggttagaatctgctaatagtgcagctgcttttcctcctcctacattagtttatttattttttgaataggcaatccatgcacctggtacaacattcaaaaggtacaaaagatatacagtggaaagtaagttttcctcttccattcttccagtctccaattccccgccccagagttaactagtaactagctgttaactagtcccctatattactcttttctttttgaaacaccttcccttcttggcctctgtgactttacagaactgtcctggttttcccactgcccactcctctgtctcctttcctggcctctcctctgcttgatctccaggttgtagtggcccaatgcttggtcctcgaacaattcctttttcacttttctattctcttgcttggtgttccagcacaataatttaaaataccatctatatgttaatgcttccacgagtattcagccagtcctaatttctttgaatctcagactatatcccactgcttacttgacatctccaactggatgtctaagaaatgtctcatacagtatttagtaaaatcaaatcaaagtgaagctaaaagtataaaactctttaatttccatttcactgctcccagtccatgcttctttctctagtcattgtgatcttcctcaggaaattgtactgtcatccacccattgctcaagccccaaattaaatgccccaaatccttgatttttcttgtctccttattcctcacaagcaatcgtaaagaaaaagtcttgttgacgctacttctgaggcatgccctgaaggcttctccagctcttcatttccacttctagcacagcttctctgctttctccagggctaccacagtagcctcataagtggtcttcctgctttcacccttgccccctgaaatctgtccagcactcgtttgcttctacactgattggtgctttctgcctctgggcatgggctcagctgtgcacttgctattcccgcagagaaggctaagtgtctttgggcatcttcagtctgcaagccccacccagagcctggcactggccagcccactcaggcctttctgaagaaacccagcccatacatacgaggacattgtaggaatctatctaccatgccttagactccaggatctttcagcctgtagcccatccacatctcacttttgcctctcctagtttcttgagcttccttgcctgtgccctgggcctccccgactgctgatgttcttctggcctcttggctcagctgggactctctcacctggtgtctgccctggcagctcttgaggacctgacttccggtgctctttctctggtcccatcactgggtgacggttccctgcatcttccctggtctccactgactaaacactccctctgcatgaagaggggggactggctgtgcacgttacacagttgaaggaaggagcacgtcttaaccaaacaggtcatgtccactgatctttcattgaatcaaacgcaagtaaaactccaaaacgtggagcaaagtgttccttccctggactgtctagcaaggaaatgggccaccactggagcatgagcccccacccttgggactcattcactacaagattattgtggtggtgattcttgccataggaggtggggtcagtgcagtgacttatgagagtcttttggttcttcgggtttgacaccaaacctgagcatctaggttggttcaggagctctctgaagggaccccctttttgacacccattctttaacagctattttagcacctagtgtgtgccaggtggtgtgctagacactggggatgcaaaaggcacagaccttccagccttttggagctttgctggaagtcagtgccttggctggcttgttctgagccatggaactcagtgggatgtcagggcctggaacttttgtcccagaacagagtttgaaggtatgtcctaattaggagcccccacctccccttaactgtgaggtctgtagggctcatatagctgcacgtgctgcagaagaggaactgcgacaaatgggactgagcttactggagagtgatgaggctctgcgagccatggggtgtcaacagagaaggagctggggattttctccagaagagaagctgggggagacgtggttgatctcctttagcagcagaagaaacacagtctgaggctgagggaccagacggatcagtgggtcccttgaaggcagagttggggcaggggcatcaaagatgacaggatttggctttagcaaggtcagcgcttcccccaggtgggatgatccatttactgattgattaattcagcaaacattcatctgtgaggtatgcactctatgtgaggccctgtgtctggaggaacaaacatcaaataggacagggttcctgttctcaagctgcttatagtctggaggttgcctgggaagtaatgagtggccctgcactcattacctgtgtagggccgctcattacctgggtgtaatgagtgtgaaagcagaggctggacaagcacgtgggagcggggcagggtgaggactaaaggaaattaaaggttgagattggtggcggggagagtgagggggctggattggaggccttgaaagagctttccactccaccccactttgcctaaaagagccagtgttctaagttcctgagcctgctcagggaatgggctggttggagatcacagtgctgctgggctggcccagaatgctcagggggaggggttagattgggagaaggggcaagccaggcctgattgtcaggagggcctgggtttgaatcccaaaacctcagccagtgctgaggatcccagcagaccttgcagactgaggtgggacagagatgaccagaaatgactgctcaggcaggaaggacctggaatttagagagacctgggttagaggcctgggagtggtggccggggcgggggtttctccccagcccgcccagcaggttctgtttgccttggtttagtcacacccctgctgtctctccctctcctgccacccctgcttttgtcccagggtctccaggatgagtgtcagtacctccttcagccgcagctgattgtccggcgtttgctggacgtcgctgtgctggttcctggccggccctcagagcaaaccctctccccacacaatcgctcagccctgtacaagtaagtcaaagactccccacacctggtcctttccctcttctgtggcctcatacaggctgcagggttctctcttggcttctccacctacctgcctggtccctgggtgggatccctgcctccctccctcccagcacagagcgggagacctgaacaggcctccttcccaccctatgccccctccttcctagtgcttcccttgccctgtgttcctctcgcctctgtttgtgccttcttacccccaacctctcctctgcccagggtctttgtgcccagcttcacttacagggtttcagcacagctggtgtgtgtggggggccgtggggtatctgcctgccccctgtcactgcgtctgcgtcccaaagccccacccctgcacaactcaagctctgtggcctgtggaggtgcctcaggatgccagctggagctggcactgcccccctgggggcactgggtctacgtgcgtgtggaaacatcatcccggggccctggtaggaccatccgcttccagctgtgtgtgcggttgcaaggtcagaacccctgcatttgccccagtctgtgtagacatctgtggttgggaagtgacttgggtggctgtgttcagtggccctctgccatatccctacaacctcccctccccatcccaagctccttcatgctccctgaagccatcacacttggagctccaagttattggaaggcctttagataattttttttttgcatctgacttgagacaactaaaggacctcattactttctttgatttaatctctcagtttcctggggtaggcagggacatccaggacctctgggacactgtccttgccaaagcccttgcaagtcagtgagacagcctctcatacttagtatctgtttcaatagtgtcttcaatgcctttagggagggatagatgacctcagttccctccagtgtggtattgcattagctgtcaccattaggaaacccctataaacctggatgccccacactcccaagggacatcgcattctagttctcatccttccccactctttgcgaaatcctgtctagctcagatgtgtttatgagtaagttcaggactgtaaaggctgcaggcccaagctctggtttcctctgccccacagagtgcccacagcccggcctgctccgagccctggtccctggagctgccatgaacatgccccagtccctgggcaaccagccactgcccccagaaccgccatcccttggaacccctgcggaggggcctgggaccacgtccccacccgagcactgctggccagtgcgcccgactctgcgcaacgagctggacaccttctctgtccacttctacatcttctttggcccaagtgtggcccttccccctgagcgcccagccgtgttcgccatgaggctgttgccagtgctggacagtggaggcgtcctcagcctggagctccagctcaatgcggtactctttatggagagtggggaggttgctctgccagggagcttgaaggggaaggtgtcaggggtgttggggtgtttacctcctccaggaagcctgtccaggttgctcccacccatcctgacaattagggaccatggctcagcccaattctggtcaacaaacatgtcctgagtattcactctgctacagatgggcgggtcaaccaggtcaactcagtgtctggggtttcccagttttgtaggctcacttcctgctcattactggcctttcactacggtagttgttaaccttttcttgcaaatctcctttgatggggagtttaccacctcttgaggccacacagttcatgtttggatagcgctgattgccaaaggcattcctgacatcccatcaaaatctgtctccatgaattttttacccactcatctttgattcagtgggtaaaagccatatccagaagccatttccagtaaatctatctctgtcctgttcttttttaaagcaacagacttaattttttttagagcagttttaggttgagcagaaagcacaaagttctcatatacccactctctcacgttttcccctattattaatatcttacattagtatgatatatttattacatcccagtcctatttttacagcccttcagatgttacctgcaaccacccaaaagctgaagaacctcagtgtcttaggggtcttggtatttggatctctccccttccttcactatctcacctggtcatacttctagtggtcactgtgtctctgaaataagtgatctgaggtggtcggaccggggtaccaggtaacaagacttgcatttgtgctgcctgagattgagttgcctttttcagcagctgcattacactgtgggatcacctagggcttgtggtgaactgagatccctgggtcttttccctttacttcctttgtattttcttcaaaccagttgtatacatttacttttttattataagagtaataggatcacataaaaactttggaaaataggggaaaatatctccctaatgcaactgtttaaccctttttttttgagacggagtctcactctgttgcccaggctggagtgtaggggtgtgatctcggctcactgcaacctccacttcgcaggttcaagtgattcttgtgcctcagcctccagagtagctgggattacaggagtgcaccaccacacccagctaattttttgtatttttagtagagactgggtttcaccatgttgcccaggctggtctcaaactcctggactcaactgatccgcctgcctcggccgcccaacatgttgggtttacaagtgtgagccactgtgcctggcccacagctgtttttggtttatgtcctcccatgtcttttccacattaattactttgtttatctagttgtaatcaaggggcatatacattttggtgccaattcgcatcttgcatttttgcagtgaatttttgaacctgaatggaagaatttatgtccctccttgaggtattgcctaatactggtttggaactcgggccttctccactttgtgtaattcacacacttgcaaagccaactttttgtacttcttagtcattactgtcagcgttaagactgagatgagggcggagccctatgttggcccattagagaatatcttcagcttagctgttccctgagccagggatccttttaactctactatcctccagccctgagagcagggaccgctttcccatcagccaacctgaggcctggtctgtggcttcatgtggtcttttatgggacacggcttagaactttctagtcgtcctgttagagccatttattcaacctgaagatatttcttatttacataatcaaattctctctttgttctagctaagactgtatgtattttgtgtttgcttattgccatgcctctgggcaatgacagtgagatcttgattcgaccttgaaaccgtagaccctgaattagaggacagccttacgcatacttgttctttcttcctcagtaccctgagaatagaagcctagccctcctgcagcccctcaccctttccctctctgcattcccatccattcactttaatgagcatctgtttacattccatccatctgcattctatgacgcgtgctaagcacctcagcctgttctgtttattctgaaaggtatttcctccaaatattttgatttttttttctccccttggatcaagaactggacatttggatcagagaactgcatatacttttttctttggctccctcctagaaagactttcactgagtaatactttggcatattgccccgggcttgcattgaaggaagttatataaggaagttgtatgaaactcactcttgtggctgaggacaggatgcatgacaacacacagtgccgctttgatgagaatttatctcagaacttcccctttggatgctgtgattctccagagactctgattagcttttatattatgtagttgcaaatctggtaactcatgatacttcctttgctttggttgcttggaaggcagtatcaaatatatggcctaccttagggacagactttattttcctgtcctgatttttaagtttccctcaggcatttattatattctattttatgtaagctgcctcaaatccttcttgaatgaggtgagcttatggcatcctgttgcctttattcttgtagacaacaccttacatttactcttgcagatatctggtttcttttaatcccagccaggttgctacatttaatctcttgggcattctgttaccactgttcagtacctaggatcatttcacctgagttggagtgagtgtcttcatgctccacctgtcttggggtccaggtgaagatgatgggaaaccttacaattgcctttgtccacaattagtttctataactggcaacagccctccttctccttaatgagctagataggactgaaaaagagggtgttctctcttgcttggacagaattgaaacacttctgcccaaagaacagattcaaaattgggccttgccgtctcatcagtccttgaaagatttctgctgtggaggatctgttgtttttcagtttttctgttctgagaatggaggtgagagagcagctttggcgtggagagcgccgggaggaatgggctgtccttggaaggtgtgggttaacaggggtgggagtctgagggtggcggtgggtggagatggaggatgtggcggcctcacttccatacctgccctccccagagctccgtgcgccaggaaaacgtgacggtgtttggatgcttgactcacgaggtgcccttgagcctgggggatgcagcagtgacctgttccaaaggtgaggtgaggaatgggggaggagaggaagctgcagtgtgggggtggtggtggcgggcagaggtgaaggtggggagggatggaatggaggaatgataggctagggttccgggaagtgggagcaggtgggtgagggttcttgggttctgacccctcctccctctcactgactccttccttctcccttcagagtccctggccggcttcctcctctctgtcagtgccaccaccagggttgccaggctgcgaatcccattcccgcagacggggacctggttcctggccctccgctccctgtgcggggtggggcctcggtgagcggtgcggggcggggccagggctgggaccgggacttggcgggggtggcccggggccccaggtgactgcgagtttgtgcgcaggttcgtgcggtgccgcaacgcgacggccgaggtgcggatgcgcaccttcctgtccccatgcgtggacgactgcgggccctacggccagtgcaagctgctgcgcacacacaattatctgtacgcagcctgcgagtgcaaggccggtgagcaggctggcgagggagcgggctgcggtggactggaggtggacctgctgggcctgtgggcaggcggcgggagtaggggagtgcgcagcctgaattggggacgggtttggcagagccggggtgagaccaccctccacaagctgtggcgtaggcccatagctgccgtctgttctcttccattctgtgccttccccacccgcagggtggagaggctggggctgcaccgacagtgcagatgcgctcacctatggattccagctgctgtccacactcctgctctgcctgagcaacctcatgtttctgccacctgtggtcctggccattcggagtcgatatgtgctggaagctgcagtctacaccttcaccatgttcttctccacggtatgcggtggtgtctgcatcttatcactgggtgcttgtgcatggtggtgggtcacagtctgtatttccaccacgttctccgagggtttgggaatgtctgtgccttcactgtgtcttctacagacagagacagcagtgcttcccaaactgtcatgcatagataatggtcatttttgtaagacacattggagtaaatgaacaaaactgtttgcaacttaataaagtaagtttgggcctccagctgttccacactctgtccaccctgagggctgaggggacctttactcaaatcatgggccaagaaactggcctaaagtatggatttgtgtctgcacagtcaccatgttctctgtatgggggcaggaaatctatgctttcccccacacctctgcacacagtgtcttcatcttcaccacattcttccatgatatgagagctagctagctactctgagctccccttctccgtcgcactggggacctgcacatcgttagcacgttcgttcctgtggtctgaaatggcgttcccattcagtcaccatgccaccttgatttctcatgagaactttggaaagatagaggggatctctctattgggggattataggacaatctgactctcagagtcctgagaagctttacagactcaactatgtcctgaggcattgtcggaagtggcagtgtcatatcacatcccagctcaaaggagtgcattttgatgaagattaatatagtttaaaacccctccattcccattgcagaattgccacaatctctttcctgtgttttcctcactcctccataatcagaaaagttcattataagcaagcgtccagaaactataaggaaaggtagagaagtgagcctgctaatgttacttaacccccaagtagactttttacccctgaagtgtcacatctgggaatcttttcaactcatctctaggctcttggcaccatgtgacatgcatgtgagcactgcaaaaactcttagatggtttcagactgctcaggccttgtcagcaaggatatcacagaaagcaagacaggccttcctggcatcctgcattactaggtcagacatatgtctaaattagaaaaatcatagttctcatctgggagaaagcaggggcaaatgtgctgaaactgaggggcctgggtcctcctggagattcatccagagatgaggaagaagagtctgcaaccatgctgcagagagagatcttggccctttaagctgggtgagaagcatataccccagttttgcttgattggcccctttttaggcctgcccccacagtgcctcattctatttttatgttagacactgtttctctttcgtattgccagatgccctttctactgtggctcaccaaatcctccagcaacagctgttctaccagcccactctcggctacatgcagatcgaatgtgattcataattagtaagaatacctaagtgtgtcaggagcctgaagcatgtagggagagcatattcactctctggacttgacacaagtatcctgattggctccagagtgttcagtgctagatgactcttccttatctggatacagtggctgtcagcctgaaaagaccttccctgtagcaggagtactaggagagcctcaagtgcctggcaccacataaaaagctcccggtttctttctttgttttttttctttttttttttttttttgagacagagtcttgctgtgttgcccaggctggagtgcagtggcgcgatcttagctcactgcaacctccgcctcccaggttcaagcgattctcctgcctcagcctcctgagtagctgggactacaggcgcatgccaccacacctagctaatttttgtatttttagtagagacaggatttcaccatgttggccaagttggtctcgatctcctgacctcgtgaaccacccaccttggcctcccaaagtgctgggattactggtgtgagccactgcgccgggccaaaatctcacattttcttaaataaggcaataaggaaaagctactggctttgagttgttgcctaaagtcctgctctcactcctgttcttttccacatgggccagaacataaaactatgttttctgttttccctgcaggttctctgtggtccctccttgccattcgtagacttatttcattctgcagcagtgtccatttaaggacccattggtcaaattgcagttgtcagtactaggacaggagataacagtcctcttccttgtcttcaaataatccaggacagtctacacttgggagtagtaatccattcttatctggaacataggagcagacagtaggtttataattcaggagtttacagatgtaaaatatgttttgaaaaaacaaaaacaggccacaaacttagcatttgatttttgtatataggcaaacaattcagataatgattacaacaaaatgacatacactgaatatgtgctgtttcagacactgctaatttaatcctcacaatagtactgttatagttgatacatgcttttattcttgtcatcctttttttgtagataagggaaagttaaatattttgcctgaggtagaaggtgagtatctaccttagaatctgggtgagcctgactccagatccctcacatgtaacagatgatattgctccctttgcaccagggcagtgagcatgcattgatatgcttttaacccaacttcagtttctcttaagtcctggagtatgtagaaaaaggcatggccccagtttagtagttctcaccaaattcttaaaagataagagccgatcaagagatctgaaaatacaactaagccaaatataagaaaccatcaggacaaagatatcaaacattttaattgtgcaacttgaacccgtactgttcaaactgtgtatccatcacagtgctccttgaatccttgtaattagatctcagaagacccagacagagctggcattctggggctgtgcaggtgtccttgctgattgctggcatcctggctacaagcccaccttctcattacgccttatatccctcagaccatcccaggtcattctcactgtctcttggcaaaatcccataactgtttccaagagaaaatgaaagcagaaaacaggaaataagggagtaacagcaagttccattatattccaatctgggcatggattaactacgtttgcgtttatagtccacattctgcagtgcctggatagcccattttggagcattagatgcactgttacaaaaatgtaaaattccacagaaaaaaaaccttgcaggataatttccctacattgcttcataaataatggccaaagctgagaaagttatcaacttagattagaattatattaatagaagtcagtttgtagtctaatttttttttcttaaattccctgatttttctatgtcacttctacttctttttattgctgttgacaaaaggaatgccaatctaaaaattagtccacggtttttagtggactaattccctcacactacaattttaatttaactctacccctgtggatttttcacaaccttaaacaatctctttgaccttttagtatacctggaaaataattagtcgtaaaatattagtgaaatgatttcttcaaatcctctccactctagagataatatctccatttttctttattcttcttttagtgcaaattcctaggagaaagtcagccctcaattattcccctagatgtgtcttcaatgtttagtgattcagctttgccttttttctgctgatatatatcttcctttgtctgaaatatagtacaaatctctctcccagaaacttctgggtatttctttctatatacttgaaagtgaagcatatggagccagtgcttggttaaggctggatgtaaaattagttctttaaaataaaatccaagtcataaaacagtattgggtaatttagtggcctatagtacttatgtctggtcttggaggcaaagaataatcaatttcctatagctaaaatagaaaaagaccaatatattgatttgtttaggaactaaattaactcccaatgaatcagcacatacaaatagttgaaaaataaaccagtctcttaggtgtattcaaacattaattacttaaccatttttatttatttatttatttttgagggtctcgttctgtcacccagggcagagtgcagtggcatgatcacagctcagtgcagtcttgacctgggctcaagcaatcctcccacctcagccccttctgccccccacccccgccaattccctgttccccaccaagtagctgggactataggcacacgctaccgtgcccagctaatttttgtgtgttttgtagagatgggggtttcaccatgtcgcccaggctggtctttaactcctgggctcaagtgatctgcccacctcatcctcccaaagtgctgggattaacaggcgtgagccactgcacccaacctaaaaaaattcattctaatgttgatatggacctacatgaaaagtctgaaaatttcccattgagaactcactttttcaatttaacagtatattaagagggaaccatgtccccaaaataacaagccctttcgaaagcctggaacacccacttaaaacatgttcatccttaggcagtctctttttgcaggagcaaaattctttacctccaaagtgaaggaaaagaaagaagatagatacgcaagcttgagtcttgcagcttaaaatttaaaggaatcaaacccaaagtttcctgatgccaatttatatcccaggttttcgtcttcattttgttttctttttctaagatcctagcttcttcctttccaaatttgtctgttgaagttgtaatttttgcagtttaaatgattggatgacatcttcagtagggtcaaaggaaacattagcgatttctttttcatcttttgtctctagagactgactttggaatatgttttccagattttttggtggcatctctgccactaaagagttatgcctagaaaacttttttcacaaataagggaacacaggatgctggaagccatggcattgtccagagagacaatctggacatgggttggaactacagacaagggagctaatggcagactttgcttggttccttaattaggatgtccagttgagtctgatccgattccacttctgctccctgcatcccctttgaacctcctcaatagtccactcttcactatgttctccagagtgtaggatgggtggacactgtcccctctccatgttcttccccatggtgtgaagtgccatgcctctctccatggccttagggactgccttttttcttacctgccacacactccccgcatttgttgggaagggatgaagagggtcagttggtggaagccctgagagtgaagcccagttcagagtctgagctagcaggggaaactgggacatagtggggagatttggtttctgggtagcttagagcttgggccagggatggggattataggtgggatccatggtgagcatgaggagacagggacaggattggcctcagcttgagggtatcagaaccccctggcagggcactctccacagcaccttccagaagcaggaagattaggaagctcagggtcagggtcagggctgccagatacatattagttatgtagcagactggacctccttaccacattcttctcaggatttggggagtcaggcatttcccagatcttctcatctgtgacctttcacctctgctgcactgacagcagcacaccacccctgggcccacccctccggttttgtagatctggacctctgcctcaagttctctcaatgcctgtcatttcttccttcagttctatcatgcctgtgaccagccaggcatcgtggttttctgcatcatggactacgatgtgctgcagttctgtgatttcctgggctccttaatgtccgtgtgggtcactgtcattgccatggctcgtttacagcccgtggtcaagcaggtcagtccagagtgggccctggggaacaaccatggccaagtctccttgaaatccactcctgacctctccctgggggcatttccaagtgcctctcatgattctgacccaggccctggagtgctgtctgtcacctggccctagcccagcccttgagtctctttctctaggtgctgtatttgctgggagctatgctgctgtccatggctctgcagcttgaccgacatggactctggaacctgcttggacccagtctcttcgccctggggatcttggccacagcctgggtaagggtggggagggatgtggggggagggtcccagcaggacttgggtgctgggccccaggtatctggtccccagtttaaggtgggcttggctctgtcgtcatcacctgctgctggcagtgtccgctccagtcttggcaggtgtctttaggtcacaaccaggatacagaggaaacctgagagtgaccagctctggcttgggttccagggcttggcattcctgagccccacttctctgtctcccccagacagtacgcagcgtccgccgccggcactgctacccacccacgtggcgccgctggcttttctacttgtgccctggcagccttattgcaggcagtgccgtcctgctttatgcttttgtggagacccgggacaactacttctacattcacagcatttggcatatgctcattgcgggcagtgtgggcttcctgctgccccctcgtgccaagactgaccacggggtcccatctggagcccgggcccggggctgtggttaccagctatgcatcaacgagcaggaggagctgggcctcgtgggcccaggaggggccactgtcagcagcatctgtgccagctgagaggggctttgggcctggccctgaggggatatgaatgcttcctagagttctttctgggggtgtggagccctcttagaaggagacaggctgtatttcttgaggacatggagtctttctcaaggacacaaaactcttccagggacctggagcccttcccaggacatggagaacttcctgagggcctggagtccccctgcatcatggagtccttcttaaggactggagcctatgcaggcacagagtccctcaggaccaaggagtccctcctgcaggtgtggagcctttcctgggatgcagagccttcccaagacatggattccttcccagggagacaaagccctgtcaggagcacagcatctttccagaggaggtggagtctatcttggggaaaccaaatttccagattttcccagaggctcagcaactctggcctcaggcttccttcccagaggcagcgtctgggctgtgctgtgctgtggaggagggattgcaggatggatggagctgggactggggctgtctgggtggctggtatcctcgtttgatacaggtggagtctgtgtgtctccagtgattgattggttcagaatggttctgtgatgccttttttccccctggggtcaggggtgtggggaagtggggaaagagggcccctcagggaatcagcagggctgatgggagctactgccggaggcttttgtcacaccctgtacacagtctgatcccgctcatctgggccctgcattcatttctaaacagtttctaatgcctattccccaattcctattgagcccgatttgcagtatctgaggggtgtgtgtgtgtgtgtgtgtgtttatgtatgtatacgtatgctgagatgatttaaatcagtgagacagactttccttatgatgcccacacccaacacagaaggaagccgaggtcccaggaaattggaatagcaggtacacgtctcaggtgtgcaagaaatatcacaagaatgtaacttctgttttgagcccccatttttcctgagtgccagaaaagatcatttgtccatttgggattccttctctttccatgagggtcatagctgagttctgagggtcttacataatgccaagaagttgggagagcattctcactgatcaccagtgtccatacttcatccatccccgggatttccatcattccatctggtccccagtcagaggtccagacagttcatctgggatgcagagagatttcttgttcccatttgcattactctctcagtcctaaggttctctctgccacttctgggccatatgtggagacccgtaaagttgtctaaggccttggctatgcagacacaccttgaagctgtttctgctctgggttttgacagacaaggcatgagttgctgcatctgttaaaactgcaaatctatcttggcctggggtgtggagctcagggactcttccttttgggaccctctgtgtcagtattctcactacatcctctcctcctctctcttctttccccctttcgttaatattggaggtgaggaagccttacttaatgttttctcctgaatctttttttttttgagacggagttttgctcttgttgcccaggctggaatgcaatggtgcgatctcagctcactgcaacctctgcctcccgggttcaagtgattctcctgtctcagcctcccgagtagctgggattagaggtgtgcaccaccaagcccagctaatttttgtatttttagtagagatggggtttctccatgttggtcaggctgctctcaaactcccggcctcaggtgatccacccgcctcggcctcccaaagtgctgggattacagttgtgagccaccgcgcctggcctctcctgaatcttttatctatgccttaagccttttctgttcccttcaggacctaggcttttgaaacccaaaagccaggaaaacatgcctttgttatctgctttctgcaatcacgtctcttccatggggcactgagcagagaatggtgtggccaagtgagtagtgagaagcagtgaggaggtgtgagctaggtgtctgttcccattttagaaaatactgttcctacatcagaaataccacattaagacgtatagagccaggtcactgggatgcttgaacccaaatagctgggattctggacagagtcagcagagtacagaaggctctgaagtgggagacggagctggggtgcatccctcccagtgaggaggggtcatgaggggcgtctgggaagagggacatttgaactaggattagctgagttgccatgatgctaagataatgggagagtgttctttgtggtcaccagtgtccacatggcatcccttccctgagattttcatcactccctgtggtcttcagtcagtaaagctcttagaacacttgtatagtgcctagtctggtatgtgatgtggtccaatatatgttagcttaaggtcaccacgtgtttggacatggagagggaacagcaagggggaatgcagaggcaggaaagactgatatttactccgggcactgaatagttcagtgtgcctgggccagtgcatgtgcgcatgcttttgtgtgtggagtggggtggtggaggtaagcagccaatgatatgattagatagataagtggaggttgggtctttattctatgggaaatgaggagccattggagagattaagcaggagaggaacatcagattggggttttgatggctggggcagaggatggactttgggagaccttggaggacaaagtgcagtgaccacagctattggaacatttgaaagagaaatggtgaagccttcttaaagcaatatcggtggaaaggaggggaccaatttaagagctgttaggagtgaactctttaggacttggtgactgattgggtgtgtggggtggtgaggtatgagagagcctaggatgatggtgatattctgatttggggatggtggtgccattccctgagatggtgacaccactttgggtggggggaagatgagctccactttggacagtttgaggtgcatgtgggattcccggagggaagggggccagcaatatgacagtgctggacgtagccgctgaaccaggcctgtctccaggctcccaaaatgggaatccttggttgtctcctgacttgtctcagtgggggagatcccaagattcaaacagcccttccttgccttgaatacagggctgtggctggcagatattgctgtacccttgcatgtatctgtacatacgactggactgagacccctgagcacttgcagctgcctggggcatgttcagcagcacagggctcaatccccacagggtgatgttctgaaagcttctgagtgacaattcagtcccgcaaaccttccatagggaacatgctgtgggagctacagagatgagccagacccgactgaatcctgccctgaaggagctcacacggtggtgaagtgtcatgaatgcaagttagatgggacaagtgtgaagtggaagatcctgacaaagtgctgtaggatgtaaagagagcgatctcaaagtgcaatgggaaaggatgcatgagagagatggtgtctaacctagctttgaaaactagtcccagctattatcagagaacagcacaatacatacaagggtgcgaagacatgggggtgcggcagtacagataatgtagcgaggggacagccatgtgaagggcatagtggaaaatcaggctgaagaagcaggtgggggcagattctggagggccttgaggattcaactgaagaatttggacttaatggtaatgggagctgtcaaaagtccttgatcagaagagtgatgaatcaatccaggtttgaccaaagtaacagaaccactatgagtgataaaaagattagacctttacagtcatgggagcagttggagaaatctgtgcaaaactgttacttctgcatttggtgttgggcctgaagctgttacagctcagctgggccagcagttaggaaagaaggctgagtgtgaagtgaggggcagtaagggcacactagaatccagaaggacaaactggaacctgtgcctggctcttatgccttcaatctcagtgactggtgacctgcaggagaagctgtcacctttgccatggagcttgcacttggcccagcactcagcacagtggaaggaggtgacctggtggggactggacaggctgtgctaatggggagccagcagatgagcaacatgggggtgccctcactgtgtctggtgctgttccattttttttctttctttcttttttttttttttgagacggagtctcactctgttgcccaggctggagtgcagtggcgccatctcagctcactgcagcctccacctcccaagttcaagcgatcctccctagtagctgggattacaggtgcaccaccacacctggctaattttttgtgtttttagtagaggcagggtttcatcacatttcccgggctggtctcgaactcctggcctcaggtgatcctcccacctcggtctcccaaagtgctgggattacaggtatgagccaccacacctggcccacttttgccttccaaatcacatgcaaacttctctgtggccaaccctaacccacaccctctaacctagtttggttgactcagtataaagctaccacacgtgagctaaccagagctttcttgggacgattaacttggcagcagcccgtgaaggatagatggtcaggataaagaaagccaaacctcccatagctcttgggttgacactgtcagctggtgtggtagtcattaggccattcacaaatctctctgtccctctcgtttgccatccagacacacgatagtgtgcttttcccccttaacaataggtgtggtcctgtgccttcctgttgccattgtgttggccactgaaatgtaggtggaggcaacacagccacttctgagtagaagctttaagagtcagtgtaggctttgttactttcccttttctttttgtcatggtgaccagcagtgttcccaatggtagctgttttgtcatcctgagtcccagaggggtgaagaccatgatgcggagcagaagccccaccagcctctggtggacctgcatcaggagcaagaaacaaaccttaatggctttaagcctctcaaggtttgaggtcatgaccacagcacaacctagcctatgccagctgacaggggcagagggcagcagtagcagtgggatgctttcctggagagcaaacctcctctcagcagagttaggacggcagctttcacctctgcattcctcaggctgtaaatgatggggttcagcgagggcgtcacaaccccgtagaacaatgcgacagtcttatccacgttgggatccttggccttgggtttgaagtacatgaaggagattgtcccataaaaaaccaccaccactgtgcggtgggctgagcaggtggagaaggctttgcaccggcctgcagcagagggtaccctaaggatggcagacaggatgaaaaggtaagacaggcagatgagcaagaggggggccagtgtcaggacggctgtggccaccattaatgccagcgcattgagggagatgtccccacaggccagttttagcactgccaagatctcatagaagtagttgatgacgtggccacagaaggggaggtgccagacaaggatggactgtagcagtgagttggcaaagcctgtcccccagctcagcgctgccatctgcatgcaggtctgcccactcatgagctctgggtacctaagcggctggcagatagccacataacggtcatatgccatcacagccagcagcaggcactccgttgatcccagcgccagggtcaggtacatctgcagggcacagccagggaaggaaatggtcctctgggtttccaggaaattgtctagcatgagaggcacaaaggaggaggtgccgcagatgtccatgagggagaggttgctgagaagtacatggggttgtgcaggcgagggtgcagcacgttcagccctatgaggagggcgttccccaacacattcacggagtagatgcccaggcagaacacaaacaggaccacctccaggttacagtgctcgtgtagccccatcaggacgtattccgtcacagctgtctggtttgcccacttcatctcattctctctccttttccatctggaccacccagctttttggaaaaagctccaactggcctgggagcccagtgacctgatgtctgagctgcagcaggtcagcctccctctctggaatttagtttcaccatctgtataatgagggagttggacttcagatctgcaatctggccttctcagcgctgcagttctgtggacgtcactgaggggaggatggggcacattctagtcccctaggctcctctctgctctccccaggatggggtcagaggagacagcagagaaagattcatgtttaaaatgatcgtttggaatccaaagtgtttttggtcattaacaggaagcatcttttctacattacggtttcatgtgaccaaattatggccatagtatttcagatttattcatccactaagtatttattaagtacctattctgtgctaggtatcaggtgctggggctatagcagtaaggaaagtaagtggacaaaaggattccacacctgtcacaggcgctgccccactccctgagtcaggtgagatgagctccggaaggcaggtgggtaatggatgatgctcacctagtgttccttgggccatgaagatcaaatatttcagccccataggatgtgtaagcttgatttctggtcatctctccttaaggaatcatggaccattcattattttgtttaaaaggacacataagaacgtacatgtctcaatagagttactggtcacaggactgaactgtggtcatgaaagccaagcaacttactttctggcctccatattgctttgtaggagaaatgatactgacaatgatgtcacacgaggagggaagccaggcacgaatctggtggaggtgcggtcagttgtgaccagctttgcaaagggagcggtgggcgaggctgtggtctctcccaggtgacctccatcgccatgcagagctgctctcacttctcctcgggaaaggccagcgtcaggtattcctaggaggaagcccaggtgtgtccagagaacagtagtcttgttagaactggaaaaatgtcttatggccaggtggcccctggtctgaaggaaaaataggagctgagtgtgaacttttatcactcagaagatataatccacctctcccctcctgcccttcgctcctgggttggttgtgaggacagtgctttgtgacagcagtggagccctgtctgtccttccgggctagatttcttctttctcttattcctcctgtttcgttgtatccacgatttgtcgagttgcagggctcaccctttcctgaagaaaccatctcttttcccagctccgcacctttgtccgagatggaggcgtgtcctcccgcccatccccagtggggggtgttctgcccattctccagagcccagcactgctccatctcttttcctccctctccttccccttgctgttacctgctgccttcttgtgctcccactgcccttggccatccctctgtgtcattgtgcgctgtggtgcacctgtcttctctactacaccttaagagcaggactctgcctccttcctaccagcacctcatgcagcaagtgctgccaatagcaggcacccagcagatagcgaatgcacgactccaaaacccagctttgcctcctggctgtagttcagactagctgtgtgacactgaccaagacacttgacctctctcagactcagcttcctccttgaagactgggatgctatgtagctcagaggaaacatacacctgaaggtgctgccccggggggtgcaatgacctgttactgaggctggatggaggatggcatccatcatcagctacaggtgcctcctctatctacaggttcctgctccatctatactagccacctcctggacaagggctccagtgtcctccatgacaccagctttctccagagcctgtgcaggatttccttcctctaccctgaatcagggtgattcttaaaggacagtttcaggaacatataggggcacttgggtaatcttggtcagtaactgacctttaactatcatccatgtgaacatctacagttagggattttcttggtgatgtttggcaaaaagtaaagaattccccaagtgtgaagcctcattcattcacttattcaacaaatagttattgagcacctactatgtgttaggccctgggccaggtgctgggaatacagcagagacagacctggctcctgccctcatggagtttgcagtcattcattcactcactcggtgactttggacacctccccctcctctctccaggctttagatctctgagattctctctgagtctgggatgtaaagacaaagtaaaacctgaaatctggaaagcagaactataagagctttgtttctgatgggggtgttgctgcagacagaactatgtccatctcaaattctgacactggacacaggcgtgggggtttcaagcaggccaagggtgggaaaccacctgactgcatttttctttatcactcacacctctaacagtaagaccaagtgggcctggcggaggcatttgagggcttttgtgtgtgcaggctctggcccgtcctcctgccttgcctccaccgcatccctcatgcacacctgctgcagcctcatcagaccactccctgtcttttggacaaagcctgtgtgctccagtcccatccctcttcttgggcagtttcttcaggctggagtgcctttcttttctactcatccttcaaggctcagttcacacaccactgtctcgtgcagccttctctcagatggcttcataaaactgaccacccggacaacaagatggtcacacagctattagtggaggttaagttcattctgccttcattatagttcatttttcttgtatatctctctctgactagactatgagctattgcagtgaaagggctgtgtccttcatcactgtcaccctccagtgacccgcagccaggaggtgtcagtgattgccatttgagttgaactatttattgacatccagtgttgttctgccaaaaatcctgatcctaggcatggtggtttgcacctgtggtcacagctactcagaaggctgaggtgggaggagtacttgagcccaggagttcgaggttacagtgaactatgattgtgccactgcactccagcctgggcaacagagtgaggccctttctctaaaaaagcaaacgaagaacgctgaacccaaggtcttgcctcaaaatcaattcccccttccccctccaacacatacaccgcaacagaatgatacagctattgtgattgctaggagaagggctttgggcagtgccagtctcctgtttgcagtaacacctgctctttctgaagagctacatcagtaacatggtgggttttcctcacaacttaaaagtctgatcgtaacacattcatggaaactagaaccagcacacgaaaccattggcttgtggccctaaagaaataactctgtgtccagaaaatgccatgttaccaggttgcctacagctttgcctgtaacatgggcacaggctgggacatcagatagaagctggttcccatggtggctgggttgggatgggctaagttatgttgcagtaacgtacaacctcatcattttagtggctagcatgacgaagttttatttctcatgctacatgtctactgtggctttcccggtggctcagggttctcagagcccctggcagatggaggctccaccctgtgggacgtcaccagttgttatggctggggaaggacacactggaggctcttgctgctctgagccacaggagacatttgtcatatctgcacacagcccactggccctgcggcatcctaccacctgcccagaaggaggagaaccagaattactgctgagcagctcctctgcatgtgggtgcaatggcgtcttatgactctcagaaagctactctagtggccatctaccagtgtcacgcagtgtcacgctcggtcatggcctggaagatcagagtcacagagggataggacctggagtgtctctgaaaatagctgcctggtttcactccccggttttacgcctcttgagaagcagagtgatgcctagaatgagccctggactgggagggcacgtcccaggtttgaatcggggcctttgttccttttctgctgtatgactttggtcagatttctccttctgagaagtggagccaattaagcgatctccgatatgctgtaatctctgaaacatttcctcatatgtttctagcaacttccaacctgaggtctgatagacccagggttactttgcaagctaactgacatatcagtctcattgtctggtaaatctaattttaaccacttaatacttattttaggcttcacaaattattttaaaagaaaagataggggcataacaagaagaaagcttcggttacaatttccccgaaatgcctggatctgggattcctgcttcctggctgtgtggcagagaagatgaggatggccctggagtcagacgggactagggtccaagccccagctcttccacttgttaacaatgttctcagcctcagcttccttacctataccatggagacggcagtatttccttgtgggcttgttttaaggatccagtgacaggaagcatgcgaagctcttagaacagagcctggcactggtaaatagtcagtgagcagtagatgatattattaccatcctgtccctatccctgtcccccagcaaatattttggcttttaaatgttttaaatgatttcttgagaataagcaatgggtcagatgaaatctccttacctctcacctactggccatggcctaaatgtctgtagggagctggagccaggtgaggggagctgtggtttgggaagtgccgagttcattatgagcaagtgcacggtgctgggatgggctaggttccccgcacctcgccctgccactgcctcccaggacctgcctcttgctcccctgccacatagacagtctgcttgccccctgctttcagggacctcatggtccctgcccaatttaaagttcaaactctgcaactgcacaaagttgcaggcttggcagctgtgggacctgggcttcagagactccaggttcctcggcctgccccaggagggccctgctgaggtgaagtgggcataggagagagagtggacagagaatctgaatactgggtcacgttgcagttctgcgccttggatgccataggctccaggcccataagcccggcttcactaggcctgggtgtctgggttgtgaaatggggtgtctccttccaggattgccgtaaggacctggattcatcaaagcttaaagtaaattgctttgtaaggtgggagacaccgagtacaggcgagggactttattaggtcagggatttaatcaggcatctgtttttacagatttctttattcctgttccctcccctccccttcctgtcctttcacaataaagaataacaacttgacacagcttagagactaaaaatcatccttcaataaagcagcagaagttgcaaagtttcctatgatgctataatttgtcttctggaatttttttatcaagaacataggtcgaagtaaaaaatggaaaagttgctactgttgattttctatctgctcatagcatattgtcctcttgctgccccacggataccctgaactcagcaggtcgaagacaaactcaccatctccccacttcccccatctactgtgctcatcctccccatgcagtgtctcagtctaccccaaataaaccagaaactcaggacctgcccacggtcctcacctctccctcctccacctctataatcccaaaatatcttccaaatattattttacatatatatacagttgacccttgaataacatggatttgaactacatgagttcacttatacttgtatttttcaaaaaatatattgggaatttttttttgagatttgctacaatttgaaaaaacttgcagatgaaccgccacccctgagacagcaagactagtccctcctcttcctcctcctcctactcaacatgatgttgacagtgatgaagacttttatgatgatccgtttaatagataggaaatctatgtctcttccttatgactttcttaataacattctcttttctttagctttattgtaagaatacagtatataaaacatataacatacaaattatgtgttaatcgactttatgttattgataaggcttccagtcaacagttatacatggatttttttttttacagtgaggagagttggcacccctcacccccgtgttgttcaggggttaactgtaatcccaaatattatatctctagctcccaaatgttattttgcatctatatctatctccccaatatttcttggggccaccctctcctttactgcccagccagctcaggcctcactgagggcctgggtgactacagcagcttcctcccttccctgccctcaggaggaagcctttctcatctgtcgtctactgcgggcaaggtggtcttccacataccattattttttaagttcaaagtcatggtcatcatagaaatattggataatattgaaaataataatttaaaaaacagtacttatctgtaaccctgtcacccaaaggaaacaactgttagttaatatttggtcatcgttttccagtatttcctagatactgacttattcatagatctgtaagaaaaatacttaaaaagttaaaattgagatcatactaaaatacaatgttatgtgttctgctttttttttttctagttactttacgagtattgcccattatcatatacccttcaaaaaataagattcctggccaggcatggtggctcatgcctgtaatcccagcactttgggagaccgagttgggaggatcggttgagcccaggagttcaagaccagcctgggcaacatagcgagacctcgtctctattaaaaataaattagctggacgtggtggcacatgcatgtagtcccagctcctcagacggctgaggtgggagaattgcttgggcccaggaagttgaggctgcggtgagccaagattgtaccactacattccagcctgggtaacagagtgagaccctgtcttgaaaaaaaaaaaaaaaaaacagattcttaacggctgcatcacatactgtcattggactccaccgggatttgtttaaatattcttctatggttgaacattaagattattacagtttttttgttactacaaataatgctgttattaatatccttatgtccaaatctttgtgccctttattatttacttagactggattcctagaagtagaggtgttgggtcaaggggtctggaagttttgaaggcccttgattcatatttccaacttactttctaggaagttcatattaaattatccccatttccaccagcagtgtatgacactgcctacttcaccacatggtacctaacagtggacattgtgttaaacaagagagagaatggtatctaatcagtgaccttgctaaaagtcaatctgattgtaaacccccagagcccacagaataaaacccaaacctctgtgatgtatccatggcccagcagaatggcatggccactggcatggctactggcagccttctctcaggcgtggtcagagaggcttgggtatctctcactcctctagccatgcttctctgtgcctctgttctggccagcagaggaagcagggagaaagccctgggaggggaattcaggcctcatgcaggggctgtgcttacctgtagccgggggcaggaaaggtggactgctgcttgcagggcaagcccagtgctcccatcgtacagatggtaccatggaggccagggcaaggcagggaatggaaatgctccgtgaatctaggtcagtgtccactgcctgtgcactgagttatcagaaagaaaagctggaagaggctgagcaccaggcaggggcaactatggcagggtcccagggcatgaggtgaggatgggtaaaacaagcttcctcaagccaggtgaggcctggatcccaagaaagggagcactggaagctgctgctgctgctgttgctgctgggcggggtgaggtgggaggaatggggtggcttcaggctttgggctggatgattggtgtcccagggcctgacaggtctgggaatcttggactttgggccttgtgatggttaatactgagtgtcaacttctttggatcgtgggatacaaagtatgaatcctgggtgtgttctgtgtgggtgttgccaaaagagattcacatttgagtcagtgggctggggaaggcagatccaccctaatctggtgggcatgatctaatcagtttccagtgaatataaagcaggcagaaaaacgtgaaaaggagagacgggcctagcctccgagcctacatctttctcccatgctggatgtttccgtcccttgaacaatggactccaagttcttcagtctggggactcggactggttctccttgctcctcagcctattgtggaaccttgtgatcgtgtaagttaatacttaataaactcctctatcctattagttctgtccctctaagagaaccctgactaatacaggcctcattgctgcctctactgtcacctaccagggaagctgggccattctcgtcatctgtggactccgtctcagctctgctcagttttgggaagaactctaggctctgccattgtcacccctacattgacatgttaatatctctatttaagaaacttgtgcagggcctagagttgggcaaggctggaccttgggagagagtagaatctgacactccctgctcttggagtaatgctgaaaacacagaggggcacagcaagaggagcaaggtggggtggcttcctggtggaggtggcatttgagctgggcctgaagggtcaggcagtcagtccttttacatatggagaagtgtgctggggataggggagggggtgctgcctcgtggggagaaacaaggagagcacagagctgggtggtgcagggcatgtgggggccacaactggctggtgtgtgtggctgtgaggagggagatggggtgggaggggaggaaggctggggagccagtcaggcagggccagcttgtgagggcctcaaatgccccactgaaaagcttccactttgttctgagaacagtggggagccacctagggatttcagtgagaagagtgatgcaatcacatgtgcatttcaaaaagatgccccatgaaggagagattggagggaggaacaggactgaagtcttgggaccagccaggaggctggtgtgaaggccagggtgatgctgagagcagagggtgatttgggggctgttctgtggcaggatcagcgggacttggtgctgccttgctgggatgaagataccagacctgtagccccagccctgccatgtcttcactggcattggcatacgatggcctcagctactaacctgagacctgcgtctgtacagagccccgccctccctcacctggaggcccgactcctgccccacaccttcctggcggcctccttcacctccttgttcctcaggctgtagatggtggggttcagcatggtcgtgaccatggcatagaggactgtgaagacctcatcagagatgtgggcttccttactcttgggcttcaagtacatgaagatgatggtgccgtagaaaagcagcactacagccaggtgtgccaagcaggtggagaaggctttgcagcacctggcggccgagggcaccctcaggatggtggccaggatgagcaagtaggacaggcagatgaatgccaggggtacaggcagcagcaggatggagcccgccagcaggaagtcttcgctgaccgacgtgttgccgcatgccagcttcagcactgccaggatcttgcaggtgaagtgactgaccacgtggtggccacagaagggcagcctcatggagatgaccatctcagtcaccgacttgaggaggcagaggacccaggcagctcccatcagcagcacgcagagccggtggctcatgagcacgtggtacctgagtggctggcagatggccaggtagcggtcataggccgtgatggccagtagcaggcactccgtggagcccgtggacaggctcagacacatctggatggcacagacagcaaaggagatggtcttccgggatgacaggaggtggaccagcatcagaggcacaaaggtgggcgtgtagcagatgtccagggtagagaggttgcccaggaagaagtacacgggcgtgtgcaggtggatatctagcacgctcaccgccatgatggctgtgttccccaggagggtcaccaggtacatggctgagcacagagggaagagcagatgctccagggctgggtagccagaaaatcctttcagaaagaactcggacacctctgttctgttgagcggctccatgctgcagagttctgaagagatggtccacagctgggatggaaggagagagggtacagggtgcggggaagctcacagagccctttctgggacgaggtggactgtcaggatcttttccagcactgccacactcactgtctgtgacgtcgggcaatccctttatcctctctaggcctcagtttatccatgtgaaaaatgagcattgatttagatcagcattccctgagagaatgttaatgagaacattagtaagcaatctgaaaaatcaatttgagacaacattggattaataaaaaataaagctctttactgcaggacttctcagagcgtttactacgctaatgtgatctatgactcctgcaaagcaatgtagaacatctgtaccccaaacttatttgatcatggatccccttttacagaaaacccattaacctactgcagataagtgttctatgagcatagtctgggaaacagtaggctagatcaacagttctcaaactttaacatgcaccagaatcacctggaaagtttgttaaaacagattgttgggccccaaacccagtttctgactcggtgcgtctgggcgatgcttctgctgctgatgtaggtaccacactttgaggaactagtgggctaggtggtctctgagcaggtggagattctcctggctttaaggaagcctctgagccatcgcatttgctattccttctgtctggaatgtcctcggcctgcagtggtctgacctgtctcttcaggcctactctagtatccatgaacaaagcatacaccgtgctgtgtgttggagggctgctgaccttgaagcctatcgctgggcatgttcccctgtcccctgcccagggcctgtttcattagctaccctgtgtggattggaccttcacaatctgccttcctgtgggtttcccagctaaaatctgatggagcttttggcccagctccaaacccctatgttctgtgggccagagcgagggctgctttgacttcatgaactcctagggtattagcatggaacatgaccagaggccaacttgttggatctcccattgtatagatggggatgctgaggtcacacaacaggtctctggtgaggtgaagctagaatccagccctcccaacagtgtgacccctataccatgctcagagcaggtgtatgcttctattaggtttcaaacaatgcttgttcttttaccattctagatggatatcagtgccccaggtgctgccacaatcctctcaccagcaaaagagcatgagtcacctctccttagtgttccagggtatctggcacggtgtcattaatcccatgggacacgatgccaaatcctgggcctgggtggagcacagttcctctcagtgccttccttgcaggagaccatttccgtcttttattccaccctcacttactcatcccagaacctagaagtaactgaggacctgctacatgtcaggtggtgccagatgtgagggagcactgatgacaggtgtgctcccaggctgctgagtgcaaacccttcctaggcagagaggacccccaagtcttccatacccagcctcaccgtccccccactcttccgtacccagcctcacccacccctcccactctcccatacccatccttgtcctcccccaccctcccatacccagcctccccctcccctgactcttccatacccagcctcacccacccttcccactctcccatacccagactcaccctccccccactctcccatacccagcctcacccacccttcccactctcccatacccagcctcacccttccctcactcttccatacccagcctcacccacccttcccactctcccacttttccaaaagtaactattgttattagttttgtgtatatctatccagatacttttctggccatttgcatatgtatatctatacatggaaataggtcttgtgactttttagtatgcttttttgttgcagctttattgaaggatggttgatgtacaactatatttaaatcatataatttgattagttttaatgtatacagtcatgaaaccatgaccacaatcaagataatgaacttatctaatatacccacaatttttctcatgccccttggtaatccattcctttcttccccaaccaggcagccactgatttgctctctgtaactgtagattactttcattttctagcattttacataaagggaattatgcagaatgtactctttttaaaatctggcttctttcactcagcgtgattattttgagagtcatccatgttgtgtgaatcaatggttagttctttttaaaaatagcatctttattgagctataattcaaacaccatgcagccgcccatttaaattcacccatttaaaatgtacaattcaaatacaaaactattgcattgtacactttaaatgggtgagtttaaagtgtacaacgggtgaatttaaagtgtacaatgcaatagttttgagtatcaccacagttgattttagaacatgtttatcacttccaaaggaagcccataccctttagccatcactccccttttcccctcaacctcctccagtcttaggaaaccattaatctactttttgtctcttttgagctgcctattctggacattttacataaatgaaattataaaatatgtttccctttgtgactggtttctcttacttagcttaatgttttcaaggttcatctatattgtagcatgtatcaggacttactttctttttattgctaattaatattcagttgtatggatataccacattttatgtgcccattcatcagttgatagacatttgggttgattccactttttgactgttacgaatagtgctgctatgaacatttgcatacaagtttttgtgtggatgtatattttcatttttcttggatattttcttaggagtggagtttctaggtcatatagaaactctatgtgtatatttttggggaactgccagtttccaaaatggaaagtatcattttactttcccattttacatttccccaatatgtgagggtttcaatttctccacatcctcaccaacaattgttattatctgctttttaaattatagccatcttggttgggtgtggtggctcacgcctgtaatcccagcactttgggaggccgaggtgggcagatcacttgagaccaggagttcgagaccagcccgggcaacatggtgaaacctcgtctctacaaaaaatacaaaaattagccgggcatggtggcatgtgcctgtagtctccgctacttgggagattgaggcaggagaatagcttgagcccagaaggttgagggctgctgtgagccatgttcataccaccctactccagcctgggtgacagagtgagaccctgtctcaaaaaaaaaatttatatttatatataaccatcatagtaagagtgaagtggtatctaattgtgattttgatttgcatttctctaatggctaatgacattgaacatattttcaagtgctcattgggtatttgtatatcttctttggagaaaaaaataggctctttagcctattttaattttaattttttttctttgagatggggtttcgctctgatacccaggctggggtgcagtagtgtgacctgggctcactgcaacttctgccttttgggctcaagtgatcctcccacctcagcctcccgagtagctgggatcacaagcacacaccatcatacccaggtaatttttgtgtatttttggtagagatggggtttcaccatgttggctaggctggtctcaaacttctgatctcaaatgatccaactgcctcggcctcccaaagtgctaggattacaggtgtgagccactgcacctggcctaattatgtatttacattttactttacatacgtaagatcacagccaaggaggttaactataatttcaaattttattaccagccacttgtgctattttatcacatttgaaaatattcactcttactatatttactttaaacagtgatctataaatttgtttagacaataataattaaggaccttttcttcttcagaatgataaaaaaattaatgatgtattgaagatactactaaagaaactttacttttggagtatggcctctgcattgaagatctgtaggattttttaaaattaattttcaagtctttccatgacctctctgttctaagaaatatcatctttgtaataatttgtgtgaatactttacaaatcaaaaattgattcacaatactgtactaccataatcactaattttaagtctcttaaacattttctatattacttttcttgattataaaatgtcaataatatgggcatgctcttaatataacagaatatttaattatattatttttcccatcaacccaccagtcatttattaattacattggccatttccattgattggcaggaggctcttccatgaacatctcctatcatttccactgtatcatttttcttgccagacttagttcattttcagcctgaagaatcacctcttttatttgaacaccttgaagttggtcttctaattttttaacatctggttctgctttaaccatagccaatttctcatctgcaatctgttctgtatactttctatgtgctgctttttaaggggtttgcttaagaacatcaaggatctttgtgtacaatattcttagcctcttacattttagcagactgattttagttgcttgtcttgtgtggactcttgcatacagccaatcccatgaggccagtggtcttcttcagcacacctgccatgacagcgccaatgagccagtcggatcttctttaatttctttcaacaatattttgtaatttttagagtatacattttttccaagaatataattatatacatattgttttatatgatttctttgaaaaataggagaagaaataagaaatatgcacttaaaactgccttttataattatataattacctttatcagtgctctttgttctatcatgtggatttgaatttccgtctgtatttgcttgctttcagcctagaggatttcttttagtatttcttgtaaagtgggtctgctagcaatgaattctcttagtttttgtttatgtaggtatgtctttattttgccttggtttttgaaagacagtttttctgtttttaatatttttggttggcaggcttttctttcagtattttgaatatgtcagcctgctgccttttggcttccactgtttccgataggaaatcagctgctaatcttattatcattcccttgtatgtgatgagttatttgtctctcactgctgtcaatgttttctctttgtctttcaagcacttttactattatatgtctggggtggatttctttgagtttgttgagcttcttggatgtgtaatgtttttcaacaaatttgggaagttttctatcattatgtcttctaatactttttctgttcatttctttctctcctctcctggtaatcctatctcactcatatgttagtacacttaagggtgtttcacatttccctgaggctatgttcatttttctttatccctttttctttctgttcttcagattctataatctctatcgatctttcttcaagtctgatgattcttttgccagttcaaatctactgttgaacacctctaagtgaatttttcattttggttattgtatatttaattttggaatttccattcaaaatagtttctcttcattaatatctctatttgatgagaaattgtcatcatagcttcctttactcccccacccctcaccagaggtagaattgctgaatcatatggttattttatttttaacttttttgagaaactaccatactgttttccattttatatttccaccaacagtgcacaagggttccaattgcttcatagtctcaccaacacttgttattttctgtttttttttttaaatagcagccattctaatgggtgagatggactatcttattgtagttttgattgtattaccttaatgatttagtggtaaacatttgttcatgtgcctattgtccatttgtatagatttttggagaaatgtctctttaagttatttgcccttttattaatagcactgtggtttttttgttttgggttttaggagttctctctatattatggatgttaatccctcatcagatacataatttataaatattttctcccattctgtgggttgccttcttactctgttgacatagtcttgtgatgcacaaaattttaatattttcatgaagtctaatttgttgattgttttcttttttttgcctctgcctttggagtcatatccaagaaattattgccaaattcaaattcatgaagcttttgccctgtgatttcttctaaaagtttgatagtttttggtaggtctttggtccattttgaatttttgttttggtatttggcactacgtaagagtctcttttgcatgtggacatctaattttcccagcacaatttattgaaaaaaactgtcccttcctaaatagatagtctcattgctcttgacaaaaatcacttgatatgagggtttatttctgggcttttcattctgttccattggtctgtgtgtctgtctttatgccagtaccatactgttttgattactgtagctttgtagtaagttttgaaatcaggaagtgtgagtccttcagctttgttattattcaaagttgttttgactactcaaggtcccttgagattccatatgaatcttaggatgatgtttctatttctgcaaaaacatcattgggattttgatagggattgcaccaaatatgtagatcctttaattctttaagcatgaattcctttaattctttgaatatagttacagtggatgcttgaaatcttcattggctaaatatgacttgaggccttttgcaggcagtttctcttgcctgtgttcccccttcatgtatgcatactttcttgttcctttgcatgattcataattttttgttgaaactgtatatttttggtaatatatggtagccactctagataccgatcttccacccgtctttgtagcttgcttttgttattttttacttctttattcctgacttggctagactatttaatttagtctattatcccacagcacgaagcctctgtctttcctcagaggctgtatgtagccttggatatgtgcacattcacaccctgggataacagtggttttagcagagccatttgactgttgcttttcctgatctatttgtaaaagtatctacttctgctggtatcacagccagtgttaggctccacaaattgtcatctgattgctttattgtttttgatcatgtgatggggaatacattgtgccacagtctgatccaattaaatttgggcaggagtatttttgaggccagtctttgaggtttgttttgaccccaggaggattttccttagctgtctttttccacggtattctgctgttattgggtgaagggttttataaatatcaattaagttggatgaaagtattgtccaagtctcctatattcttactaattttctgtctacttatttttcaactactgagacagggatgttgaaatctttggctgcaattacagatttgtctattcctcctttcagttctatcaggtcttgctttatgtattttgaggctctgtcattagatatataagcttttaggactgttatgttatcttgatgaactgacatctttgtcattttcaaatgaccctctttatccctgttaatgtttttgctctaatatctactttgtctgctattaatatagaattggagctttaattttttttttttttttttttgagatggagccttgctatgtcgccaggctggagtgcagtggtgtgatctcggctcactgcaagctctgcctcctgggttcacaccattctcccgcctcagcctcctttgagtagctgggattacaggcacgtgccaccaggcccagctaatttttgtatttttggtaaagacggggtttcaccatgttggccaggatggtctcaatctcc

SEQ ID NO: 181 - DNA, 22343 bp, Homo sapiens
accccttaacagtcttgcctacctccagtgtcgtgtgcctctctcccctgattcttcccttagggtgagctgaccacatgcgcagtgtcctccttacccttgggaagtgagcacatgcagggtgtttaggaagttgtacgcatgcccatctgaggctttgttcccttttcctgtggagtgtgcccctggaaatttttttttttttttttttttgagacagagtctcgctttgtcacccaggctggagtgcagtggtgcaatctcagctaactgcaagctccacctcccgggttcacgccattctcctgcctcagcctcccaagtagctgggactacaggcacccgccaccacgcccagctaattttttgtatttttagtagagacggggtttcaccgtgttagccaggatggtctcgatctcctgacctcgtgatctgcccgcctcggcctcccaaagtgctgggattacaggcgtgagccaccatgcctggccctgtccccggaaattcatactcctccattttttctcttaatgtgcattccccgggctcactcacccaacacctgagattttattggaagccctttttgcttctctctggcccctgctttcaatggacactttaatgttaacagctgtggaccattagaagcctgtctctccctggagcctaactgccaaattatcatttttagagaggcaatgtgataactgttgaaccatcacctgacattcctggtgggtgggggagagccctctcctaccccactcatgcctgtctaactacctgtaacatctctacaaaaaataaaaaaattagctgggcatggtggtgtgtgcctgtggtcccagctacacgggaggctgagccaggaggattgcttgaacctagaggttgaggctacagtgagctataattgcaccactgcactccagcctgggtgacagagtgagactttgtcaaaaaaaaaaaaaaaaaaaggaaaggaaagaaagagggttgggcgcggtggctcatgcctgtaatcctagcactttgggaggccgaggcgggtggatcacctgaggtcagaagttcgagaccagcctggccagcatggcgaaaccccgtctctactaaaaatacaaaaattagccaggcatggtggcgcacggctgtaatcgcagctactcgggagaattgcttgaacccaggaggtggatgttgcagtgagccgaaatcacgccactgcataccagcctgcgcgatggaagcaagactccatctcaaaaaaaagaagaaaagaaaatttaaattcagctcctcagttgcactaccacatttcaagtgctcagtagtggctagtggctattggactgggcagaaaaagcacattttcgtcactgcagaagctctgttggacagtgctgctctggaatgtcagctgcaggtggacagggatttctgtttttgttgttcccagctgtattcccagtgcctggaacagtgcctggcacacagtaggtgctcagtatttgcctgttgaatgactattgaaattgtcagagatgatgggtggctgtgatcaataatgttaattactgtcctaagccccagtgctgggtggaggtcattgatgtgtgtagggggaggggcggtgggaatgcatgtaggtgaccatcaggcacaggtgaaagggtgagtatgagttttggggcgagaaggctctgcagcagaatgaagtgcaagagagagacaggaaagtctagaccactctggtgtgtatgagaagcagcctatgttgaggacaccaagagtaaaccttttaaaaactgttcagtcccctccaggcatccaccgtctgcacagacttaccccggcccccacgtagagaccaccctgcctggcaggagccagaggtgatggtgggagcagagtctggggaggagccccgtagggagaaagccccaggcggggcggcgagggcggaaggcgggcggtggagcctggcggtgccgtgtccctccctgcaggagctcaaggagtcttgcatccggaaccaggactgcgagactggctgctgccaacgtgctccagacaattgcgagtcgcactgcgcggagaaggggtccgagggcagtctgtgtcaaacgcaggtgggtatcgccgcccggggggagccagaggggatccaggggaagtgggagccagggcgggcccagattcctggggaggaaagaagggtaggtgggcggaaatgccctggagcctggaattcccccgtgggactgcacctccaagccttctgggggagcctgtggacggaaccaatatggtagcccaccctagggttttggaatcctggattggggcgggaaggcgatgtttcactttctaatgtgggttcacattctccaggagtcttctcagcaaattccgaaagtagtacagtaaatgggcacagctaggtccagcctctgccccagagccccgtcttcatccagctcaggagttctgctgtggccccgggtgttcctggtggaggatgggcagaggcagcctctgagctgggtgtgtaggggagggagttgatttgcccatggaaggatttaaagacaagacatagaggtcctgcgatggtgtgtccatggacttaggacaggcagatgggtcagtgacaggcagggttacaaggtctggagctgggaggacactgaacaatccaggagccagcctggagaaggcagccagaggtgccactctgagcagctggcaagctatcatttatccctggatcctggctgtgggcaagcacatgggccctggagctgggctgggctgggcttaggggctcagggaagagctgccgccaaggtcgaggtcaaagtcctgtctttcccaggtgttctttggccaatatagagcgtgtccctgcctgcggaacctgacttgtatatattcaaagaatgagaaatggcttagcatcgcctatggccgttgtcagaaaattggaaggcagaagttggctaagaaaatgttcttctagtgctccctccttcttgctgcctcctcctcctccacctgctctcctccctacccagagctctgtgttcaccctgttccccagagcctccaccatgagtggagggaagtggggagtgattgaaataaagagctttttcaatgtttgctgcccacagagttggggcctgggtgggctgggctggggtgggcatggtacaggtttctggggggtggggaggtgatatgagggaggaagcaggaagggacactgttggacttggggtctttccccagttggggcatgaatgaaagtcccccagaagagaccaaagctcccttcccaccccaacccctttctgccttcagcccactctgtaatctaccccccggaagcccagtttacacctgatattccagttccacgaccttaaatttcagaaatgtgaaagaaggtacacaaaatatccatgtgtataaagaattgaggatgtttattgagcacttactagatgttaggggccgctctagctgccttatgcacatgatctcatttaatcctgcaacaaacctgtggggtctctcctgttatcacctctgttttacaggtagggaaacgggttgagcaacttgttcaaggtcacacagttggaaagtgctgaatctgaatcttctgggaggcaagagaaaagagggacaagaaaagaaggaaggaaggaaggaaggagagcctaggaaagagtgagaaagaaagactggagcagcgactgtggtgtggggttggagagagaatgagtcaagtggagttttaggaagtctcagtgtgtggtgaggcttttggagttagatgctagctcgcttgtctgtgagtagtgcctgttatattcaggttacattttggagttaattatttcagattttggacctaaatttccacattcagccaccagaactgagccaaacatgccctccaggatgttgggcttaggatgcaagggctggggagtttggaggtaaactatggttgtacttagaacgcccccttgtaagtcatagcaaaacgatgtgaaccataccttggtagaatatgctgtcctgtactaaatgtatcagacagataaccagacttccattgtgttatgtgagctctccccattcagagaaaacctatgaaatgaccgtggaaggagaggtggcaggctggaaacccaatgatacccaatgtctaagaagttcccaaggatacccaatgtcaagaagttagaaggggaaggggagaatacagagcccagaaataaacccaagcctgtacagccaattaagtttcaacaagggcaccaagaagacaccttggggaaaggatagtcttttcaataaatggtgttgggaaaactgaatattcacatgccaaagaatggaattggacccttatagcacacacaaaaataaactcaaaatggattaaagacctaaatataagacccaaaactgtaaaactcctagaagaaaatataggggaactattacacgacattggtcttgacaatgattttttggataagacaccaacagcacaggcaacaatagcaaaaataaacaaatgggactacatgctgaaaagctctggaccgagcacggtggctcatgcctgtaatcccagcactgtgggaggccgagttgggtggatcatctgaggtcaggagttcgagaccagcctggccatcatggtgaaaccccatctgtactaaaaatacaaaaattagctgggtgtggtggtgcatgcctgcagtcccagctactcagggggctgaggtgggagaatcacttgaacctgggaggtggaggttgcagtgagccgagatcataccactgcactccagcctgggcaagagagcaagaccctgtctcaaaaaaaaaaattaatttgaggaaattttatggtttggttttgttttgttggagacagggtctcactctgtcacccaggctagagtgcagtggctccatctcagctcactgcagcctcatccttctgggctcaagtgattttcccatctcagcctcctgagtaactgggaccacaggtgtgcgctaccacacctaactaatttttaagatttttgtagagatggggagggggagatctcaccatgttgcccaggctggtctcaaactcctggcctcaagcaatcctgcctcagcctctcaaaatgctgggattacaggcatgagccactgtgcccggctgaaatttcacttttttccaatattggatattttcatccaggaatataaaatgctttaaaacaaagttgttaatttttttaataaacgtttttagcctaataaggaaaaaaaagaaacaaaaaagaaagggagttggggaagatacgttgctgacatgactaaactggttccaagtgttgggggaggaaaacttttcctctatcctcttaggttcagtacttgaaggcctgagaattaaaccgataaaagagaaatgaccgatttttattcagaatgtagggaagttcatggaagagtgtgactctagaaggaagttagaatttgcgggttatgtaccatctcaatagaagaaggggaggaggagaaaggacacttatagaaaagtaatttttaggaaagatgaatgggcccttaggagaaaagatgggagctattatagtttcgtgacctgactgtttaggtgtggtgccaactattctcccctccagcaataagtcaattttccctggttttgagaaactcctgggagggggatttatgacaatggagctcttttgcagggctctgcatttaggcagacaaaggagttcagaaaagagcctattctcatccagcctgggcagcattgcgaaaccctgtgtctgaaaacaaacaacaacagcaacatagccggtggtggcacgcacgtgtagtcctagctacttaggaggctgaggcaggaggatcacttgagcaccaggaggttgaggctgcagtgagccatggtcgcaccactgcattccagcctgggtgacagagcaagactctgtctcaaaaaaaaaaaaaagaaagaaagaaaagaaaaaggcccattttcaaatgccttctgctcagaataatttttatgcttcagtggcattctctagaccccttcacaagccatggggattccgctgccctatgggaaaagtggtcattggtagaggctgccgttgtcagaatccagagagatttgtagggaataaagtacagatgctccttgacttacgatggggctacatcctgataaacacattgtttaagttgaaaatatcgtaagttgaaaatacgtttaataggccgggcacgggggctcacgcctgtaatcctagcactttgggaggctgaggcaggcggatcacaaggtcaggagttcgagaccagcctgaccaacatggtgaaaccccgtctctactaaaaatacaaaaattagctgggcgtggagggcacgcctgtaatcccagctactcgggaggctgaggcaggagaatcacttgaacccgggaggcggaggttgcagcgagccgagatcgtgccattgcattccggcctgggtgacagagttagactctgtctccaaaaaaaaaaaaagaaaaagaaaaagaaaatacatttaatgggcaggtgtggtggcttgtgcctgtaatcccagcactttaggaggttgaggtgggcggattgcttgagcctaggagtttaagaccagtgtgggcatcatggtgaaaccccatctccactaaaaatataaaaattaactccgggcatggaggctcacacctataatcctagcactttcggaggcctaggtgggcagattgcctgagctcaggagttcgcaaccagcctgggcaacatggtgaaaccccatctctactaaaaatacaaataaataaataaataaataaattagctggacgtggtggcatgtgcctgtagtcccagctactcgggaggctgattcaggagaattgcttgaacctgggaggcagaggctgcagtgagccgagatcgcactattgcactccactctgggcaacagagacagactccatcttccccccgccacaaaaataaataaataaataaataaataaattagccaggcatggtggcacacgcctatagttctagcacttggggaactgaggtgggaggatcacttgagcccaggatgtcaaggctgtagtgagccatgatcatgccactgcattccagcctgggtcacagagtgagaccctgtctcaaaaaaaaaaaaaagtatttaatacacctaacctactgaatatcatagcttagcttagcctaccttaaatgtgctcaatcagaatgcttacattagctgggaaaaataacacaaagcctattttagaataaagtgtcgaatatatctcatgtaatttattgatgttctactgaatgcatattgcttttgcaccatcataaagttgaaaaattgtcagtcaaaccattgtaagtggggaccatctggttccttgagctgtggttagactgtgcctctgctgtgtaggcgtgtgatgctgaaaagcagcagaaattgagagtctacaggagcactggccgttggaaataaaatggaagctacataatggttggggtcttggtcacttgcttctgcagagcccaaagcccaactccctactcacttttgaagaccagggacattttccttatgccccccacagtccaaaacacggtgccaggcacactgtggtcattcagtgaacacatgaaggggacatgaatgcagatctccaggaccgaatgtggcaccaagaagcgtgactcagccctgctcagggcctgagacccctcctgggttaaggtattgaaagctcctcttgttgagcacataattcatatgtggcagacaccattacctggtttcctaatagccattgcccccttccctgccaactgaaacccaatattgtttgggcatcaatgaacctggccccaggagaaggatcttattccctttgctttcccagcgtcccttgcagctagaagtagtcagataacctagttctagccactgagatatgaagagaagtcggccttgaggatttgaggaaagataagaagagggtatggtccaggtgccatggttcatgcctgtaatcccagcactttgggaggccgaggcaggtggatcacctgaggtaaggaattcaagatcagcctggccaacatggtgaaaccctgtctctactaaaaatgcaaaaaatcagccaggcgtggtggcaggcgcctgtagtcccagctacttgggaggctgaagcaggagaatcgcatgaacccaggaggcagaagttgcagggagccgagatcgtgccactgcactctggcttgggcaacaagagcaaaactctgtctcaaaaaaaaaaaaaaaaagggtatgcaagaagaaactctctgctccttctcccgccttcccagctgccagctactccatgcttcctgccttcgaatacggtgagaacgtgaagtcatgagctgctgctaaggcatgtggcaaccttgaagagaaggtcaagagctaccagccaccaaaagaatgccagcacttcctgtgtctttgctttggattcatgagaaatatacgttcctatttgcttcagccataattacttgggtttttctgctactcacagttgaatgcaatcctaactcataagcctgtggttacaggaggattcattgatcacagaactgcaagatcctggggctgggacgacatcgaagtttcattcagttcactgtccctcactctctgtgggaatctcctctctagcatctccaccgaggggtcagtgagcttccacctgcgtacctggatgatgggcacctcagtactgcctaaggtaactcatgtttgatggctccaggggatatacaatttttatattaaggcaaaattaaattccttgcagtttccacccatttttcttaatgcgaataattgggaaagaaaaaggaatcataaggccgggcacggtggctcatacctgtaatcccagcactttgggaggctgaggtggtggatcacctggggtcaggagtttgagaccagcctggccaacacgatgaaaccccgtctctactaaaaacacaaaaattagccgggcgtggtggtaggcgcctgtaatcccagctactaggggaggctggggcaggagaatcgcttgaacctgggaggtggaggttgcagtgagccaagagatcactccgctgcactccagtctgggcaacagagagagactctgtttcagaaaaaaaaaaaaaaaggaatcatagaagcagggcagtggagttagatggtagagtgccaacattttctgattatgtgacattgggcaagctcctctctgaaacttggtctctatctataaagtggagatgagaaattctccctcctgggatccttgtgagcatttgctggcagagagtaagctcatagcaattgagagtggtctgaccccttaacacatgagttgtgtcagctagctgtcatatttgagaattgtgtccagaaaagaggtgagagcccaggattctgatgcctctgatgcagggtgacgaacatgggccattaaaactccttacccacaagtgtgtgtgtgtgtgtgtgtgtgtgtgtgtgtgtatgtgcgcgcgcatgcacatgtgcccgcttgtctctttgagaaccggagggacaaggagggcatcccaggtaggtgtgacttctccccagaaatggagggtttcctaggctggctgggtctccttcacagctttgtcttcagtctccaatctgtttggccacaacttcttcagccccagacccatcccttgttcttctgacctgcctgaagcctgccctggtggaccaaaggcctgatgcaacttcagagaagatgctgagtcagaaagaatatgcaggagactgggaaaggtttgcaggaggcctttaattgtgaagagcgcaatcagaaaacagatatgctggtcaaggaggtggccagcccgggagatgcgctggagcaggggagagatgcccctgcgcctagtggcctacagcattctgggctaggtgtgggagtgggtgggcagtctcactgcttggagcgtccagcgtcatggcagatgccaaagttggtgttggtgatggagcccacgatggtcttgtctccctcacaggtcaggccacgctcacagggacacttgtagtaaatcccatagagcgtctgcagagacacagccaatggagtcaaggctatggggagatactttggacatcacttgtcccctgcctgacctagagaaccagtaggccagcctgtgttttcggggagtgcctctcccacctgcctccccaggggtgccgtgggccctggagaccccagctctgacctctgctctggctcatttgctcttactagcttgatctctctggggagcctctatttacccagccatgaaatggggataacaaatccccacccccacccatctcactggtcactcgggagggtcaagagagatgatgggatgggaaagtgctttgacacctgtcgacctccctctcgtctcctcaacattcagtgtccaggctgacccccctccctgatcccactcacaagtgttcagggccctactccccattctcccccacccacgccaagtcctcaggcacccaccttgacagagcactcgctgttctcgctggccatggatgtgcagcgggccaggcccagcgcacttgaatgctggcagcaattgctcttacactgggcactattcatgcagagctcaccgttctcctgccaggagcagccagtcagcccaggccccactccctcaggtcccttctccattcagacctgtacccaccacacactaccactaacagtgtctcccctggtagggatgtgtgtgaaggagtccatcccctgggtctggtggcctctgtgccccccacccacgtgagaagtgggcatgcggtgacagagaagcagacttgcacagagggtcaggacccctgggttctagtaccggctgtgctaccaacctcctgtgtgactctgggcaagtcactgcctcccaagcctcagtgttcccatttggaatgtgcacacaaggcccctagacaagttctccaaaccactctgggtcccacacctctttaaggaggcggtgaagattgcatctccctgcaagactccttcctcccccaacagatctgatctataatctccaagggtcctggacctccaagtccagccatggccccaagttaagagagttcagaacctttcaaccgcatggacgttctggaagggctttcccagccaagacccatggtggagaggtggtgtggggcagtggtggggccccagctgaaccactttccagctatgtgacctcaggcaggttgctcaccctctctctgtctgaagacagggctgactctgaaaacacctccctcagtggttattatgagaacagaatgagtaaacatctccgaggcatctccataagtcagaagctggaatgattggcgcaaagcattttctcaggatggaagcccagggctctggatttttacaaagctccctcgtagggccaggtgaggtggctcatgcctgtaatcccagcactttgggaggccgaggtgggcggatcacgaggtcaggagtttgagactagcctgggcaacatggtgaaaccctatttctactaaaaatacaaaaaatagctgagcgttatggcaggcacctgtaatcccagcttcttgggaggctgaggcaggagaatcatttgaacccgggaagcagagattgcagtgagccgagattgtgccactacactccagcctggtgacagagcaagactccgtttcaaaaagaaaaaaaagaaaaaaaaggtccctcatagccaggttgagctgctgctctgagcatgctccagttggagctggagaggggctgatcagcctttcctgtggcctctgggaagaggcataggacaggacatggaagtaaacagagggatgcaagatgccactcctcccagcccctgccagtccaggtggagacatcagaggtcaaggtccaagcttaggaagtcttcatctggggactcaggaggcgcctcccctgaagaccctcttaccaggttgataatgatcccccgggggccaggagctgcataggccacagagagggcgacaagcaggaggatcaggatcttctccatggtgagtgggacagctggtgtgggtggcgggagacagagccagctgtggtgatggggctataaaaggggccctgacctcacgagatccacctgcatcccacagggctggccgtgggcagaggcacagctgtggccaatctgctgtggggcggttcctgataaggaaactgggtgagtacctggtggcctttttcgtgtgtgtgtgtgtgtgtgtgtgtgtgtgtgtgtgtgtgttggtgataattgtgttgcatcgtggttaagagtatggactgtgtacaagttattagtgaggcaaacttactatctgttccaactattctgcctttcatcttatctgtcaactaaggataatttaaagagttgtgagggttgaattaatacacatttatgtgttacatatatataaacattattatatacaattataagaatatatttatattgtatattcccatatgccacataagcagtgggtaagggtggctgcccttgtgtcttgagctcctgggcagtgcctggacgaatccaaggcaagagaggcacctatggtgtgagtgcctgcttacattctgtgtacttggggcctctctgcctcactatagtcaggccttgcctttggcccacccaagcccaggtgtctagcagtgtcagactccagggacgaggatcctagcctcccacccctcaaccttccttcagtctcctcgggggattccaggccatgcccagatccctggggctgacagttctgcaacccccagcaggccagggtgtgtgtgctttcactttggcaccctccccctgccctcacaccaggggctgcctgcaggcctgactcaagggcccttaggaggcccttcctaaatgcctctctcccctttcctttctacctcacttactatctgcaattccagcatcagatactcacccctttagttaaggtttccactcacgctgccccctacccaaggccacgtgcgcgcgtgagcagtcgctagtcctggctgagaatgaagaggtctcatgagcctcagatggagcaggggcctcaggaagctgggaagggcacagctgcctgagtttgctcaggcatgggaacagagcagcttttcctgaaggactagtcatggcagccagaggcccctgcccttcccctctccatcccaggaggtagaagacagctccactgagaggcccaggcctcaagcacagcttttaatttaatttaatttaattttttgagacaaggtctcactctgtcacctaggccgaagtgcagttgtgccatcttggctcactgcagcctccacctcctgagatcaagcaatcttccccctaagcctcccaggtctaaaactcgtgggctcaagcaatcttcccacctcggcctcctaaagtgttgggattacaggtgtgagccactgtgcccagcctcaagcacagctttgatccagaccaagctggcttcaaaattcagcatttactggagctacgtggcctcagacacattattgaaagtgaagctccctgaacctcactttccttatttatcttagggggataacgcctcctacttcctgaggtcatgattaagacaatgcacgtggaacaccttcggaagtgcctggcacatggtgggtgcccagccatgtaatatgacccccttcctctcacctttacatccctggggtgtggaatgtagagaaatagctggaggaacaaccaggagactctcaaaatgagaaaaaccaatttggttccagcgatgcagaaataccattgatgaaagaacactatcccccctctcttttatagaactcaatgtttgaaagcactttttcctatgagttcactctgatccttccttctcttttctctacctgctccccacccccaggacctctgtgaggtgagccacagagaagggaatcactattcccttctcacaagtcaagatggagactggcaaaggaatcagaggagtgatttctctccatgaagggagctgtgaaaaccatcagccctgtccctagttggtctcagccaagcttgcaaagaaaaaaggctggagttttttccattacaaatgaagtgtagcaaagagaactttgacactgtatgtgcttctaaaaggaaagcaaaaattaagtacctgtcaatgaaaagagtcaaactctgtacaatatttgaatagatttattctgagccaaatatgagcaaccatggcctgtgacacagccctcaggatgtaaccactgaaggggttcaccttgcccactacctagatagagccgattcatcaagacaggggaattgcagtggagaaagagtatttcatgcagagccggctgtgcaggtgcaggagactagagttttagagttgttgttgctgttgagacagagtttcgctcttgttgcccaggttggagtgcaatggcatgatcttggctcactgcaacctccgcctcctgggttcaagtgattctcctgcctcggcctctcgagtagctgggattacaggcatgtgccaccatgctcggctaattttgtatttttagtagatatggggtttcaccatgttggtcaggctggtcttgaactcctgacctcaagtgatccacctgcctcagtctcccaaagtgctgggattacaggcatgagctaccatgcccagcagggagcagagtttttgaagataacttggtgggtggggggaagccagtgagccaggggtgatgattggtcagagatgaaatcatagggactcagagctgtcttcgtgcacccagtcaattactgggtgagggccacaagatcagatgagccagtttattgatctgggtggggccagctgatccatcaagtgcagggtcagcaaaatatctcaagcactgatcttaggagtagtttagggaggatcaggatcttgtagcctccagctgcgtgactcctaaaccataatttctaatcttgtggctaatgttagtcctacaaaggcaatctagtccccaggcaagaatgaagtcagctttgggaaagggctgttactgtctttgtttaaactataaactaagtttctcccaaagttagttcagcttacgcctaggaatgaacaaggacagcttggaggttagaaacaagatggagtcacttaagttagatctctttcactgtctcagtcataattttgcaaaggtggtttcagaatgaggagaaaacaaagaaaatgacccccttttgagcactccgtagcttttatggcacctctacctgacaaagtttatgtaaaatggaaataacgtggtctttgtgcacatttacattaaggaaaaagagccctaaggttgacctgcaaactatagaattcctaagtcatctttttctctatttttcttttctgcctgctctaaatcttccttccttccttccttccctccttccttccttccttcctccctcccttcctttcgatggagtctcactctgttgcccagcctggagtgcaatggcacaatctcatctcactgcaacttctgcctcccgggttcaagtcattctcctgcctcagcctcctgagtagctgggattataggtgcctgccaccacacccagctaattttttgtatttttagtagagatggggtttcaccatgttggccagtctggtctggaactcctgacctcgtgatccgcccactttggcctcccacagtgctgggattacaggcgtgagccaccgcgcccggcaatctgctgttatttttctattaagagaaaaaccactgtttagatccaacaagttctttttgcaagccaggtgaatttgtatttatttcatggctaaaagttctgaagtaaaagctacaaggtgtgtgtgtgtgtgtgtgtgtttaaaaggcctttataatttccatacttttatgtttaattggcaattaaatctgttttaatttccctctagaacaccagacttttcttggcgcaccttataatgtaaattttgctgtttgactttcatctgaactgtttcctttaatatgcaaatttaaggctatttagctgtcaactgcctagggttgtgaaagaggttatcaagaatttgataactcttgaggtcaggtgtttgagaccttcctggccaacctggtgaaaccccgtctctactaaaaatagaaaaattaactgaggatggtggcaggcacctgtaatcccagctactcgggaggctgaagcagaagaattgtttcaatttgggaggcagaggttgcagtgagccaagattgcaccactgcactccggcctaggtgacagagcgagactccatctcaaaaacaaacaaaaagaatctgaaagattaaaataggaaaaaaaaaggtttttataaatctgtaagatgtacttctataggcatgcctgatatgtctatgtatttatgggtggtgtgcacagtgtttcactactgaaaataaataaaagagctctaattggcttaagaaaataaaagcacttgaacactttatcaggaaaaaagactagtcaaatgctgtttcaagtttatgtaatgtaagtaaaatctttaatacataagctagcttcaaaattattattaatgttgggattacaggtgtgagccagccactgcacccagccacttttttactattaaaaacaacctgagccaggtgcggtggctcacgcctgtaatcccaacactttgggaggccgaggcgggcagataacttgaggtcaggagtttgagaccagcctgactaacataatgaaaccccatctctactaaaaatacaaaattagccaggcatggtggcacatgcctgtaatcccagttacttgggaggctgaggcaggagaatcgcttgaacctgggaggcggaggttgcagtgagccgagactgtgccattgcactcaagcctgggcatcaagagcgaatcttcgtctcaataaaacgaaacaaaacaaaacaaaattaaacaaaacaaccttactggccgggcacagctgtaatcccagcactttgggaggccaaggcgggcggatcactaggtcaggagttcgagaccagcctggccaacatagtgaaaccctgtctgtataaaaatacaaaaattagctgagtgtggtggctcacggctgtagtcccagctacttgggaggctgaggcaggagaatcacttgaatccgggaggtgggtggaggttgcagtgagccgagattgcgccactgcactccagcttgggcaacagagtgagacttcgtctcaaaaaaaataaataaagtgaaaaagtgaagggccaggctcagtggctcaagcctgtaatcccagcactttgggaggccgaggcaggtggatcactttaggtcaggagttcgagaccagcctggccaacatggtgaaaccccgcctctactaaaaatacaaaaattagctgggtatggtggctcatgcctgtactctcagctacttgggaagttgagacaggagaatcgcttgaacccgggaggtggaggttgtagtgaactgagattgagccactgtactccagcctgggtgacagagcaaaactctgtctaaaaaaaaaaaaaaaaaaaatgtgaaactgacaaaacataccaaagggaaaaaaagtaataggagaaaatattaacattataatgctaagtgaaaaaaatgtacatacggccgggcacggtggctcatgcctgtaatccagcactttgggaggccgaggcaggtggatcacctgaggttgggagttcgagaccagcctgaccaacatggagaaaccctgtctctactaaaaatacaaagttagctgggtgtggcggccatgcctgtaatcccagctactcaggaggctgaggcaggagaatcagttgaaccaggaaggtggaggttgccgtgagccaagttcgcgccactgcactccagtctgggcaacaagagcaaaactctgtctcaaagaacaaaaaacaaaacaaaacaaaaaactagctgggcatggcagtgcatgcctgtaatcccagctacttgggaggctgagacaggaggatcgcttgaaccagggaggcggaggttgctgtgagccaagatcatgccattgcactccagcttgggcaacaagagtgaaactctgtctcaagaaaagtaaaataaaaataaaataaaataaaataaaataaaattgtacatacatcatccaattgtgtaaaggagtatgttcagaagggggaaactgcagagattaacaatggtaataataataatcaccaacatttttgagtactttctctttttttgttaaagcccagactggagtgcagtggtgtgatcatggttcactgcagcctcgacctcctgggctccagtgattctcccacctcaacctcccaagtagctgcgactacaggcaagcaccaccatgcctggctatgcctggctaagttgtgtattttttgtagagacgggagtcttgctatgttgcccaggctagtctagaattcctgagctcaagtgatcggactgcctggcctcccaaagtgctgggattagagaccactaatgtacctttgagcactttaaaaaaaaaattattattattattttttgaaatggagttttgctcttgttgcccaggctggagtgcaatggtgcgatctcagctcactgccacctctgcttcccggggttcaagcaattctcctgtctcagcctcctgagtagctgggaatacaggcacccgccactacgcccggcgtaagtgcatttcctgcatttaatagatggcgaaactgaggctccggaaggaaggttaagtccatggatggttacttagtaagtagctcattcaaatccaggcctgttgaaccccaaagtccatgtttttaagattgtcttgtctttccttagctccggacgttggtgttattattattattatttttttttttttgagacggagtcttgctctgtcacccaggctggagtgcagtggcgcgatctcggctcactgcaagctccgcctcccgagttcacaccattcttctgcctcagcctccccagcagctgggacaacaggcgcgtgctgccacgcccggctaatttttttgtatttttagtagagacggggtttcactgtgttagccaggatggtctcgatctcctgacctcatgatccgcctgccttggccttccaaagtgctgggattacaggcgtaagccccacgcccagtggaattttcctagttctttacactagccatgtatttacctataaaatcaggagaaatatgtatatatataatatattaaaacatatatatatttaaatggggaaatatgtaacaaacaaatagaaacaaggggagaaaggcattgtatttgacaaaacacatatgttcaggtctgagaaggctcataaagaatgttgtctgctatactttgtagttgcttctgttatcacacaatcagtctgcatatacaggcgttttatatatatatttatatagactacatatatacgtatattatatatgtaaatatttcactgtctttgaggacgggggccctgtcttttttatctgtggttttgcttagatgtcctccaacataatcttaacacatagtatgcttttagaaatcgttgactgaatgctaaggacgaaaaaccggtgaccagaaggcaaccaggaaaggctttgctgacctccggagtggtggagttggaggttctgggaaggcgactagggagccaggcaggggcggggtgggatgggatgtggacagcgcttttgcggggggaaagcgtttttgctgctggaattgagcagtaggaatgtgtcagtcacatccccaccttcccaattcttgtcatctcggttcaggaaggtgaacggtgttccgattccccgcggcgggggcctgtagtgggagctctgccccttccccgcctctgctgcaggccccgcccctcgcccggaaccccggggcgctggccgcggtgctgaaacggcgccctccgcggacggaggagggggcggggctctcgggagccgtgagccgggaagagggagacgggcagggcggcgccagcaggccctggtgggcttgggaggaggcaggagactggagacagcctcggctagagcggacacaggcacctggcaagctttccttgaccaaatcaaggttgtccttgtcctattaagcctcttccccttgccttgaagggacctcacctggtgccctgacctcagcctcctccccaaaccccgctggggagtgacctgcttctaggcctccatccacaaagctacggacttgcagcccacgggaccccagcccagggcctgctgccctcaccatggtgaaattgctgccggcccaggaggcagccaagatctaccataccaactatgtgcggaactcgcgagccgtgggcgtgatgtggggtaccctcaccatctgcttctccgtactggtcatggccctcttcatccagccctactggatcggcgacagcgtcaacacaccgcaggcaggctacttcggccttttctcctactgcgtgggtaacgtgctgtcctccgagctcatctgcaagggcggccccctagacttctcctccatcccctctagagccttcaagactgccatgttctttgtggccttgggcatgttcctcatcattggctccatcatctgcttcagcctgttcttcatctgcaacacggccacagtctataagatctgtgcatggatgcagctggctgcgggtaagcagagatggtgggagggcaggcaggggcccaccccggggccacagctgcagctgcaccatcccagcctctgccagggctctgggccttaaatttagctgttctcctatagcccagtcctactcagtgctctgcagaagattctgaggagttgagaatcttaaaatggcagaggcagaaaagaccttagagaccaagctgtccaaccctctcatcctacagatgaggttctgagcccagaacctcatctgagcccagaacctcatctgtaaggggaagtgacttgcccaggagcacacagttgccagtcctgattcccaggccatcacatcagtttttgcagctgtgagagagagaaagaaggaagcttccattgttggccatgtgggaataggactcaaccctagcacaaagtagtgacaccagtcaagcacattctagatgccttcatctcccacctctgggcttttgttctttttaagagtgcccagaactctgtcctcattctctctctcccactccaaactgctctcagattctaaggtctcttgctgattttggagtgttactattatgcagggtatgaccttgcctatagaaactttcatctaaattcccctctttcattgtggagtgaaagtcttttttccttgatcatgggattttatacttaaggcagcaaatggagtgatattttgtgaggtagaggaagctatttagggtccttttgttgttgttgttgtttgtttgttttttgagacagagtctcactctttggctcaggctggagtgcagtggcatgatctcagctgactgcagcctcaacctccttggacttaggtgatcctctcacatcagcctcccaagtagctgggactccaggtgcgcaccaccatgtctagctaattttttttgtattttttgtagagacggggttttgtcatgttgcccaggcaggtcttgaactgctgggctcaagtgatttgcctgcctcagtctcccaaagtgttgggatttcagatgtgatccacagcacctggcctagggtcctttaaaacaatgtgggggctgggcacagcggctcacacctgtaatcccagcactttgggagagagcatcacttgagctcaggagtttgagactagactgggcaagatggaaagaccctgtctctaaaaataataataataataataaataaaataaaacaaataaaactgtggggtaggcagctacttgt

SEQ ID NO: 182 - DNA, 177796 bp, Homo sapiens
ttgacctcccaaagtgctggaatttcaggtgtgagccattgcttgtccactcattcagtcatttttagtgtctgaataggcatgtatggaggttacaacatacaacataaatgaagcgtcagaggggaggaagtctcagcatcactcaggtgaaaatgaatggaaaatagagcaggaacgcaaaacatggcttcagaggttagtggtaacaccagagctacaaaccagggctggaaattcagcttcagaagtcttctgagaccaggagtcttgaagggcttgcagtaccaggaagtctccaaaggagggagcaggaagagagagaagatggtgaaggcaatttggacatgtgggtggcctattagctgccacagagatccagggaggaggcatttttaaacaaaggagaatgaagatgtgtagtgactatagccttaggagagtgcatcagtgaactcaggaataaatgggcattgtagaaaaaagaagcagcaaatagaaattcttggccagtcatagtggcttcatggctgtaaatcccagcactttgggagtctgaggtggaaggatcacttggggctgggagttcataaccagcctgggcaacagagcaagatcccatctctaaaaaaaaaaaaatttctttgagatagaatctggctctgtctcccaggctagagtgccatagcgtgatctcagctcatggcaacctctgcctcccgggttcaggcgattctcctgcctcagccttctgagtagctgggattacaggcatgtgccaccatgcctggctaatttttgtatttttagtagagatgggtttttgccatattgactaggatggtcttgaacccctgccctcaagtgatctgcccacctaggccctccaaagtgctgggattacaggcatgagccaccatgcccagccaaaacaattttttttttttaattagccttgcctggctcggcacagtggctcacacctgtaatcccagctctttgggaggccaaggtgggcagaacacgaggtcagaagttcaagaccagcctggccaatatggtgaaaccctatctctttttttttcttttttttgagaattattctcactctttttgcccaggctggagtgtagtggtacaatcttggctcactacaacctccacctcctggtttcaagtgattctcctgcctcagcctccagagtagctggtgggtggagtgggggagctacaggcaccccccaccatacctggctagtttttatatttttagtagagacggggtttcaccatgttggccaggctggtcttgaactcctgatctcgtgatctgcctgcttcggcctcccgaagtgttgggattacaggtgtgagccacctcgccgtgccgaaaccctgtctctactaaaaagtacaaacattaggctgggcattagccttgcctgtagtcctagctactcgggaagctgaggcagggggatcgcttgaaactgggagagaggctgaggctgcaataagctgtgatcataccagtgcaccccagcctgggctacaaaagagaccctgtgtcaaaaagagagaaaggaaggggaggggtggggagatgaggggaagggagagcttctcaggaaagaaataagaaagcaaggccaagcaaaggggccacctggtcatggtaaacacaaaagacctataaacagcagaggagaaggaattaatgaagaggagacggtgctgatgctagaaagacaggggctcattaatggagtaagaggtgcttagataagtaacatggaagctatgggctcaaggatacaagctaatgggcaggcacataacatagagaagaaacttcaagtaagaaaagaaattgcacgctgaggaaaggaaagaaaggtaagaaatctctgtcgtctgagccaccgtgcctggccacacccagctatttttttgtatttttagtagagatggggtttcactatgttggccaggctggtctccaactcctgacctcatgatccgcccgcctcggcctcccaaagtgctgggattacaggcctgagccaccgtgcccggccgaaactattgctttttagcaatttttatttatttaaaatttattttattttttaataaaataaaataagtattttaaaacctattgctggctgggcacagtggttcacgcctgtaatcccagcactttgggaggcagaggcaggtgaatcacgaagtcaggggtttgagaccagcctgtccaagatagtgaaaccccttgtctactaaaaactacaaaaaaaaaaaaaattagccaggtgtggtggcaggtgcctgtaatcccagctactcgggaggctgaagcaggagatcgcttgaaccagggtggcagacgttgcagtgagccgagatcacgccactgcactccatcctgggcaacagagtgagactccatctcaaaaaacaaaaaaaaaattgtttatttcttgaattttccatggaatcttatcagaccactgacgacctctgataaggagtggactactatgatatgaaatacatttagtctgagtccccagctcctgtcacacagctcctaaaatcgtaggaatttcctgagtgctaggaatgtcttagttattcacaacaaatcccttcatcacgccagagtttatgctaaagaagtgatttagggtggggccccaaggtagccttaggctggggctgctcaacgggtgattagtggattggaaaggcagagggggtgggggagggaggggttcaggagatgatgctccatagaaacttttgaacaaggagttgctgaacacttcgagttgctgggaggtcagtgtgcacagtcaaggtacggaagctttgtgacacctccttccacaatcatgccctttgcatatcttcttggagtgatcatttgtgtccttcataatacattggttaacataagtagagcatttcccctgagttctgtgagccatcctagcaaattatcacagccgaggaggggggttgtgggacccctgatttatagtcagtcagaagcacaggtcactgtctgggacatgtaattggtgtctcaaaatggcggcagtcttgtgggactaagcccctatctgtgggcttcagatagcatcagaattgaattgagttagaggacacccagttggcatctgctggagaattttggtgtgtgtgtgtgtgaaaacccccataaatctgataaatattctgagctgcattcagtgcgagtagggagaaaaaacttttttcccttaatttgtgaccaataaatgccaattcttgaacacctgctcagtgcaagttctttcctctggtagttctctggtcattcccttgggtcctttcttttttctttttctttttttttttttttgagatggagtttcactctgttgcccaggctggagtgcaatggcgtgatctcgactcactgcaacctccgcctcctggattcaagcgattctcctgcctcagcctctcgaatagctagaattataggcatccaccaccacgcctgagtaatattttgtatttttagtagagacggggtttcaccatattggcccagctggtcttgaactcctgacctcaggtgatccacccgcctcggcctctcagagtgctgggattataggcatgagccgccacggtcggcctctttttttcttttttaagaattattttaatttattttatttttttggcagactcatgctctgtcacccagtctggagcacactgatgcagtcatagctcactgcagccttcacctcctgggctcaagcaatcctcctgcctcagccgtctgggtagctgggactataggtgtaagccacagtgcccagcctccttgagttttttctacttgaaatttttctttctcctttgaattcctcgcccaactgacagcattagatcttcacaaatgctactgctggcttctgctgctacaagatgtatcttgcccagcttccccgctatcccccaggaccatgcagagtgtgctgtcccagatcaccaagggacaactgactctttactacctgctattatatcaactatctatctattgaatttacgttttatatttatttatttacttattttgagatggagtttcgctctgtcgcccaggcgggagtgcaatggtgtgatcatggcccacttcaactttcacctcccgggttcaagcaattctcctgcctcagcctcctgagtacctgggattacaggcgcctgccaccacgcccggctaatttttgtatttttggtagagatggggtttcaccttgttggtcaggctggtctcaaactcctgaccttgtggccaggcgctgtggctcacgcctgtaatcctggcactttgggaggctgaggtgggcggattgcctgagctccggggttgagaccagcctcgacaacatggtgaaaccccgtctctactaaaatacaaaaaaaattagctgggcgtggcgatgtgctcctgtagtcccagctacgcgtgaggctgacgcaggagaactgcttgaacctgggaggcggagattgcagtgagctgatcacgccactgcactcaagcctgggcgactgagggagattccgtctcaaaacaaaacaaactcctgacctcatgatccacccgcctcagcctcctaaagtgctaggattacaggcatgagccaccgcgcccagcctattttattttttattttattatttatttactgagttagggtcttgctatgttgcttaggctggtctcaaactcctcacacatcagcatcctaagcagctggtcccacaggcatgggccacctaacccaaattaatttatctatctatctatctatctaatcagaccctgatctccatataggaaataatgagtttgtcttccttagttactatataatttgtactaccaggattgtataaaattcctaacacttagtattgccaaattttaaaattttgtccaatggagattatattctttctttttttttttttttttttttgaggcggagtcttgctctgtcgcccaggctggagtgcagtgacgcgatctcacctcactgcaagctccgcctcccgggttcacgccattctcctgcctcagcctcccgagcagctgggactacaagcgcccgccaccatgcccggctactttttttttgtatttttagtggagacggggtttcaccgtgttagccaggatggtctcgatctcctgacatcgtgatctgcccacctgggcctcccaaagtgctgggattacaggcgtgagccaccgtgcccggccaacctggctaatttttgtatttttagtagagacagggtttcaccttcttggccaggcttgtcttgaactcctgacctcatgatccgccttggcctccaaaagtgctgggattacaggcgtgagccaccatgcctggcagagattatattctttaggaaagaatctctgtgtgtgtatgtgtgtttgaggaggttattctatattatatatataatttccacctctgccaggtcactaaccaagataatttggtaagcagagtagctaagatgttttggagatagagcaatagtaaaatgagaaataactgtagagggaacttgagttaggtttggatgagttagataagtgcagttcctatacccttatgacataattttcatacctctttttaaaagaggtgactggaaaaaagacattcttgctgttacttggggaagaaaatggggtaagttagttataaggatagtggaaaattgcctaaacatttattctttgttattgaggtctggaaagaattgcactttattttcttctccctgagtagtcacctcatgttattgtttaatttcccatgacttgttaaaccttttagactttatggaaacatctggcccctttcctgacagatgaacccgatcaggttgctgggtgccaagatggtttttaatatcatctacatgctgatgactctcaatttgtttcttcaagataactctccttcccaaactcgaaattgtcccagacttggccagtgggagagacctgtccttttttgatggacatttagatggtttccagtttttcaccattgtgaaacataatgaaaatattttattgacacagactcaattcagccctcagagcctttgcacttgctttttcctaagcctgcaatcttcttccagcttcctcccttacttttttcagtctactcaatgtggtcttccttgattgctgaattcaaaattaaaattctggtcaggggcagtggctcatgcctgtaatcacaactacttgggaggctgagatacaagaattgcttgaacttgggaggaaggttgcagtgggacaagattgcactactgcactccagcctgggcgactgagtgagactccctctcaaaaacaaacaggccaggcgcgttggctctctgggaggccgaggcaggtggatcacctgaggtcaggagtttaagaccagcctgaccaacaaggtgaaaccccatctctgctaaaaaaacacaaattagccacacgtggtggtgcatgcctttagtcccagctattcaggaggctaaagcagaattgcttgaacctgggaggcgaaggttgcagtgagccgagatcgggccactgcactccagcctgggcgacggagcaagattccatctcaaaaaaaaaaaacccaaaaaacaaaacacacacacacacacacacaattattttagaagcacacatgcacttagaatccttttagaagcactcattgggttttttgtttgtttgtttgtttgttttgagacagggtcttgatctttcctccaggctgacatgcaagtcatacaatcttggctcactgcaaccgcctcccagactcaggtgattctcccatctcagcttcccgagtagctgggaaaacaggcatgcaccaccatgcctggctaatttttatatttttagtagagatttcactatgttgcccaggctggtctcgatctcctgggttcaagtgatcctccccccctctgcctccctaagtgatgaaattacaggcatgagccactgagccctgagccctgtgtattgtgtgtgtgtgtttttgagatggagtcttgctctgtcaccaggctgtaggctggagtgcagtggtgccatctcggctcactgcaacctctgcctcccaggttcaagcgattctcctgcctcagcctcccgaatagctgagactgcaggtgcgcgtcaccactcccagctaatttttgtatttttagtagagactgggtttcaacatgttggtcaggatggtcttgatctcttgacattgatctgcctggcttggcctcccaaagtgctgggattacaggtgtaagccactgtgcccggctatttttttttttaattgcaatcttccccagcatttcccatccccttccctgccttttccccccactttatcccggtgctatcactatctgatacactatatattctgctcatttattttctttattttctgtgccccgactcttacaacacgatggaatgcaagctctacaaggacggaggtttccttttgctcacttttgtttccccaagtttggaattgtgtctggcactaagtagggactcaaggggaatgagtgttaccatggacatcattctatatagttgtatgattttcctatttcaatacattttaaagttaatccagttaattgacaaaagccaggatatttctattttatgatagtccttttccttttgttcttcatgaaaattagattatgttggatttttccttttcctttttttgggggcagggagatgggtcttgctgtggttgcccaggatggcctcaaactcttgggctcaagtaatcctcttgcctcagtctcccgagtagctgggatggtgcgcactattatgcccacctgaaagtcaggattttttttaagacagtatcttgccctgtcactcaggctggagtgcagtggctttaccaaagctcactgcaacctgaaactcctgggctcaaacagtcctcctgccccagcctctcaaagtgttaggattacaggtgtgtgcccagccttgaaaatcaagttttataagtcaaactctccctgcattcctttctttttatctaggtagaatgtttctaacaagattttaacaagtaaccttttgaagcattggctcagaagggtcaatttttgtccataagatttatttcacggaaggcagctatgctaacccctataccatcaacgggtcatataagatttatttcaggcctggtgtggtggctcacgcgtgtaatcccagcactttgggaggccaaggcaggcagatcacctgaggtcaggagttcgaggccagcctgaccaacaaggtgaaaccccatctcttccaaaataataataataataataataacatagctgggtgtggtggcgcacacctgtaagccgaactactcaggaggctgaggcaggagaatcgcttgaacccaggagcagaggttgcagtaagccgatatcatgccattgcactccagcctgggcaacaagagcgaaactccatctcaaaaaaaaatttatttcaaatgccacatttctgattttattcagccaaggtactttgattgtgccattgaaaacacgagtgcagtcatcagtttgctctgccagcctggaatctctgttccttctgtgtaggaggcaaattttattcatccttgtatgcctacattgtagtgcaagaatacatttgtatgaatcaatcagtgaggaaggttaaaagtttaggaatctttcccagaacagcccggttatacttatgtgtatacgaataaaatctaagtgcagaatgggggtagaatggtgtgaaatgcaatgagggactgaatcctttctcttcacttgaagtttgacctggaaggaatgaagattccatgaacagcattttccttaccacggtgaccccattaaaatcctggattcccttgtctgtgtcatgactgctggaagaagcaatagctatcaaacatttagagaaaaattcagatgccctagtcagtcttaattctggcgtaatgccactggttattcctcctaattcggaaaacttagctcttcctgccctttcatttcttcattcataaagtgaatacgaccaccactgaggtccagggccaaataactaacagaaatattatgatgaactttgcagacatccagcccagagtcagggaacacagccctcatctggtttctctctttggtgttgagggcggttttccgttgctggcgacctagacattgctcaatggtgtcatctctgacctggcaccttcttcatacatttataaacatgcaatttagagatcctaaaaactttttctagagctcccctgggaaaaaagttaatgacaaaatcttgacacctctctacgtcttcttcggagacagagaagttgagagaggtggagaacgagggggagggggagggggtcgagagggagtcgaggagggattccagctccagtttgggtaaatccagctcgcgttttgtctctcgctcaactgtgcagggtccagcgaaggcagagccccagcttcactccctgaggtctgtcctggggagacactgctgctccggggggctgacctggcggggagtggccgcgcagtctgctccggcgccgctttgtgcgcgcagccgctggcccctctactcccgggtctgccccccgggacacccctctgcctcgcccaagtcatgcagccctacctgcctctccactgtggacctttgggaaccgactcctcacctcgggggctcgggccttgactgtgctgggagccggtaggcgtcctccgcgacccgcccgcgcccctcgcgcccgccggggccccgggctccaaagttgtggggaccggcgcgagttggaaagtttgcccgagggctggtgcaggcttggagctgggggccgtgcgctgccctgggaatgtgacccggccagcggtgagttggggccggggcagagggcaggggtgcggggagcgaggactccgacgccgaggcccgaggggggtccgggaggcggcgctcggcgcgggctggatgtggccggggctctgcgtccttggctctcccgctgcctcaggggtgggctcgttccccgcctcgaccccccaccccgggacgctcgggacgcttttgttgccggagataaacaatgcccccggccggaggtatcggccacccgctccggaggccccgccacagcgccgggttgggggcagcgggggcgcctggggctctgaccccgggctgcggtggaagcggggctgggggagggcaagtgtggcgtgggggagatggctgaatataccagcggttggttccctggcccctttggggagttggaggtcggggcgcctcggggtgaggagaggctagagtctgtgcaagttgtgagtggggagtccgggctgtcccgtgctcaagcgtaccccctaaacaagttttctccctccccccatatatatatgagagacaggttggtagggaaacgctttggcgcctgtctccccgagagttttgggacggcagctccagggatgaaacgtttggagtggaggcagtggtgcagtcttgctaggagttggctgggagttgtaaggatcagggaagaagggaagagggagtagagtgtgttctgtcaaaatggcatttaagaaactcatttatgagcaccactgggtcgctggacgcgctggccttgcgatcccatcagtccccgtctggcgggatcccggagcgggccccgagggtgggaggtgcgcggagctgggtgctggggctggtcgtgcagcacgtgaggggcctggtcctcgctctcgggcgaggaggcggccgcacaacctaccgcccccagagaaaaaatgctctcctctctctctgtgcttccctccctccctccctctcccccgctccggtccccgcctctctcgccccaggctcttgaatatatatatatatatattctacaagaagtggtctggaagggactggccgacgctggtaatctttccacgtgaacgagaaacccacgctgggcatttctgatccactaaaaactaaagtgtttccaaaagaacacttaaagcttcagcctcggagtctttcccgcgcccccaactcgtccctctcccaaattaaccaacctttctgcatacgtctcttagggtgcctcttcccctccgtcccggttccactcctgggcactaaacgagctgcacaatatgtcctagtaatgactgctttttgaagaaatgtttgaaaagtgctgcaagaccttggagcgagaacaggattaggtacacagccctgggccggcggggtgagccgcgcgcgccactggaagagcggcgctgtatagcagcagccccaggtctcccctggacctgagtgtgctcggcgtccccacccccaatataaagtaaaataaaagcaatggtttaattaggcctcaggatacgaaaaatatggaaaaggcgcttcttaaccagtaagggcaacagttatttggagcacactaggaatttatgactacaattaaaccaggggcaggggtacacgtagataggtacggaaataaggagattggtgtgagttaataatcgaaagacttaggtgaatcaaaccaagaatcaaaagacttaggtggcttttggtgtgtttccgattttatcggtattgatcatacgggtcccccttttccccaattaagggatttttaattagtttgtcagtctttaaagctaagttgtggtttcaattaaatttcagaatcaagatatacgggaaatggcagacagtgtccttttctctttgcaaagatgaggagtccaggcttacaactctgggactgccactttccattttaataagagttaactatcgctctccgggctggtctcccagaatagatgggtgggagggttgggtctccactgtccctgccctttgtttctcttccttctcccatctgatttgtctcccctcccccaccttctgagcgtccgtatcttccctgcacacttgatttcccctatccccttggtcttttagttttcggccttttgatcccagttgcctttttatgttctagctttattactatagatgtcgaaccccttcctcagtttttactataagtaatttttgcccttcctcagttttttactatacatttcttccccttctttcgtttttggccttttttgttttctttttgggcattttcttccttctcttgctttttcttctacttcctcctgttgtgtgttatgtctttcttgtcttcggaaggacagttctatgtccattctaacgtctcccttcccttttcttggcccttttccccccttttttcccccttcctctctgcagggcagaggggtgttttacatatggaaggagccattgactaaatgtgctggcattctagtgagtttccctgaacagcttttacatgtgccgagggctctcacacttcctgtggtagaaaactatctaggaacagcaagcagttgcctgcctgctcttcctttcgaggtagaacttagttgctggaggaaactgagccaggtgctgccttttttaaaaaatgttttaaatcttgtttttctctgccaagtgcaagagcctttaagttctgtagagctgaatggagggactatgaaatcagtctcttgcaactagctctatgtatgcaaataccacgtttttggccactgctggtagtgggaagaattgaaatatgactttaatttaacatgcaggctggattgttacatcagttaagcatttttgcccagaggattttgggggaatccagaaaaaggacggatataggtgggaagaggatcttgctgacatgttgctgtcaatactggcttttttgtttgttttttgagacggagtctcgctctgtctcccaggctagagtgcagtggcatgatcttggcttactacaacctctgcctccggggttcaagcagttctcctgcctcagcctcccaagtagctgggattacaggcgtgtgccaccacacctggctaatttttgtatttttagtagagatggggttttactatattggccaggctggtctcaaactcctgacctgaggtgatctgcctgcctcggcctcccagaatgcttagattacaggcaagaaccaccgcaccagccagttctttgcagaaaacccttacactttaagaagccagcttttcattctctaagcaaggtaattatttttaaaagttagttgggttattatctcctagcctataattttggattgcatactctgtagttcccttgtcataaagacattttagggggaaaaatgttctattgttttcttttttttttttttcagagtctcactctgttgcccaggctggagtgtagtggtgtgatctccgcttactgcaaccttcatctcctgggttcaagtgattctccttcctcagcttccctagtagctaggattacgggcatgcgctaccatgcccggctaatttttgtatttttggtagagatggggattcaccatgttggccaggctggtttcgaactcctgacctcaagtgatccacctgcctcagcttcccaaagtgctgggattataggtgtgagccaccacgcctggccaaaaattattctgttgttgtttagggcgtcttggtgctctctggtgaaaagatctgttgattgagtaatgttttacatcccagaaatggttttttgtttttcccttccatgacagtaagaactcacaggatggtgtccattaattgcacatgattcccttcttggccaatgatagatgcttaataacagggtctccagtcttattttcttctcatatcatgttatcatgtagctatctctgcagcactttcactgactcttgaagacattccaggttagaataaaagtaactttctcatgcctgtaatcccagtgttttgggaggctgaggcaggaggatcacttgaggctaggagttcaagaccagtctgggcaacatagtgagatcacccttgatcctcatctctacaaaaaataaaaagaacttagccaggcatggtggcctgtgcttgtaattcccgctaccgcggtggctgagatgggaggatcacttgagtctaggagtttaaggctatagttagcgatgatcacagcactgcactccagcctgggcaacagagcaagacctgtctcaaaaaaacaaaacaaacctgatattgagaaacattgaaatatcagtttttatcagaaatgaaaaatggaagtagaattagggaagagtgtacacgggagagatttgactgctggaaatattttagttcatctgagtggtaggatctgagtatttatttgaaaatacacattttttctggacatggtggcccacacctgtagtcctagcactttaagaggctcaggagggcagatgacttgaagctaggagtttgagagtggcctgggcagcatagtgagaccaccctgtctttacaaaagaaagaaaaaattagcctggtgtggtggcacgtgcctgtagtgccagctacttgggaagctgaggtgggaggatcacttaagcccaggaggtcaaggctacagtgagccttgatatacctgagcgacagagcaagaccctgtttaaaaaaaaaaaatatatatatatatatatatatatgcacacagacacacacacatttttgtatgaattgaataatctatgacagaagcactaaaaatggaagcagagcatttaataatgtttacaaaaaagaaattaatttctggaggtctttgaggtaattccatatttaaatgtggacctatttaatggagtggactacattctcttgcccctgcctccacaaatttcaggataaacttactgcccctactccgtgagttcggctcttgggacaacttagtttgtcacaaaagaagtttatgtttcaatagtggagccatgagtgataaaaatcagggtcttgtgggagtccttattttgtttctggttgtctctgattctttggctgggtggcacccagtggttttctcccctgcagttgggtttttcaggggtcattggcctctttcatgatctcataaaaaggctgttaccatttaaagaggccacatcttcgcaatccatgttgttcataccttttctatttccttgacaggctgttttttaggagatagggtttgaatgataaagattatcttaattacaagtctgaatttctaaagcacttcaatttaaaaatatgaaagaatataggagagacagaaatcaatttgtaaaccactttcaaagcagatcccatgacaccctctggcatacccagattacttgcctacatatatgaattttaatttttgtggctgatttacaatgactagattatatactcctaataattttttagcagtataatcttgatacaagagagaaagcatgcttttaatgatatcgttgaatttcaagagattaaaatgaattgctttttgtaatgaaaatgcatcctgatgaaggtatttgttgactttttggaaattggaattggaatgtcttgttttctgaaaatcttgtacaaaaagcagtggtctttggagaaaatatctttcagtttctcacagccaaagactgaattactgcaagccaaaacttttttttttttttggaagaaggggaaagcagtaagcttagatgccaagaattcaagtgaagtattctctggcctagtgtttgtatttagtacagatttatcaaaatgttattttttgtgtatttgatgttatcactaatgtctattttaaaagtcttaaagacacattacattgactaaatgtagtgtgctctgggaattcttgtgtgtataacctacgtagtgtgtaaggtgggaacagaaccaaaaggagatcttgttctggagaatatagcaaactctgagttaaactggttccataataatgataactaccacttattttctctctctctcttttttttttttgtattttagagttgcaaacaggctttttttttttagctcctatttatgaaacacctatcatgcgccagccctgtgctaagcctttacacatattatttcgttttattctcatgataacccaatgaggtcaatactattaggttttcttttgtattaaacatgaagaaacataggtataaagataccaagaaacttgtcacaatctactaatatttatgaactgaaaactgaacccaggtcagcctacttccaacgtccatctttttactctgctacccatgtcccctgacactcaaaccacagataccacaaggatgaaaccagtgccactagttttttcctgtgggagcccattgaaacctcaaaactacctcattttagatgaaggaacatggactcagctaagtagttctctgaaggacacagagctggcgatcacagattcaaacccaggactttttggtgtgagatcatctctagacatgaaactaaacagtgggtcctaggattacctaggtcagtcagtaatttttaaacagattgaacccgggagggttcaagtgattctcctgcctcagcctcccaagtagctgggattacaggcatataccaccacgcccggctaattttgtatttttagtagagacagggtttctccatgttggtcacgctggtctcaaactcccgacctcaggtgatccacccgtctccgcctccaatagtgctgggattacaggcatgagccactgtgcttggccaggtttatttttttttaatctatttttaatttttctcagacattgggaggctgaggcgggtagatcacctgaggtcaggaattggagaccagcctgctcaacatgccaagatcgtgccattgaactccagcctgggcaataagagtgaaactccatcttaaaaattaaaaaaaaaaaatcatagaatcaagactgtgacaacagaaaattaagactagttgtcatttgagaccattcgtgagaacatatggttctcacaatgagaacaaatggttaccaacaaccgttttcctacaccatgagacggagttcctacaccatgagatggaggctggagtgcaatggcacgatcttggctcaccgcaacttctgtctgccaggttcaagtgattctcctgcctcagcctcctgagtaggtgggattacaggcatgcaccaccatgcctgactaattttgtatttttagtagagacagaatttctccatgttggtcaagctgctctcgaactcccaacctcaggtgatccacccaccttggcctcccaaagtgctgggattacaggcgtgagccactgcactgcgcccagcctttgggattacaggtgtgagccaccgcgcccagtcttttttttttttttttttttttgagatggcatttcactcttgtcacccaggctggagtgcaatggtgcgatcttggctccctgcaacctccacctctctggttcaagcgattctcatgcctcagcctcccgagtagctgggattacaggcgcccaccaccacgcccagctactttttgtatttttagtagagacagggtttcaccatgttggccaggctggtctcgaactcctgacctcaggtgatctgtccacctcaggtgatctgtgcacctcagcctcccaaagtgctaggattacaggtgtgagccacagtgccaggccgatgctgtgatcttgagagagactgttgatatcctactatagtgagctttgcttttgcttagagcttcatcttattttgggtctgggtaggcaatctgaaaagacccgggtcaaaacccagagtcaagtggtgagactccatctccacaaaaattaaatatttagactggcgtggtggcacatgcctgtggtcccagctattcgggcagctgaggtgggaggattgcttgaacccaggaggttgaggctgtagtgagctgagttagcactactgcactccagtccaggtgacagagtgagaccctgtctcaaaaaaaaagaaaaagaaaaagacctgtgggatcttgtagaagggattttagaaccagcagtctttggattgagtcaggagaaagaaaagagggacatttctgggtttgggcagtgtccaccacaatgccttccttagacatagcaggtactcaacagatgtattggacctgtgagtcttatttgtaacctaatttgtcaatactgtctcctgagattttatgctgttttggtgtgcatgtgaaaagctcaaaatctgtggattgttaattggaatgtggtaggaatactgctggatctccaggcaggagagtttcttttttttttttttttttttttttgagatggagtctagctctgtcacccaggctggagtgcagtggtgcaatctcggctcactgcaagctctgcctcccgggttcacgccattctcctgcctcagcttcccaagtagttgggactacaggtgcccgccaccaggcccggctaatattttttgtatttttagtagagatggggtttcaccgtgttagccaggatggtctcgatctcctgacctcgtgatccgcccacctcggcctcccaaagtgctgggattacaggcgtgaatcaccacgcctggccagtttcttaccttatatgagcctcttcttcctctggtttaaccagctttactgtcaaacagatgatacttctcccagtatagggatatgctcaggaaagagataatttttaaagtatccaaatttgtaaagattgggatttaagctttaaaacatatataatggctaggcatgctggttcacacccgtaatctccgcacttggggaggcggggaggattgcttggggccaggagttcaaggttacagtgaggtatgatcatgtcactgcactgcagcctgggcaacagggagacctgtttcaaaaaaataataataataaattaattaattaaaaatgcatgaaactacaaggggtgtggtttctaatgtagagaaaaccccatgcttaccttatttgaggaacttcatcaacttaaatcatttgttgtagcaattaaagaagctttatagtgaatctaaggtttaaaggatactttagtattttttcttttttaaaataatttcaactcttttaggttcagggggtacatgtgcaggtttgttacatgggcatattgtgtggtactgtggtttggggtgcaattggtcctgtcacccaggtagtgaacatagtacccaaaagtttttcttttttttttctttttttttgagatggagtcttgctctgtcacccaggctggagtgccatggtgcaatctcagctcactgcaacctctgcctcccgggttcaagtgattctcctgcctcagcctccggagtagctgggattacaggcgcctgccaccacgcccggctaatttttgtatttttggtagagacggggtttcaccatgttggccaggctggtctcaaactcctgacctcaggtgatccacctgcctcggcctcccaaagtgctgggattacaggcgtgagccaccgcgcccagccagtaccggatagtttttcaacccttgtctccatccctccctccttctctagtagtccccagtgtctattatggccatctttatgtccatgagtacctgataagtgagaacatcagatatttggttttctgtccctgcattaattcacttgggatattttagtactttctgtgttgattatatttttcttttgcagtaaacaattctcagttccatgattttaattatttttaattttttttttgagacagagtcttgctctgtcacccaggctggagtgcagtggcgtgatcttggctcacttcaagctccgcctcccgggttcacgccattctcctgcctcagcctcctgagtagctgggactacgggcacccgccgccacgcccagctcattttttttttgtatttttagtaaagatggggtttcaccgtgttaggcaggatggtctcgatctcctgacctcctgatctgcctgcctcagccttccaaagtgctgggattacaggtgtgaaccaccgcgcctggcctaattatttttaaatttttgtcattttctatttttgttattttattttatttattttattttattattatttttctgagatggagtctcgctgtgtcacccaggctggagtgcaatggtgcaatctcggctcactgcaacctccgtctcctgggttcaagagattctcctgccttagcctcctgagtagctgggattacaggcgcctgccaccacgtctggctaatttttgtattttagtagagacagggttttgacacgttggccaggctggtctcgaacttctgatctcaggtgacccacccacctcggcctcccaaagtgctgggattacaggcatgagccaccacgcccagccctgttattttattttatttcattttattttttgagatggagtctcactctgtcacccaggctggagtgcaatggcgcaatctcggctcaccgcaatctccgcctcctgggttcaagtgattctcctgcttcagcctcctgagtagttgagattataggtgtgcaccaccacactcagctaatttttttttttttttggccaggctagtctgaaactcctgaccacctcaggctcccaaagtgctaggattacaggcgtgagccactgcgcctggcaatttttgtatttttagtagagatggggtttcaccatgttggccaggctggtctcaaactcctgacctcatgatccacctgccttggcctcccaaagtgctgggattacaggcatgagccaccgcacctggccactgtttttatgagttggagtctgcctatgtagcccaagctggtcttgaactcctggcctcaagtcatcttcctgcctcagtctcctaaaatgctgggatcacaggcatgaaacactgctcctggtccttacttttaactggccgggcacgctggttcacacctgtaatcccagcactaggggaggccaaggtgggtggatggcttgagcccagttagagaccagccagggcaacatggcgaaaacatgtctctacaaaaaatacaaaaattagccaggtgtgatggtgtgagcctgcagtcctagctacttggggggctgaagtgggaagattgcttgagcctgggtaggtccaggctgtgctgagctgtgatcatgcctctgcactccagcctgggcaacagaatgagaccctgtctcaaaaaaataaaataaaacaattagtagtgaatattctatttcaaataggggaatgcataggaaaaagactcacttcagtgtattctgttgttatttcagaccaaaaccttgtgtgactgagctgaagagcagtgcatccagattctcctcagaagtgagactttccaaaggaccaatgactctgtttcctgcgccctttcattttttcctactctgtagctatgtctcgatcccgccatgcaaggccttccagattagtcaggaaggaagatgtaaacaaaaaaaagaaaaacagccaactacgaaagacaaccaagggagccaacaaaaatgtggcatcagtcaagactttaagccctggaaaattaaagcaattaattcaagaaagagatgttaagaaaaaaacagaacctaaaccacccgtgccagtcagaagccttctgacaagagctggagcagcacgcatgaatttggataggactgaggttctttttcagaacccagagtccttaacctgcaatgggtttacaatggcgctacgaagcacctctcttagcaggcgactctcccaacccccactggtcgtagccaaatccaaaaaggttccactttctaagggtttagaaaagcaacatgattgtgattataagatactccctgctttgggagtaaagcactcagaaaatgattcggttccaatgcaagacacccaagtccttcctgatatagagactctaattggtgtacaaaatccctctttacttaaaggtaagagccaagagacaactcagttttggtcccaaagagttgaggattccaagatcaatatccctacccacagtggccctgcagctgagatccttcctgggccactggaagggacacgctgtggtgaaggactattctctgaagagacattgaatgataccagtggttccccaaaaatgtttgctcaggacacagtgtgtgctccttttccccaaagagcaacccccaaagttacctctcaaggaaaccccagcattcagttagaagagttgggttcacgagtagaatctcttaagttatctgattcttacctggatcccattaaaagtgaacatgattgctaccccacctccagtcttaataaggttatacctgacttgaaccttagaaactgcttggctcttggtgggtctacgtctcctacctctgtaataaaattcctcttggcaggctcaaaacaagcgacccttggtgctaaaccagatcatcaagaggccttcgaagctactgcaaatcaacaggaagtttctgataccacctctttcctaggacaggcctttggtgctatcccacatcaatgggaacttcctggtgctgacccagttcatggtgaggccctgggtgagaccccagatctaccagagattcctggtgctattccagtccaaggagaggtctttggtactattttagaccaacaagaaactcttggtatgagtgggagtgttgtcccagacttgcctgtcttccttcctgttcctccaaatccaattgctacctttaatgctccttccaaatggcctgagccccaaagcactgtctcatatggacttgcagtccagggtgctatacagattttgcctttgggctcaggacacactcctcaatcatcatcaaactcagagaaaaattcattacctccagtaatggctataagcaatgtagaaaatgagaagcaggttcatataagcttcctgccagctaacactcaggggttcccattagcccctgagagaggactcttccatgcttcactgggtatagcccaactctctcaggctggtcctagcaaatcagacagagggagctcccaggtcagtgtaaccagcacagttcatgttgtcaacaccacagtggtgactatgccagtgccaatggtcagtacctcctcttcttcctataccactttgctaccgactttggaaaagaagaaaagaaagcgatgtggggtctgtgaaccctgccagcagaagaccaactgtggtgaatgcacttactgcaagaacagaaagaacagccatcagatctgtaagaaaagaaaatgtgaggagctgaaaaagaaaccatctgttgttgtgcctctggaggtaagcaaacagtcaaggggctgggagacagctgacacttggtatagtgatctatatgcagagacacttctagtgtctctagtgtctctatgtaatagtgaattgcttcactattacatatttttactttggtacaatgttactttaagttatccataaaagaattcctggacctacctgaagtatgtcttgtgcagtgatgccttagctagcttatttttagaatttgtcccagaaaactagaacatacagtttttttctcattacaggatttgatggaaacatagagaaattgtatgaaatgtgtttttgcagagatttcccctatgcctcttttggctagttgcatgtcttttttggcagtcacagatttaaaaattaagagtggaacaaattcattaactccatagcagcctgaaaaaccagaggaattaaacatctttccttttgaaagaacacagttgcatccctaatcttgaaactttgttttggagacatagcaataatacagcttttgtctcaacttttggtgagtgatttctacctgctctaccaacctcatagggttgttgggattaaaggaaaatggcttgtaaactccaaagtgatacacaaacattagttcttattatagtttatgaacctaaggtagttaaaggatctgttgatttagaatttatttaaaaacttttagggagcttggttaaaacccagtattgcttttttggccttttgaaacacctgtcaaatatgatgttttgtgatttttagatcacgcattaaagttatgtttattacatctactatgaatgcaggtatggtagaatagatggacttagaagtattgtaggcctggtgtggtggcttacgcctgtaatcccaacactttgaaaggccgaggcgggcagatcacctgaggtcaggagtttgggacgagcctggctgacgtggtgaaaccccatctctactaaaaacacaaaaattagctgggcgtggtggcgggtgcctgtaatcccagctactctggaggctgaggcaggaaaatcacttgaacccaggaggcagaggttacagtgagccaagattgcgccattgcattccagcctaggccacaaaagcgaaactctgtctcaaaaataaataaataaataaataaataaataaataaagtattgtggttgggcatggtggtttacacctgtaatcccaggactttgggaggccaaggtggcggatcacttgaggtcaggagttcgagaccaacatggggtgaaaccccatctctactaaaaatacaaaattagctgggcatagtggtgcacactggtagtcccagctactcaggaggctgaggcagtagaatcgcttgaacccgggaggcggaggtttcagtgagacgtcatcgtgccactgcactacagcctggacaacaagagtgaaactccatctcaaataaataaataaataaataaataaataaataaataggccgggcgcggtggctcacacctgtaatcccagtactttgggaggccgaggtgggccgatcacaaggtcaggagatcgagaccatcctggctaacacggtgaaaccccgtctctactaaaaatacaaaaattagccgggcgtgacggcgtgcgcctgcagttccagctgctggggaggctgaggcaggagaatggcgtgaacccgggaggcggagcttgcagtgagccgagattgtgccactgcactccagcctgggtgacagagtgagactccatctcaaaaaaaaaaaaaaattaaataaataaataaatgaataaataaaagtgttgtgaggctggtcatggtggctcacacctgtaatcccagaactttgggaggctgaggtggacagatcacttgaggagttcgagaccagcctggccaacctggcaaaaccccatctctactaacaatacaaaaattagccaggagtggtggtgcatgcctgtagtccaagctactttggaggctcaggcacaagaatcacttgaacctcggaagcagaagttgcagcgagtggaggttgcgccactgcactccagcaggggcaacagagagaccctgtctcaaaaaaaaaaaaaaaagtattgtgaggtttaggccaggcatggtggctcatgtctgtaatctcagcactttgggagggctcaggcaggtggactgcttgagcctaggaggtcgaaatcagcctgggcaacatagcaagacctcatctctactaaagatacaaaactaactgggtgtgatggcacgctcctgtagtcccaactacttgggaggctgcagtgagaggatcgcctgatcctgggaagtcaaggctgcagtgaacagtgatggtgccactgcattccagcctggttgacagcaatgagaccctgtctcaaaaataaataaataaataaaaagtactgtgaacttaaaattcaggaaactgtttctatttctttttttgtttttcattttcttttctgagacagagtctcactctgtcacccaggctgaagtacagtggcatgatctcggctcccaagttcaagcaacttctccctcccaagttcaagtgattctctcttgcttcaacctcctgcatagctgggattacaggcacccaccaccatacctggctaatttttgtattttttttttttgagagagtctcactctgttgcccaggctggagtgcagtggcgcgatctcggctcactgcaagctctgcctcctgggttcacgccattctcctgcctcagcctcctgagtagctgtgactacaggtgcccgccaccgcgcccggctaattttttttgtatttttagtagagacagggtttcaccgtgttagccaggatggtcccgatctcctgacctcacgatccacccgccttggcctcccaaagtgctgggattacaggcgtgagccaccgtgcccagccttaatttttgtatttttaatagagacagggttttgccatgttggccaggctggtctccatctcctgacctcagatgatctgcctgcattggcctcccaaagtgctgggattacaggcgtgagccaccgtgcctggccttctatttcattcttgacttaaattatcagtttaaaaatgctgattttggctgcttgtggcacttcgagaggctgaggggagaggattacttgaggccaggagtttgagaccaacataagcaacatagcaagacctcatcaaaaaacaaaaaacaaacaaacaaacaaaatcatagctgggccgggtgcattggctcactcctagaatcccagaactttgggaggccaaggcaggcagatcacctgaggtcaggagtttgagaccagcctggccaacatggtgaaaccctgtctctactaaaaatacaaaaaatagcagagcatggtggtgcccacctgttaatcccagctactctggaggctaaggcaggagaatcgcttgaacctggaggggggcgttgcagtgagccaagatcgcataattgcactccagcatgggcgacagagcaagacactgtctcaaaaaacaagaaacaaaaaaacatatctgggtatgttggcatgcacctgtattcccagttacatgagaggctgaggtgggaggatagcttgagcccaagagttcaaggctgcagttagctatgatggcaccattgcataccagcttcagtgacagagcctgaccctgtctcaataaataaataaataacactgattttttatttgtctgagccactgcaaatgagaaatcagacatttaataaatcatgtattgatgggcatttaaagtgtttctaaaatactttgttgtaaaaaatcttactgagcctgtaatcccagcactttgagagaggccaatgtatgctgggcgcggtggctggcaagaggattgcttgagcccaagactttgagataaataaactgggcaacatagcgacataaacctctacaccaaaattttattttattttattttatttatttatttttgagacaaagtctcgctctgtcacccaggctggagtgcagtggcgtgatctcagctcactgcgacctccacctcccgggttcaagcaattctcctgcctcagcctgccgagtagctgggattacaggcacctgccaccatgcccggctaatttttgtatttttagtagagacgaggtttcaccacgttggccagcctggtcatgaactcctgactcaggtgatctgcctgcctcggcctcacaaagtgctgcgattactgcgcgtggctgatttttgattctttataatattttaattctttttttaaagccccaaccatggcaaggacagattttgaagtttttaacgagtcctgataagaatttttacatttagctaggatttggacaaagccacccattcagacattttcaggagcaaaatggaaaaagatcttatttgatgctgagtgacggatacacatgggggacaaaggggatgcttttgctttgaatagtgttgctaattgccaatttctggtctaacttggggtgctgggattgtaggcatgagtcaccatgcccagccccaaaatttaaaaaaaagaaaaaatttgccgggcgtgatagctcatgcctgtggtcccagctacttgggatgctgaggtgggaagattgcgtgaacctgtgaagctgaggttgcagtgagctatgatcgcgccactgcactccagcctgggtgacatagcaagaccctgtctgaaaaaaaataataactaccttactgaaatgtataatcttttactcaatcaagtcacgtcacacatgtgggaatagataaaatgtggccagttactgatggtttacaaagtaacatttagcaatatctctagtagagagacctcccttgtaagttactggtttgtagcattgccaaatgacatcattgtaaaaaacactgtatctctaatggatatgaacacatttgttctattctttctcaaacctgctctttctcttgcattacatgtttggttcagtgccataacaaatgattacccaaaatagaatattcagtatcctcgcctcctttgctcatccatccaaattctcttgttctacaagttctgagcgctaccacctctccattttcttggccactgctatattgaggcctttatttcttcatcaggataacttcagtgctatctttactatcaacaagtattgcacttctcctaggctatgcactggaaatccaatcatgagcattctagccaccagggaaatcaggaagctgaataacaagctccccttaggggagttcaagttttccttctgaaaaacatgattctcctatctaactacatgtagtgttctctttatgtgatatatttcactcaaaataaaagaaatagagcaaaactttcagggccttcgaatgattagatgaagcctagattcattagcagggaatacagcacctttaagatttttgcaaaacccacttctgtcttgtttgccttcatgtatcttcaccttctacttgctgcagcagtatacgactgcatacatttccccagtgcatactcttgcctcagtctccaggcccaagtgatgcccttcttcctttctctctcttctttttttgagacagactctcacaccttccttcttctttttttttttttcagatagaatttcactcttgttgcccaggctggagtgcagtggtgcaatctcagctcactggaacctctgcctcccggattcaagtcattctcctgcctcagcctacctagtagctgggattacaggtgcacaccaccacgcccagctaattttgtatttttaatagagatggggtttctccatgttggtcaggctggtctcaaactcctctcctcaggtgatccaccccccttggcctcccaaagtgctgggattataggcatgagccactgtgcccggccgagtctcactctttcacctggcctattttattattaatttttatcttatttttcagtatgaaccaatgcatttttattatattcaatttttttttttttttttttttttttgagacagagtcttgctctgtcacccaggttggagtgaggtggcatggtcatggctcactgcagccctgacctccgggctcaagtcattcacccacctcagcctcccagtagctggtactacaggcacatgtctggccaacttaaaaatcttttgtagaaggccgggcacggtggctcatgcctgtaatcctagcacttcgggaggccaaggaaggtagatcacttgaggtcaggagttcaagaccagcctggccacatggtgaaaacccatctctaccaaaaattcaaaaaaaattagccgggtgtggtggtgcatgcctataatctcagctatttgggaggctgaggcaggagaatggcgtgaacccaggagacggaggttggggtgagccaagatcgcaccattgcactccagcctgggcaacaagagcgaaactccatctcaaaaaaaaaaaaaaaaaaaaaaaatatatatatatatatatggcgtgatggtggcccacacttttgtaatcccaactactcaggaggctgaggtggcagatggcttgagcctgggaggttgaggctgcagtgagctgtgatctctccaccgcactctagccttggtggcagtgagactgtgtctcagaaaatatgtgtaaattctgaaggagtctctgaatttattctcgtttgaaggttgcctgtaagaaataaaatatatttagcccctaaagccatgtaccatttctcagaatgttgactgctaactcctcggataagtgaaaacaaccttagactttattaagtcatagattacattgtagtctcccattctttaattgtatgacagtgtgttatgtaatcttctgagaggtatcttttggtcatggaaaaaaacttaatttgtcatctgtcaagcctaattcagcttactcttcttgatgttcagaattacagataattaaaactgctagctttgtcactctcagtcatctaggaatttgctttcggttagggttttccttctatgtgtttgtaattttgaaaatactataaatagggtagtgcattttgaaacatatgcactaccctatttattgaacagtgagagattgttacaaaaaaggaacgggggactgtagagctattcgcagacattagagagtaggtgctttggctaagctacactttcacaagtaatttttagtatgtgtgaaagccaaagaaaacaaaattggccatggggactggcacatgcctgtaaccccaccactttaggaggccgtggcaggcagattgcttgagccctggcattggagaccagcccaggcaacatggtgaaaccccgtttctccaaaaaaatacaaaaatattagctgcgcatggtggcatgtgcctatagtaccagcttctcgggaggctgaggcaggaggatagcttgagctcaggaggtggaggctgtagtgagcttagatcacactacagcctgggcgacagagtgagaccgtgtctcaaaaaaaaaaaaaggaaagcaatctaaagtcgtggactatatccctgaagatagggtcttcatatatctctagccaggtgattttggtgtagtatcatgcatttaattaactttcattgaatgactggacaattagtttgcaagtttagtcaaactgaaataatctctcatatttactctggttaatgtattttttgtctaaaatattaaagggctattatgtacttggttagtttaaatagaagcatattagatgacactattttttttttttttttatggaaatggagttttgctcttgttgcccaagctgttgtgcaatggcacaatcttggtcaccacaacctccacctcctggattcaagcaattctcctgcctcagcctcccgagtagctgggattacaggcatgcaccactacgcctggctaattttgtatttttagtagagacaatgtttctccatgttggtcaggctggtcttgaactaacctcaggtgatccgcccacctcgtcctcccaaagagctgggattacaggcatgagccaccgcacctggccttagatgacactattaagtcagctaatgtgccatgttcattaccacgctagcctcttaattaatgcaaattccactggaaaaaaaattgtaatacctacatgggctgtgtttcaggagctaaaaagttaagtagtgttaatatgatacaaattgaacgactgactgtccactattttatgtgcaggcctttccatgtgataattgtctagttccagggctgtcatttcagaattacttgacacacttgtattattttatcccttttggtggcagtgggggtggggctagcctctcttggccattgcttttctcagttttcaaacagccgtatctcattatggcatatgttacatatggcatatggaacaaatttttgctaccaactctttcaattgagggcagatgttatatgtacttaaatatgcctttaaggaatctctttgtatcactactgagacttcagtagcatactgcaccacagaactggacttggggaaaaaaaccaaaaaacaaacttttgttgtttagtagatattcgtgtataacctccaagtttgtcagtataaaggcatgtagactgattctgacccatgggtgttaatttctgaaattttgtcacagcagttcaaatcttaccctgtcatttcgtatgtgttatcttttccaggaagaaaaatttgtaaaactggccaacatcttcatctagtgtcagcataatccaagttacactgtgatgtaatattgagcaccctattatcgtgcatgtttattttgctgcagggcttaacttcagatctctttttgttggtcaggcttttggttttttattccagggtggtatttcaagaattgactatatcaaagctgcaaaagtccttttcaagtagccagccactgtgggactatgatggataatggcacaaatgttaccaggaggggtaggagaaagcatctccttttgcattattatcatactaaaataagacacaacttccaaatgaatcagactaatctaaacaattcagggcattaccttgacaatgagacccagtgctcaagacatatccagaaggtgttggctaattatcatcagcttttcatgtctgctatgagtgcaacaaaagagaaattttgctttttactgatttaattatgcaccattaacaccaagtcactgtttctaaagaaggccctgatgttctcctgcagagagagcagtagaagtgagatgcttgaccggacacggtggctctcgcctgtaatcccagcacttcgggaggccgaggcaagcagatcatgacgtcaagagatcaagaccatcctggctaacatggtgaaaccccatctctactaaaaatacaaaaattagctgggcatgatggcgcgtgtctgtagtcctagctactcaggaggctgaggcaagaggatcgcttgaacctgggaggcggaggttgcagtaagctgagattgaaccactgcacaccagtctggcgacagagactctgtctccaaaaaaaaaagacatgcttatattaacttccaaagcccaagccctggattagggggtgctaacagcacataacaagtgctcaagaaatatttgttgaacaaatgattgaattagtgaatgaataaaatatctttttttttttttaatttttttgagacagtcttgctttgtcgcccaggctagaatgcggtggcgcgatctcggctcactgcaacctccgcctcccaggttcaagcgattctcctgtctcagcctcccgagtagctgggattataggcacaccccaccacacccagctaatttttttttatttttattagagatggggtttcaccatgttggccaggctggtcttgaactcctgacctcaggtgatccatctgcctcagcctcccaaagtgctgggattacaggagtgagccactgcgcccggccatgagtgagtaaaatcttacaaatacatatgagtcagcctatttttcatatgacaatgtctgttaaaagaaaaaaaaagaaaatgggctgggtgcagtggttcaggcctgtaatcccagcactttgggagtccagggctggcagatcacttgaggccagaagttcgagaccagcctggccaacatggttaaaccccgtctctacgaaaaatgcaaaaattagccaggcgtggtggcatgcacctgtaatcccagctatgagggaggctgaggcaggagaattgcttgaacccaggaggcaaaggttgcagagagctgagatcgcaccactgcactccagcccgggtgacagagtgagactccgtctcagggaacaaacaaaacaaaaaaagtatactgtaaaccatacattttattccatatgcagtatactatagcagctagtaccccaaaacaacattgtattagtttattctacacatatctcttttttttttttaggcaaaatctcgccctgttgcccagtctggagtgcagtggtgcgatctaagctcactgcaacctccgtctcccgggttcaagcgattttcctgcctcagcctccagaatagctgggactacaggcgcctgccaccatgcccagctaatttttttgtgtttttgttttgttttgctttgttcgagtcagagttttgctattgttgcccagtcttgagtgcaatggcatgatcttggctcactgaatcctctgcctcccgggttcaatcgattctcctgcctcagcctcccgagtagctgggattaaaggcatgcgccaccacaccaggctaattttgtatttttagtagagacagggcttctccatgttggtcaggctggtcttgaactcctgacctcaggtgatcctcccgtctcggcctcccaaagtgctgggattacaggcgtgaggcactgcgtccagtcttgtgtttttaatagagacgtgatttcaccatgttgaccagggtggtcttgaactcctgacgtcaggtgatcagcctgcctcagcttcccaacgtgctgggattacagatgtgagccactgtgcctggccaagaatttctagaacgaatttgatcctagtttaaatgatcccaacatcatactttcatatgatttagaaatcataaaactgcaacttctacatcagaggttcttactctgggtaggcttcaatggtctgtgatcccaccccctcagaattatatgcagcatattgcatttatatgcattttttatggtgagcttacccatagcttgtattggatttcagagaaaggaaatcatatgtccactccctgaaataaaaacaaatcaaagaatcagaccacttaaaaaaaatttttttgggccgggcacggtggcgcacacctgtaatctcagcactttgggaggctgaggcgggcgatcacaaggtcaagagattgagaccatcctggccaacatggtgaaaccccgtctccactaaaagtacaaaaattagccaggcatggtggtgtgcgcctgtagtcccagctactcaggaggctgaggcaggagaattgcttgaaccctggagacggaggttgcagtcagctgagatagcgccactgtactccagtctggtgacacagactccatctcaaaaaaaaaaaaaaaaaatttttttttgagatagagttgttctgtccccaggctaagctgcagtggcatggtcatagctcactgtaaccttgaacctctgggctcaagggatccttctgcctcagcctcctaactagctaggactatacatgtgtgccactatgcctggtttatgtttttggttttgtgttttgagaaggagtcttgctctgttgcctaggctggattgcagtggtgcaatctcggctcactgcaatcagtacctcccaggtttaagtgattctcctgcctcagcctccctcatagctgggattacaggcgccaaccaccactcccagctaatttttgtatttttagcagagacagggtttcaccatgttggtcaggctggtttcaaactcctgacctcaggtgatctgcttgcctcggcctcccagcttgctgggattgcaggcgtgtgccattgcacccagccagctaacgttttttttttttttttaatttttattttttgtagaaatgtgatctcactatgttgcccaggctggtcttgaactcccggcctcaagtgatctttcctccagctttccaaagtgctggtattacaggcatgaggcactgtgcccagcctcacatcagtttttttttttttttaacagatttgaaggaatgcaattgaatattgtttctatggttaaggaaaaaacagtttgctaagaatttagttatttcctatatggtaaacagtgtgagagtggacctacttgtaacattgagatagtcatactgcaaagcagagatgccatgaggagcagagatgatgtctgtaaagcgtcttgcagtgtgtctgctatacaacagatgcttaaaagtggtgggtattgtatatgtttgaagagatttgtgtatttatttcattactttcacctgttttccatcttgccattttattcatgttatgtagaggaaagtaattaagttttctaagtattccatatgtaccatttctcagtatctgcaaaagcatttttcctgctggaggattaagatactttatgaatgaattggtttcactgttcccatgtgatgcagaattatagttgtggtttccagcgagatgactatgccgcagttattttcttgtgcttgtataatgagagggttttggtgtttctgctgtgttctagacagttacactatacagctcattttcatatcatatttcatacgcaacaccatattgtggtgagttttctgtaaaagtaggatcaagggacgaggaagtgggaggacaagacagtggaaggccagagttgatccaagccatggaattttggatggagtggatataggttagatttagagaaaaaagcgggtgtctgttggtttcttctatccttggaggagtaagtaatttgtacaggagttattacagaattgcagggagatttgtctactgggcaacacagaagttaagttgctttccttatttcccattttctagagactctgatactgcattatgagttggtaaaacagactaataaaacaagaaaatcaaaatagtgttctattttctcttcctttttaaagaaccaataacctttattaattaggtacattactaattcacattacttcattactaattaggtacacgcagttttaacaaaattgaaactttgcttgaaacacacacaggaagctggcaaaggaaaggaaggtggaaggagactaacatttttttgaggggcagacacagtgataaaagacttcctattactgtattcaatgctgacagtaaccctaacccatgaggtgtaagtattcggattctcattatgcagaatgggaaatagaaacacgtcttgttgtttttgttttgttttgttttttgagacagtctcactctatcacccaggctggagtgcagtggcgcaacctctgcctcctgggtgcaagagattctcgtgcctcagcctcccaagtagctgggagtacaggtgcgcaccattacgcctggctaatttttgtatttttagtagaggtggggtttcaccatgttggtcaggcgggtcttgaactcctgacctcacgtgatccacccgcctgggcctcccaagtgctgagattacaggcgtcggccaccttgcctggcttttattttttatatgtagaaatagagatggggttttatcatgttaccctggactcaagcaatctgcccgctgcagactcacaaagtgcagggattacaggtgtgcatcactatgctcagccttattcagtatttattaagtgagcagtatagcattaagaactcacatgctcattgtctcatacaatcttacaacaatcgtatgaaatatatgttctgctttaatttataaagtaagacactgaggcttagagatgccaggtaacttgcttaagaacatagttgatctgggattagaatccctgggttgaatggtatgtgttcattttagtcaccatatctctgagctaaggcaatgaggaaaatgtgaaaggcccaaaagatggagagtagtgagactgagaggtggactggttgaggaataagtcatgttgaggttattgctgtcatcttttagacttgttaaatttggagagatgtgagcatcttctagcttcatttcacacaaaaaacaaaaatgttaacatgatttaaatacttcaaatctttgagtttgtcaattctactgctgctatattttaatattaaggtgttcctttaactgtgtttaactctttccatttttaattttacttaaaatatttttagtgagaccctgtctcaaaaaaaaaaaaatgttggctgggtgtggtggctcacagctgtaatcccagcactttgggaggctgaggcagaaggatcccttgagccctggtgtttgagacaagcctgggtaacaaactgagaccctcatctctacaaaaaatgcaggaattagctgggcatggtggtgagtgcctgtagtctcagctagtagggacgctgaggcgagaggattgcttgagctggggagatggaggctgcagtgagctatgattgcaccactgcacagcaacctgggcagaagaccctttctcaaaaaaaagaaaaaaaagaaaaagtttttacactccctggaccttatttccctctgaatcatggtctggtaattcttcactatcatggtaatgattcacattcactctcctattccttcaagcagatgactttgtattttgtccagcttttctaattgtcttcagcaggaggtttctcccagattatcaatttcattatcactagaagtgaaagtttcttattctcttttacttaataagtgtaaggttatattatgatgcaattagcatggagctagcctatcccaatactagtagcaaacttgtttaatacttagatgcatatatctatatgtgtgtatatatatactttaaaaagaaatttataaaaagagatggggtttcactgtgttgcccaggctggtcttgaactcctgggctcaagtgatccacctgcctcggcctcccaaagtgctgggctgacaggagtgagccacctagcccagccttagtgctctgggagaggttccagtgccccaaaatactgtgctcggttaatatctccaatttttttttttttttttttttttttggagacaagagtctcactctgtcacccaggctggaatacagtagtgacatctcagctcactacaacctctgcctcttgggttcaagcaattctcatgcctctacctcccaagtagcggggactacaggcatgcaccaccatgctcactaattttttgtatttttagcagaaatggggcttcactgtgttggccaggctggtctcgtactcctggcctcaagccttctgcctgccttggctttccaaagtgctgagattacaagtgtgagccaccatgcctggccttccaatttttatattaaatgaattttaactgctcattacatggtttacgtgtacactgttttcttaattagtggcagccatggttctccattgctacagttgtacggactgagagtcaagtgccataacacatgcttttcttttttctttttttgtgtgtgacagggtcctgctctgttgcccagtctggagtgcagtagtgtgatcatggctcattgcagcttcgacctcccagactcaagtgattctcccatctcagcctcctgagtagctgggaccagaggcatgtaccaccatgcccggctagtgtttttgtttgtttgtttgtttttgtttttgttttagagatgggtctcattatgttgcccaggctggtctcaaactcctgggctcaagcaatcctcctgccttggcttcccaaattgttgggattacaggcatgagccaccacacccagctactacatgcttttcatatccaatattgcatataactctaatgttagtatttccccccattgagtctactggaggttgacttgctcatggtcccatcattgggatttggatctccccaaggatatcctcgttttgtataagatcccagcactttgagaggccaaggtgggatgatcacttgaggccaggagtttgagaccagcctgggcaacatattgagaccctgtctctacaaaacataaaaacaattggaggctgaggtggaaggatcacttgagcccaggagttcactgcatgtctgccttgagccatgactgcactagtgtacaccaccctgggtgacagagcaaggccctgtctctaaataaataaataaatatttaaaaaatatataaagctattttcttttttttttctttttttcttctcttttctcttttttgagatggagttttgctcttcttgcccaggctggagtgcaatggcacgatctcggctcattgcaacctccacctcccaggttcaagcgattctcctgcctcagcctcccaagtagctgggattacaggcatgcaccaccaccctcagctaattttgtatttttagtagagatggggtttcttcatgttggtcaggctggtctcgaactcccgacctcaggtgatccacctgcctcagcctcccaaagtgctgggattacaggcatgagccaccgcatcccatttatgcattttaaacaaaaaaagctaatgtgtcattgactaagtatttggatatcaggaaaatcaaacagactttggaaagttaattgtagaaattctgttgtaaatattatgagttcaatgataagtctttttattttttggttcctctcttttttctatctgagttatgttccatggaaaagtgcttttcaataagaaccacagccattaagcagtgtcctcgaacatagctgttgttctgtattctatttctggaatgaacaaagtaagagcatcccctacttccaacatcagaagcatctgtgcagtacagggtcatccagctgagagagtaactcatttgtaggcagtcaaatcttgcttctccatagattgtgtgagactcgagtaaatgaatttagaaactaaagaaataagccttttctgaataactggtctcatctcaacaaaaacagcctacataaaggccgggcacagtggctcacacctgtaatcccagcactttggatgaccgaggtgggtggatcatgagatcaggagattgagaacatcctggctaacacggtgaaaccccgtctccactaaaaaatacaaaaaattagctgggcgtggtggtgggcacctgtagtcccagctactggctggaggctgaggcaggagaatggtgtgaacccaagaggcagagcttgcagtgagccgagattacaccactgcactccagcctgggtgacagagcaagactccctctcaaaaacaaacaaacaaacaaacaaacaaacaaaaacagcctacataatatccattctcaaaataattgcttttctctgattaggagacttagttatacaagggtgttttctagcttaaaaacaaaagagttgactgggtatggtggctcacgcctgtaatcccaaaactttgggaggccgaggtgggtggatcacctgaggtcaggagtttgagaccagcctgaccaacatggtgaaaccttgtctctactatttacaaaaattagctgggcatggtggcgggcgcctgtaatcccagctactcgggaggctgaggcatgagaattgcttgaacccaggaggcaggggttgcagtgagccgagatcgtgccactgcatgccagcctgggtgacaagagactttgtctcaaaaagaaaaagaaaaaacaaaaaacaaaacaaaacaagagtttcaggtctgggacaaaccaatcacctctctttagttctccccttgaaaaggtaacttatatttttgataatcgtcttaacaggagcgttattcttggcttttcaaagaaacaattatggacaattgaaagaacaacaaaaataattctaacgggaacggtagagaagtaaaggctggcatctcttcatatgcatgctcagtaaccttgctacccaagtggtggcatatttattgatatttgtatctccccatggccccttaacaaccacactggaatgttacctcagcaacttagtgctccagtgtctttgtgggtgctgttacctccatgtggggcacactcctttcttctctccctctatatcttgccaactcctacctgccaacccttgggtttcagtgggaaatattgcttcccctgggaagcctcctctgggtactatatacctcctgggctcatctcattctacattacatcatgaatatgtgtttatttgtttgtgtctcttagaagatggtagtttccgggtgggtggcaacaatgacattcctccagttatacactcagcactatgtctgcatgagagaggtgctcaaggctggggcacagtggctcatgcctgtaatcccagcactttcagaggccaaggcaggtggatcacgaggtcaagagatcgagaccatcctggccaacatagtgaaatctctactaaatatacaaaaaaaattacctgggcgtggtggcatgcacttgtagtcctagctacttgggaggctgaggcaggagaatcgcttgaacccgaaagttgaaggtcgcagtgagctgagattgcgccactgcactccagcctggcgagagagtgaaactctgtctcaaaaaaaaaaaaaaaaaaaaaaaaaagaggtgatcaacatacattacattgttttaaggggttttggttattaaatggggaaagttattgtgaaaaacaaattaatacatttaaagaaaacatttttggacctgggttcttttaaggttcttcaataattttaagttctctgaaatggaagggaaaaaaataaagtttttttaaaaaaatttttaattttttcactttttatgatggagtctcactctgttgcccaggctggagtgcagtggcagcattttggctcactctctgcctccggggttcaagggattctcttgcctcaggctcctgagtagctgggactacaggcatgcgccaccatacctggctaatttttgtattattattattattttcagacagagtttcgctcttgttgcacaggctggagagcaaatggtgcgatctcggctcactgcaacctccgcctctcaggttcaagcgattatcctgcctcagcctcccaagtacctgggattacaggcacccgccaccacgcccagctaattttttgtatttttagtagagacagggtttcactatgctggcctggctggtctccaactcctgacctcaggcgatccacctgccttggcctaccaaaatgctgggattacaggcgtgagccactgcgcctgagctattttttttttttttttttttttttttttgagacagagtctctctctgttgcccaggctggaatgcagttgcaagatcccagctcactggaacctgtgcctactgggttcaagcgattctcctgcctcagcctcctgactagctgggactacaggcatgcgccaccatgcctggctaatttttgtatttttagtaaagacggggttccaccatgttggccaggctggtctcaaactcctgacctcaagtgatcctcccgccttggcctcccaaagtgctgggattacaggcatgaggcaccatgcccagccctgttattggatttttctgtccaaattttgaatctagacactgacacagggagtaggccttccagtttctagttggtacaaagaagagttgagaaatttgagagaggcaataatttcagccccattcttacaacagtttgtctcagttggtaactgttgaagattattcacctactttttcctcaattcttgctttagaagagccatcaaggaacagctattaccagcagaactgctggaaggaatccagtagatctggccccttgggagagtgggggaagagcaagagtagcctcagggaaaggggtcagggagagatccagcaggaaaggctcttctagtggaccaaccgcttacatccggactattactccacccagtcttccaaggagattctccagtgttagcctttcaggttcctatgtgtcacaggaaataaaaccaaactagcttttttaaatctatgagagagaacgggcgcggtgactcatgtctgtactccctgcactttgggaggctgaggtaggctgaccacttgaggtcaggagtttaagaccagcctggccaacatagtgaaaccctaactctattgaaaatacaaaaattagccgggcgtggtggcacgtgcctgtaatcccaggtactcaggagcctgaggcaggagaatcccttgaacccgggaggcggaggttgcagtgagcagagatctcgccattgcactccagcctgggcaacagtgctcaagacaccatctcaaaaaaaaaaaaaaaagaagaaaagaaaaaaaaaattagcttgttgtggtagcacatgcctatttgggacactgacatgggaggatcgcttgagcccaggagttcgaggttgcagtgggctatgattggagcattgcactccagtctggggaagagagtgagaccctatcaagaaaaaaaaaaaaaatctctgaaaggtacaagacattcttttcttattccttaaatttttaaaaagtttttaatttttatgggtacatagtacatgtgtacttattcttattgattggaagtttataatagatggtacttggaatatctttagttatcactgcaaaattgtagcccccaaaatcagaagaaaaataaagaatttcttgggagaggagagcgcgggacatattggaaggaaattgtgtttcggtcttcagtcttgaggaaaggtgaattactcctgagattaatttggaagaaaattccttgtagtatgctgctgttgttttaatctaggtagtttgtacttacagtttcttatcaatccagaggtgcatatacccagaaagagaagtggagttttggaattattcataattttaatcctgaagccacaacacacacacacacacagcttcttttttttttttttttttttttgaggtgtagtctcattatgtcacccaggctggagtgcggtggtgtgatctcagcttaactgcaaactccgcctgccggtttccagcaattctcttgcctcagcctcccaggtacctgggattacaggcaagcgccaccaggtctggctaatttttgtatatttagtagagacagggtttcatcatgttggtcaggcttgtcttgagctcctaaccttgtgatcagcccgccatggcctcccaaagtttgggattataggtgtgagccactgcgcccagccaaaacatatatatatatatatatatatatatatatatatatatatatacacacacacacacacatatatacacacacacacacacacacacacacacacacacacacacacacatatatatatatatatacacattttttttttgagacagtctcttcctgttgcccaggctgcagtgcagtggcgcaatctcagctcactacaaactccgcctcctgggttcaagcgattctcctgcctcaggctcctgagtagcttgagattacaggcacgtgccaccatgcccagcggaagacatttcttttaaggttattttaggatatttacaaatgtcttttgttagatactgaaaatcaagaggatttgtagagagagctgtatagatggttagaagtgggatcaactcaaattctatatattttcatattttttctgtatattaataaacatcttatggtacatgctcaagtcaagttctaacctgctgtgcaagctgagatatttttacttctttgggcctctgaattatttcatagctaatatttaattttttttgtagagatgtgtctccgctatgtagcttaggctagccttgaaatcctgggcttaagtgatccttcaaccttggcctctcaaagtgcttggattgcagatgtgagccactgcacctggcctctgctcagaatttctgactattctctcccatcaaaactcgcccagagctcagaccaccaaatcacttagtataggaattgaaacacctgatctatgctgtgttcaaacaagtatagatcttcgtggtgaagcatcaatttgatatttggagttaatgttagttctgatcacattcattaactttcatatatagctaggatgagccttggctttatttattatccaattttacagaagagtgcacacacaggccttcgatgtttgcttaggttgtcaagtgcaatgttgtatggcttcatgagtatcctatacagtgaaaacacctgtctttgggcctttacaaaacagacctctcagcaatatagatattctgtacacctaaccctctgagcctgatttcattttattttattttattttcatgatcacacagctaatggatttttttttttttttttttttgagaccgagtctcattctgttgcctaggctggagtgcagtggcacgatctcggctcactgcaacctccacctcccaggttcaagtgatcctcctgcctcagtctcccgagtagttgggactataggtgcatgccaccactcctggctaatttttgtatttttagtagagatgaggtttcatcatattggccaggctggtcttgaactcctgacctgaagtgatccacctgcctcagccttccaaagtgctaggattacaggcgtgagctaccacgcccggctgatcgacttaaattatacaattctatcataatatatcatggccactttactaaatattgaacaattaacctggaaaaaaatgttcattttttaaagttatattcaaacattcaacagaagaggcataatgtgtaactgaaatgcaaggcacttcaagaaatgtaggactacccttgtgcaaagctgatgggaatgtaaaatggtgcggctgctatggtaaacaatttggtagttcctcagaaagttaaacatagccttatcatatgattcagcaattctactccaaggtgtatactacttgtatacctacttgtacacctatgttcatagcagtaatattcataatcaccaaaaagtacaaatgtctaacaacagaataagggaaaaacaaaatgtgttatgtacatacaaaggaatattgttcagccttcaaaatgaatgaaattctgatacattctacaacatggatgaaccttgtaaatattatgctattaataagtgaagcaaagagaaacgaaaagaaaaatactatatgaaaaatactatatgattccaattataggaggtacttagagtagtccatttcatagacagaaagtagaatggaagtcagtatgggctgggggaaggcaaatgaggagttattgtttaatgggtatggagtttctgtttacaaggaagaaaaagttctggaaatggagaggtgatagttgcatagcagttgtgaatgtacttaatgtcactgaacgatacacttaaatatagttaaaatgggctgggcgcagtggctcactcctgtaatcccagcactttgggaggccaaggtgggcggcccacctgaggtcaagagtccgagaccagcctgaccaacatggtgaaacctcgtctccaccaaaaaatacaaaaaattagccaggcgtgatggcgcatgtctgtaatcccagctactcgggagactgaggcagcagaatcatttgaacccggaaggcggaggttgcagtgagctgagatcgcaccattgcatctaggcgacaagagtgaaactcgatctccaaaaaaatagttaaaatgataaattttatgttacatatatttcatcacaatttaaaaaaaaatcaccaaaaatgggatgtacagctaaaagattttgtacctattttcaaatcttactgtatttgattatttttctgccagtttcaatgctgctttattcctcacagagagcttcttatagatagtgtgggcttagtgtgctcaaagttgcactggtggatgtgcatatttcagagtccattggttttgttacaagtgttgcaggaagagttgagaacaccatattcattaggttttttttttctttttctttcttttttttttttttttggagacggagtctggctcagccatctaggctggagtgcggtggtgctcactgcaactactgtctcctgggttcaagcgattctcctgtctcagcctcccgagtaggtgggattacaggcacccaccatcatgcccggctaatttttgtattttagtggagacagggtttcctgttggccaggctggtctcaaacgcctgacctcaggtgatcttcctgcctcggcctcccaaagtgttaggattacaggcgtgagccactgtgcccggccaatagtttttttcttacatgaatttgttaaaaatgtgggtgaggggtgggtgagtgagaggtaatttaaaagtggaaaaacaacgcatgccggacttcacgttccaacacggaaagcatgcttttgtggcaaactgaaaggctagggattaagggtgatgaaatgcaggccttccggccctcactctgttcctgatttctggttgtgggaatctgttctgaatccagctgcaagtggaaaacccatctttggctgagcagccggggaggccctcctgccaatccccgaaatgtgctgctgaaactttggccctgcaaggctggagctagggctgtcttccccagatctgtgcagctgtcaaggtggctgtgatgggactgtgaccgccctctacactgcattttggcagtgaccttgagaccagccagctcaccacagctgccctgctctgctgccgctgttgcaatgccaggtggcttaagaggggtcgtggggggcacggctcccggtccagtctttcccagtgtctggcaggtgctagctgtggtgccagctgtcccactgcctaccacccactgggcgtgggggcagtccaggtgtgtgtcgggagatggtggtttgttctacccctggctcaggtcccgatccctgggaagtgggtggttccgtctgaccgcgagtctggtgcgcagaccggccccacgtggggacttgcttggcaggtctgcggatatagatgctcagtgacagttgatcttgggagacagaagagccaaaggtgtccttttgtcccaaagatatgagtccgaattttccttctcgtaggggagaaattttatttggaaatgaaggtcatcagaaatgcccagagcaagagagaaaatcctttctctctagccactcagagtggcaagtgtattttgaaaactcctccctctctttttgtcctcatcctgtccttttccttttcagtggctttactgttattttttaattcgccattgtcattggacatttattgacagaaatcaaattgctgtgtttctgggcaaagcgcctgctgcaaagaggtgtggttcctgaggaatgagacacgcagcccaacagctgagcctacactgtcctcacataacctccctgccttaaatatcgccaatatttagccttgccttataaagtaaaaatgcacaataccttccagagtttcagcaagcccaaatgcccccctaggctcagttatgtctcctgtacattggaggcagagcagcgcacccctcccccatgcagacctgccctcggaaccgccaagaggttactaatcaggaaggctctaccatcgatccaatggtggtgacctgggggatttgtgtgcattgtttttgttgaagcctcctgtgatttcggcgcgaccagatcctctgcagcgaactccatgtcgcagcttgtggctgcctgtgtcctgtggtgagagccgagccgcacaggagatcctttgtctaggaagggctaggctgagaagatcactttggagttgctaagctctgcattgccattggctgcactctttgtggggctgtttttgcaaaaggcatgcccagcacgtctacagtgctggcaggccagggctgcctttaaacaccatgataataataccaaaaagcagtttgcagaactgttccactgtagaggcttcctctgcagaagcaagcaagatggctacctcgtgggcttcgctgtgaagaatgcagaggctaattaagacagactttaaggggaaaaaagggtatttccctgcttcatctttatgcaagatttttttagtgacttttaaagtatacattttacataagctctttaggttctgcctagcaaacatgttgatgattttaaatggtataaatagttttacagagaaatagccaaaaattttggggatgtgggagctaattttatttcttaaacagaggctcattttgcaatttgattttttttaggttataaaggaaaacaagaggccccagagggaaaagaagcccaaagttttaaaggtaatcagctgttgattaaataatatttcattatttttccatttcatatagtatttttctgcacttgggtatatttggagtacagtatatgtgaattctcccagattttcagtagatggatgaatttccactcaactaaagtgttttctctctcttttttttgatgtgctgcataatgtgcatattagcatcctttattttcaactccactcaagtctacagaaagaaaagtttgtatgcagagtgttgtgaataaaatttgtttttctttatagctccctttgtagcatctgcatttgtggtgttgcaccagtgtgtaaacttaagccctttagaagaaaggcactatttgaagttgacagctatgatccattgtgattttaatagactgtccattaaaggctattttaaaatgtatgattcttttccaaagaaaaagtccttaatgtgtaagtagtggagatcttacagccaaattatagttgtttaatctcaaattctcataatatcatctttaattttggctttcatgaagccataagaatatgcatgttttctttattttctatagtttgcctgatgagtattaatagtaacctaattcagttataagctcacagtctgtgtgatgagatttgtacagtgtttagaagggttaatttaaaagcatatggcatcactaaaagttcaaggctagctttagtctaacgaataggtgcttatgtgtttaagatttcaagtggtgtattgctattacaaatgtaagcaacctttgcaagccaccttttaaattcatgaagaaatactaagcaataaaatgacttatctttaattattttgtgtacatttaatttaaaatagttttacctaatcctagctttccttttttacacataaagttttagcactcaaagaggaacaacatgttgaactatgaatgtggcagaattttatttcatttgttgccccagtgtgtaacttgaaaatgttgacacggagaaccaaaccttgccctgctttcaaatttgcctgaccacattgagtttctgcttcctgtgtatatacagcattttcatgtacctgtttcatcaaccaacaagtatttatttaatatttaccacatagtcagcaatgtgctaggcactgtgaaatgaatgaaattgcttgacacaaattttcactgggcctggacaaatagaatcatggttattctcaaggtaaattaaacccttttctgtttttcttctttgtgttgatccatcgacccccatttattccttttccttccaacagagatagaagtttatcattaaaagctccttctatactttctgtgttggctatatccatctcaggcattttgtgaaaaatagatttagtcttcctcttaaaaatggctctcatttgttggggttgtggatggggattagcaggagaaagggatagattatgtggagaaactaatacagaccaagcctagtatctatgtcttcccctgccttggctaggaagtagaattggactttgggaatgcaatttaattctatgtttattttgttagattgtgagtgtcctgtcacctgaaataaatgtaaaaagtaaatatgccatgtgttgctttttggaatcacggtagtggactctggcttaaaagaaaaagaataaaagtgcctgtgggtggccacatttcatctgcaacagcaagcagaaccaaattgttgctcacgttcctctatagttagcaattactgtacaagagcaggaaaatattctaaaaggaaaaaaaatttctgatgttggcatttaaaaatggttttccacattttctgttagacataattttttttctcatccaaagaaagctttgtttctctgcttcacagtagaaatgctaaaaaaaactttcagattttagcttgatgtgtataaaattcatagagcaaatgtagaatattatataatcctatagaagacataaaaaaaatgaaacctgtgtttgggagggagagtgggagaggaatacaactgtcagcttgaggttttatgagtgaggacttcaacattctaggagcatgctacctgggggaccagtgatgggaatctcacagtttatgatttggtcttccatcattatttgctgtctttacatttggtgtcattccagaaatttagtctgcttcctttgactttatccttttagatgttgaaatctcctggatcatttaccctttgtcagggtggatgctgcaggtatcctgattgacttttcattttcatcatctattagaaagtagttggatacgtgaagaacctgattcaagaagttgggtatagaatttgagacttgtttcatcctacactgacctgaacctgataactattgaatccagttgtggggctgaaattggctggcatgtcttatatccctctcctcttaaaaacatacctgttatccaccaggtatgatgactcatatgtgtaatcccagaactttgggaggccaaggcgggaggattgcttgaggccaggagtttgagaccagcctgcaaaacctagcaaaatcctgtctctatgaaaaatttaaaaattagctgggtgcgacggtgtgcacttctagtcctagctactcaggaggctgaggagggaggattgcttgagcctaggagttggaggctgcagtgagctataatcacatgagctatatgcactccagcctcaggaatagaatgagaccttgtctcccaccaccaaaagaacactattatccatatttataccatattcattctattgtacttcaaaattaaaaactaaatagcgatctaaatcctgattagagattcttcctgtagctgaaatgacagctctggccaaagcactctaaaggccagaatgggtatcagctaatggtgcactagtggtgggtgggggtagctcagcatcaacttcctattcaagcctattggtgatcactagttattttcatatatagatgacatcttgttagcaatgttattattggaaacacaagcatttccttgactcttgatctaggtagaggtgtggtctaattccagtccttcaatcacgaacttagccttttaagtgacgtggtttggaattcctcttggaagaaacatttgtgtaaataacttttactttgtgtgtgtgtggtgggagcaggtgagtaggagtgtatactccctttaagaaagtcaattttaagatgataatagttttgttagattgttagtcattgtccctggagaaaatcagacagcacagtcaattgggggtttgaacagagtttaataaaggaattactttcaatagtgtgggagggttaaggaaagaactaaggatggtgaagaaatccagatctaatgaaggcagagctattactaatcctaggcctgaagggggatggtgagtggaaaccaggtaatgtagctacagctgagtagaggaagcatgggctggagcctttggtaaagagatgctcttgcaaggagtcaagtggggggtgggtgtgggataaatgccctgctctccagtctcctgctgctttgattggttgatcccaatggggagccagagtgaaaggggagacctctgatgtagtacacgctggtcagccttctgggatgtgtaagaaggttatggaaggtggaatgtaggcctggaagggaaaacaacatactgggcatgactagtgaccacaggggtggtatggtagagtgaacaatagtactagaactgtgattacataagatggtaacattaggcaaagatggctgaagagtacataagaactctatactatttttgcaactcatctgtaaatctaaaattatttcccaataagcatgaggatccttgaggggatgcatttatacattctgtaattagatagtctttttggctggtaaggaatattttctagctatttaattataaaatatcatcagagtagtatttggaagagctgggtgaacaaatataaagaaatgtcagtggatattaaactaggagagtgtctccagaggttgattttaaaaaggcaaaatgaaaactaagggatcttcctgcagggttcagcactgacttgctcttctcttttccttcattccttgatgatgctgataaagaacaagtggggccaggagagtggctcaggcctgtaatcccaacacattgggaggctgaggcgggcagatcacctgaggttgggtgttcgagaccagcctgaccaacatagagaaacccccatctctactaaaaatacaaaattagccaggggtagtggcgcatgcctgtaatcccacctactcgggaggctgcggtaggagaatcacttgaatccaggaggcggaggttacagtgaggaaacaagcaaaaattgccgagatgatgaaggaaaacatcatctagggaaagatacttaacattcccatcatttataaattgtttttattgaatttatttacttatttatttgagacagagtctcactctgtcactaaggctggagtgcagtggtgcagtcttggctcactgcaacctctgccacctgggttcaaatgattctcctgcctcagcctactaagaactgggattacacacatgtgccaccacgcccagctaatttttttgtatttttagtagagacgaggttttgccatgctggccagtctggtctcaaactcctggcctcaagtgatctgcccactgcagcctcccaaaatgctgggattacaggtgtgagcaaccacgcctagcccataaattatttttatatatactagaccagtgctggtttaaaaggactaaattatactctggttatgtttgttgtttgttgtttgtttgtttgttgagctgaggtcttgccgtgctgcccaggctggttttcaactcctgggctcaaactattttcctttctcattctcctgagtagctaggattacagccaccctcccctgctaaaattactaaattagatacaattgagttacattgtttattttaaaattctattaagctataaataggccaggttcggtggctcatgtctgtaatcccagcactttgagaggccaggatgagtggatcacttgaggtcaggggttcaagaccaccctggccaacatggtgaaaccctgtctctactaaaaatacaaatattcgccaggtgtggtggcaggtgcctgtaatcgcagctaattgggaggctgaggcaggagaatcgcttgaacctggaaggcggaggtggcagtcagccgagattgtgcctctgcactccagcctgggcgacagagggagactccctctcaaacaaacaaacaaaaaaccctacaaatgaaagataacatagttgctaatgattttcttctgcttatttgtctataactttgtttcagttagtaaaataaatcattggtaaagtaatttctttagagtttttaaacagacggttataatgcaacattctattacttgtagcaacatgttgcaaatttaagtactagatcaaatactaagcttgaccatccttcaggggaaaaacaaaaacaaaaaaaaaaacacatgtcattttgataggtccttatagtcccaggcaactaatcccagacttctggatttaatgggccagtgaggaaaaaaatcagagtgggtgttgaaaatattcacaagggaataccagctttaatttttaaaaatggaaagaagataatatcagaacacaggaaggtcatagaaatttaataatttagttttatgacaacacattgtctttattgaactcattttgtcataaactggcaaaaactgttaaggacgtgtgctcacccatcagtgtttattcacacaatcaaagacacacatgggcttcgtttgtatacccagaaactgtaatacagcattttgcctggagatcagactggatttcagggctgagttctcactaaaccagctcatatacaggcattcgtttatcactgcagcatgtatatttccagtgactcaagactcatgtccattctgtgatttctaggaatgatcccaaacagagaatcaaagtgaataaaagccaaatggagttggacgggtttaaggaaaatttcattcaggctattaaaaaaaaaaaaaagacttgaattcttcctagtccacaaaagaacatatgccttgtatcctgaatacttaggctcatctggtacgtgtttgtgttttgatagtgccggattcatactgtttctgagttgtactttctttactgtatagctctccatttactgactagaatatattctcatgagtcagatgaaaagagccaactaataactttatttaagttttgtttggatcttaagttttttttttttgttttttttgtttgtttgtttatttgttcttgagacaggtctcactctgttgcccaggctggtgtggagtggcacaatcttggttcgttgcaacctttgcctccggggttcaagagattctgtagcctcagcctcccaaatagctgggatcacaggcacacaccaccatgcccagataatttttgtattttttgtagagacaaggttttgccaggctggtctagaactctgagctcaaagcaatccattctcctcaggctcccaaagtgcaggcctgcaccactgcacctggccttcttaattcatttttaagtgaaatatttttaataatggaatgtcttgcaatgtcattcatatatatatatgaatatatatattctctctatatatagaatatataaatatgtttatatatataaatataaatatatatttcattttcaaagatttgatggtaaggtttgccaaccaaaatggcctatgcaagagaacgtgggtaacagaggtaacagtgtcttttttttttttggacagagtcttgctctgtcaccaggctggagcacagtggtgcaatctcggctcactgcagcctccatctcccgggttcaagcagttctcctgcctcagcctccggagtagctgggactacaggtgcataccaccgcacccagctaatttttgtatttttagtagagactggggtttcatcatgttggccaggatggtctcaatctcttgacctcatgatccaccctccttggcctcccaaagtgctgggattataggcatgagccaccgtgcccagccgacaatgtcctatttatttatttattgagacggagtctcactctgtagcccaggctggagtgcagtggcatgatctcagctcactgcaacctccgtctcccaggttcaagcgattctcctacctcaacctcccgagtaactgggattacaggcgtccgccaccatgcctggctaattttctttattttcagtagagatggggtttcaccatcttagccaggctggtctcgtactcctgacctcgtgatctacccgccttggcctccctaagtgctgggattataggcgtgagccaccgcgccaggcctattatttatttatttttgagatggagtcttggtttgtcacccaggcaggagtgcagtggtgtgatcttggctcactgcaacctccacctccggggttcaagtgattctcctacctcagcctcctgagtagctgggactaaaagtgtgtgccaccaagcccagctaattttttgtagttttagtagagacagggtttcaccatgttggccaggctggccgccaactcctgacctcaggtgatccgcctacctcagcctcccaatgtgttgggattacaggcatgagccaacatgcccagccatatttattttttaattaaaaaaaaattttttttaatacaaaagaggggtctcaaatgttgcccagggtggtctcaacctcctggattcaagcgatcttcctgccttggcctccaaaagtgttggaattacaggcatgagcaacctttcctggcccatagttttgtttgtttgtttatatgtttttatgacagggtctcactttgtcacctaggctggagtgcagtggctctgctcactgcagccaaaacctactgggctcacgtgatcttcccacctcagtctcctgagtacctaggttgacaagtgtgtgccaccaagcctgactaattttatttttttttgagatggagtttcgctcttgttgcccaggctggagtgcaatggcgtgatcttggctcactgcaacctccacctcccaggttcaagtgattctcctgcctcaccctccctagtggttgggattacaggcatgtgccaccacgcctggctaattttgtatttttagtagagatggggtttctccatgttggtcaggctggtctcgaactcctgacctcaggtgatccaccctcctcggcctcccaaagtgctgggattacaggcatgagccactgcccccggccaagcctgactatttttaaaattttttgcagagaccaggtttccctgtgttgcccagggtgatcttgaacttctgggcttaagcaatcatcctgccttagcctcctcaagtgttatcccacagttttaaatagtaactccttttctgtacttctgaagtttttgtcatctatgtgtaaaattcagtgatgtcacatgaatttgattaaagcatagattattttcataattctaggaaatcagatattaaataataaacttattctaggagtttggttattttatatatatatagcgtgtgagagcattttaaaatatttcatttatttatttttaaatattttatatacatatacaccatatcataggattatctgggagttgggtgaattatttaaaatatgttaggcagggcacagtggctcatacctgtaatcccagcactttgggaggctaaggctagtgggttgcctgagctcagaagtttgagaccagcctgggcaacatgagaaaactacatctctatatatttataaaaaataaggcagggcacggtggctcacccttataatcacagcactgtgggaggccgagacaggaggatcacgaggtcaggagatcaagatcatcctggctaacacagtgataccccatctctactaaaaatacaaaaaattagccaggcgtggtggcgggcgcctgtagtcccagctacttgggaggctgatgcaagagaatgatgtgaacccgggagatggagcttgcagtgagctgatattgcgccactgcactccagcctgggtgacagtgcgagactctgtctcaaaaaacaaacaaacaaaaaggccaggcatggtgacttatgcctgtaatcccagtactttgtgaggccgaggcggtggatcacttgaggtcaggagctcaaccagcctggccaacatggtgaaaccccatctctactaaaaaaaaggaaataacaaaaattagccaggcatggtggtggttgcctgcagtcccagctactcgggaagctgaggtgggagaattgcttgaacccagggggcggaggttgcagtgagttgagatcgcccactgcactccaccctgggtgacagagggagattccttctcaaaagataaaaaaacacaaaaataaaaaatatgttaaatgtttagaaccgcttggcatactgtggtttttttgtttttacttttttttgacaaggtcttcctcggtcacccaggctagagtgtagtggtgtgatcatggctcactgcagccttgacctcctggatcaattgatcttttacttcagcctcccaaatagctgggaccataggtgtgcaccaccaatcccgcctaatttttatattttttgtagagatgaggttttgccatgttacccaggctggtctcaaactcctgggctcaagcaaacccaaagtactagcactacaggcatgagctaccttgcccagctagtaattttttaatagtgattataattacaagtaaaggtgtaatttatgttcataagaatatgaagtgaactaggctgggcgcagtggctcatgcctgtaatcccagcactttgggaggccgaaggtggtgggtcacaaggtcaggagttcgagacaggcctggccagcatggtgaaaccccgtctctactaaacacaaaaattagccagacatggtggcgggcacctgtaatcccagctactcgggaggctgaggtaggaaaattgcttgacctcaggaggcggaggttgcagtgagctgagattgtgccactgcactgtagcctgggcaacagagcgagactccttctcaaaaaaaaaaaagtgacctttccaaaaaatgtggatttcagtcaggtgcagtagcacactcatgtagtcctagctactcagaaggctaaagcaagaggattgcttgaactatggagctcaagaccgtggtatgctatgagagctcctgtgaagccaccgcactccagcctgggcaacatagcaagactccatctcttcaagaaaaaaataagtgggttgggcatagtggcttatgactgtcattccagttactcaggaggctagggtgagaggatcatttgagcttgggagttccaggctgcaatgagttgtaatcatgctactgcactccagcctaggccaattgtcagagaccctttctttcttttcttttcttttcttttctttcttttcttttcttttcttttctttttctttcttttttttttagagggagtctcgctctgttgcccaggctggagtgtaatggtgcgatctccgctcactgcaacctctgcctcctggattcaagtgattctcctgcctcagtctccatgagtagctcgggaggtggggggggtggggagagagggagagagagagagagagagggagggaggggagaaaggaaggaaggaaggaagaaaggaagggagggaggaaggggaaaagaaaataatattatttcctcttggtatattcacttgatagccttactgagaaatataagcctatattcaacagaggcttttcattccttttgaaaatgtcacttctgttttaatttacttacaatggatgaggcatatcttgttgttgttttcttttttttttttatttgacagagtctcactctgtcacccaggctgaagtgcagtggctcgatcttggctcactgcaacctccgcctcctgggttcaagtgattctcctgtctcagcctcctgactagctgggacaacaggggcacaccaccacacccagctaatttttgtatttttggtatagacgaggtttcaccatgttggccaggctggtcttgaacttctgacctcaggtgatccaccagcctcagccttccaaagtggtgagattaccagcatgagccaccgggcccggccagtcattttgttttaatgtgatcagcaggtactaggacccaattctataatcccagcagtgtgggaggctaagtttggagaatccactgatccccggagtttgagaccagcctgggcaacatgttgggatccagtttgaaaactgaaaaataaaataaagtcctttatagtctattaatttgcttaagtttttatttgcatttattattctatatgtatgggggttttttgtttttgttttgtttaggagatagagtctcactttgtcacccaggccgtagtgcagtggcaagatctcggctcactgtagcctcacctctcaggctcaagcgatcctcccacctcagtcccccaagtagctgggactacaggtacacaccaccacgcccagctaatttttgtgtttttcatagagacgggtttacagcatgttgcccaggctggtcttgaactcttgagctcaactgatctgcccacctcagactcccaaagtgctggaattacaggcatgacccaccatgcctggctgcttttatgaatcattacaaatcctttaagggtagagtagtattcacctttttgttctccacagtgtctaacagaatatcttgtgtttacaactcaatacatttatctttttaatgaataattgaattcatacacattatagcttaacttcagtcagttaagtcagaactacaaaatttgtgtaattgcatcttggtgtaaaggaaaaactacttcctcaaatcattgatccagcgttgatagtctctgtaattaattgctatggcaaatcaagatacatatttaatacatttattttaatttggttaacttttctctgacatgttacatttaaaagaacccaaacctacagaaaagtctttctttttgatgatggttgcatagactacttgttccattttgtaaaaaaatcttttgatttgatggtcaagtgatttgggtaactgacagtaaatttcagtaagtttcaggtaggttgtccaatctatgtttaactgttggagtctttgttggagactgtccaaagttcctaattacaggagattagcagattggaaaaaataatgtaattgggtaaactcagagattaaattgatctgctgcatccaccccagtggtttcagggaatgaagataaaagaatgccttaatcattggttcattgaaaaaacaacatggaaaaaaaaagtaatgatataatagagcaatggggaagcactcacaaaaacactactggttggccggacacagtggctcagcctgtaatccctagcactttgggaggccgaggcaggtggatcacctgaggtcaggagttcgagaccagcctagccaacatggtgaaaccctgtctctacctaaagtacagaaaattagctgggcatggtggtacgcacctgtaatcccagctactcaggaggctgaggcaggagaatcgcttgaacccgggagacactggttgcagtgagccgagatcgtgccattgcactccagactggaggacaagagcgagacttcgtctcaaaaaaaaaaaaaaaaattgctgtttaaagtattttggtgaaccttatttgaaggttatttgctgattaagataagtagaagctatttcaatgttaattttgtccctccacccatgaaatctggtttatgctctcacttaatggatagtgtaaaatagctgaactgaagattggaacatttcatgagaaatttaatccacctgtccagggtttatttaaagcctgtgatatttgatcacttcactaaaacaacttaggaccatgctgaccatgctgatttagttgggccacattttctaagatgctatgcattatcacaaatgatacaattatactataaggtctaacagctaatttctgctcaatagaatttctagggggaaatactgaagattaatttatgtgctgttcatggtcagaaataaaaaacagtgtaaatactgtgttttccttcaaaagtggagaaaggaaaaaatgtatttttctgtcctgacttttcaaaaaactcagtcaaattcactgcccaagaaatgtgatttgctaaattctgaaatgaaaaagtatcctgtcttctcacttcttaattttttgagacaagagtcttgctctgttatccagggtggagtgtggtggcacgatctcagctcactgcaacctaaccttcacctcttaggttcaagcgattcttgtgcctcagccacctgagtagctgggactacaggtgtgctcactgcattctccacctcctgggttcaagcagttctcgtgcctgagtctcttgagtagctgggattacaggtgtatgccatcacacctggctaaattttgtatattttatagagacagggttttttcatgttgcccaggctggtctcaaactcctgagctcaagcaatccgcccaccttggcctcctaaactcctgggcttacaggcgtgagccatcacacccagccattctcacttctttcttgtgtgtttcataaaaaatttaaaatttttatggctttttttttttgagttttacttttttgcccatgttggcactccaacgtggtgtgatatcggctcactgcatcctccgtctcccaggttgaagcaattcttttgcctcagcctcctgaatagctgggattacaggcgtgtgccaccacacccggctaatttttgtatttttagtagagatggtttcaccatgttggccaggctggtctcgaactcctgacctcgtgatccacccgcctgggcctcctgaagggctgagattacaggcttgagccaccgctcccagcctggcatagtacacagtattcccttataccctaccctgaggtttcttttttttcctctctctctccacacagtttttaccctgaattctttgagagtaagtttcagaatggtgtttcttttcttttctttttttgagatggagactcactcttttgcccaggctggagtgcagtggcatgatttcagctcactgcaacctccacctcccaggttcaagcgattctcctgcctcagcttcctgagtagctgggactgcaggcacccaccactacgcctggctaatttttgtatttttagcagagatggggtttctgcatgttggccaggctggtcacgaactcctgacctcaagtgatccacctgcctcggcctcccaaagtgctaggattacaggcatgagccactgcgtccaggcaagaacagtgttttttattttttatattttgagacagagtttcactcttattgtccaggctggagtgcaatggcgcgatctcagctcaccgtaacctctgtctcccaggttcaagcctcccaagtagctgggattacaggcatgtgccactacgcctacgcccggctaattttgtatttttagtagagatggggtttctccatgttggtcaggctggtctcgaactcccgacctcaggtgatccgcccgctttggcctcccaaagtgctgggattacaggcataagccaccacgtccggcctaagaatggtgttttttaaactccttactagagtatttcctataaataaggacatcttagcttactgtaaatcatcaaattaaggaaatgaacatttatacaatgctattattatctaatgtactaatgtactgataaggaaattaacattgatacaatgctattattatttaatctactaataaggaaattaacattgatacaatgctattatttcatcagataataatttactcatcagtacctattcagatgtcaccaattgtcctaataccttgtaattcagacgctcattatgcattgcattcagttgctatatctctttagtctttcaatctgatattttccaagcgtacaggtcagctatttttgaagaatttccctcaaattgagttttgcatttgctgatgattacattcaagttatgcattttcacaagagtatcacagaagtgagtttgtgatctctgcagcatcgtatctggagacacatgtcaatttgtgaccttaacagatcacttggttaaggtgtatctgccaggtttctccagtactaacttagtctttcattttgtaattaagcaatcttttgagaatttttttttttaatgagacatggtctcactctcaccctggcgggaatgcagtagctcaatcacagctcacggcagtctcaaacttttgggctcacacgatcctctcgattcagcctccaaaattgctgggattacaggtgcatgtaagtatgcccagataatatttaaacttttttttttttttgagacggagtcttgctctgtcgcccaggctggagtgcagtggcgcaatctcggctcacggcaacctctgcctcccgggttcatgccattctcctgcctcagcctcccgagcagctggggctacaggcgcccaccacgacgcccagctaattttttgtatttttagtagagacggggtttcactgtgttagccaggatggtctcaatctcctgacctcgtgatccacccgcctcggcctcccaaagtcctgggattacaggcatgagccaccgcgcctggccttttttttttttttttttttttttttttttttttttttgagacggagtcttgctctatcgcccaggctggagtgcagtggcgcgatctcactgcaagctccgcttcccgggttcacactattctcctgcctcagcctcccgagtagctgggactataggcgcctgccaccacgcctggctaatttttttttgtatttttagtagagacggggtttcaccatgttaaccagtatggtctcgatctcctgacctcgtgatccacccacctcggcctcccaaagtgctaggattacaggcgttagccaccgcgcctggccaatttttaaacttttttacagacatggagtcttgttacattgccctggctggtcttgaactcccagcctcaagcgatccttctgcctcagcctcccaaaatgctggggatacagggacaccctaccaagcacagcctgagaagatacattaagactatgtcaatatactgttaattctctttggtttttagcatccattgaggatctttgttttttttgtttgtttgtttgtttgttttgagagggagtctcactcttgttgcctaggctggagtgcaatggcatgatctcggctcaccacaacctccacctcccgggttcaagcgattctcctgcttcagcctcctgagtagctgggacttataggcatgcgccaccacgtctggctaattttgtatttttagtagaggcggggtttcaccatgttggtcagactggtctggaactcccagcctcaggtgatccacccgcctcgacctcccaatgtgctgggattacaggcgtgagccaccgcgcctggccaatggactctatttttaacccaaacattttatcttgtaccatgttacctttacgtcatcttgaatttctttctttctctttttttttttttaaagagacagtgtcttgctctgttgtccatgctggtgtgcagtagtacaattatggctcattgtagcctgaacctcctgggctcaagtgatcctcctgaggcattgggattacaggcgttagtcaccatacctggctttgaattttgggggtggggagggcatagcaatggtacctcttgagtttttaagagtaaaggaggaaaccttttaagtaatagtaaaaaatgcttatggcttcttgtgtcactccactcatgaaatctagtttataccttcacttaaactagatcaatatctgattgcacagtgtagttaaaatggctaagtttggtttaagaaagttggagtcaggttactgtatggtaaaatgtggctgtagtaactggcatattttttaaaaaaaataggtattagggaatgaggctaactaggcatagaattccacgggaatgtgacatagacttcattccttctttatcttgcccttcctgctcttatcttccacagagctttatcttaccaggaccttaatacaaacaaaagaagcccaatgctgaaagtcaatggagataaagtaaaatagaagataaccaattaatcagtgacaacctactcctccaatctgggaccacctagctgtgaacaaaagaaaaaagatttgtttatgtaccagataggaaacaaatagcagaaaatgcccttcaggtcatgtacaaacacaaaaattacctctgagtgaaattttagcttattataatagcataagtatagtacaatcctatgtacaactgataatccaagggcaacatgtcaaagtgtagtcaaaattaatttgttatgaaagaaaatgcagattaatcagtatgatttaaaaggaaatctgggcctggcctggtagcaaatggtgtcatctcagcactttgggaggttgagctgggaggatcacctgagcccaggatttcaaggctgcagtgagttatgatcttgccacgtcactccagcttgggtgacagaattagaccctgtctcttaaaaagcaaataaataattaagtaaaaagaaattcaatgaattcatttaatagtagttttaaattttcgaaaggaattaaaggtacaaaggaaaagtaaacattctcctgtatacttgttcctcccttctttcaatcttagtctcatatatcagaggtgcagtcttgatagttttgtgggtatctttctaggtatagtctatatacatacaagtatctctatagttacatatgtgtagtatagacacatgtgtccaccccttccgttattctctttttttgagccagagtctctatcacccaggctggtgtgcagtggtagaagctcatcagctcactgtaacctccgcctcccgggctcaagcgatcctcccacctcagtctcctaagtagctgggaacacacatgctcaccaccacacctggctttttaaaatattttttgtagagacagaggggtctcacttttttgccctgagctcaagtaatctagccccctcagcctcccaaagtgctggggttacgggtgtgagccaactgcacccaaccacgcccattcattttgaatggcagaattatttttaaagtttatttttattgtaaattgacaaacaatagttgcatatattcatggggtacaaaacaacattgcatttttatgaatacaacgtggaaaattaatctaattaacatatttatcaccttaaataacttatggtgaggatatttgaaatgtactcagcaaatttgcagtgcacagtacactaatagctatatttaacatgctgtgcaggtgtcattagtttttgaagtgcattttacatattgtgaaatactcagatcacaaatatattattcagcgagttttgatgactgatttccccagtctcattgagatatgatttgtataccatacagttcactcatttaaagtgtacaattcaggctgggcatggtggttcattcctgtaatcccagcactttgggaggccgagctgggcagatcacttgagtttaggagttcaagaccagcctggccaatatggtgaaacccccgtctctactaaaaatacaaaaattagccaggcgtggtggcaggggcctgtaaccccagatacctgggaggctgaggcagagagaattgcttgaacacaggaggcggagattgcagtgagccaggcactccagcttgagcgacagagcgagactttgtctcaaaaataaataaataaaataaagtgtacaattcagtggcttttagtacattcaccaatgtgcatctatcatgacaatcaattttagaacattttcattacctaagaagtaaccctgttctccttagctgtcattccccaatccttccatttaccccagcccttggcaaccactagtgtacttcctgtctctggatttgcctattccagacatttcaaacaatggcatcatatagtacgtgatacttagtgactgactttcactttgcataatcttttccaagtttatctgttgtagcatatatcactacttttcttgagtaatgtttcaatgtatgtattatgtatatagctcattttctttctatatcctccagttgttggccatttgtacaccacccccacccccaaacacacacactttttaactactatgaagaatcctgctatagtcattcatgtggaactttttgtgtggacatgttttcactcttcttgggtacataccaagaagtggaactactggttcctatgttaactctatgcttgactttaagagccactgccagacctttccaaagcagcttcatccttttatgttcccactaccagtggatgaaaggttcagtttctctacatcctggtcaacacttattaatgtccatcttaaaaattttagcctcctagtgggtggcaaactggtatcttgaatagctaatggtatttaacatcttttcatgtgcctcttggccatttgtatgttttctttggagaactatctattcatatttaaattgcgccatttgactgtttattattgaattataatagtactttatgtcctacacacaagtcctttatcaaatgtatggtttgcagttattttattctgttagttatggtctcataattttggttgtgttcagtttatctttttctttgggtaattatggttttggtgttaaaaacagttggccaggcatggtggctcatgcttgtaatcccagcaatttgggaagccaaggtgggaggattgcttgagcctaggtgtttcttgttgttgttgttgttgttgttttgagacggagtttcactcttgttgcccaggctggagttcagtggcgtgatctcggctcaaagcaacctacacctcttgggttcaagtggttctcctgcctcagcctcctgagctcaggagtttgagactagcctgggcaacgtggtgaaaccccgtatttactaaaaatacaaaaattaactgagcttggtggcttgcacctgtagttccagctactcaagaggctgaggcaggagaatctcttgaatccgggaggcggttacagtgagctgagatcgcaccattgcactccagcctgggtgacagagtgagactccatctcaaaaaaaataaataaataaaattttaaaatctggctgattaaataccagtttcccctgagtagacgatttggggtgtttcttctggttttccttctctacatctgttgcattttcaatttttttctgtagtgagactttaataaaatcaaagaaatttcaaattataatgaaaaacacaaaggctaaccttaggattaaagaactgagtgatcaacgtcatgtacattatgaaatccattccctatatctaaaagttctgtttaaacctgagccttgagggagaaaaagggtcttgggaacaggagtatgggctctaaactgagatagttatatgtttgtcttttttttatttggatatcatttgatatttataaaatgattacaaaagtagtacaaagaattctcttatactctttatccaacatccccaaatgttatcttacatagccttagtatcagtcaaaactaagatgttaacaataacacagtgctattaactatgttaaagatgtaactcaaatttggccaatattcccacgaatgtccttttttgggtgcaggattccatataggatacctatgcccttccttccttccttccttccttccttccttccttccttccttccttccttccttccctccttcctcccttccctccctccctccctccttccctctctccctcttccctctttggacaaggccttgctctgtcgcccagtctggatggagtgcagtggcatgatctcgggtcactgcagtctctacctcccaggttctaacaattctcctgcctcagcctccagagtagctgggattgcaggtgtctgacaccagacccagctaatttttgtattttttttagtagagacggtttcaccatgttcgccaggctggtctggaactcctaatctcaggtgatctgcctgcctcggcctcccaaagtgctgggattacaggcatgagccaccacacccggcccctcattgcatttagttgtcatttctccttgatctccaacacagttccacacagttcctcagtgttgaacagttccacagtcctctttcaacatagtttctcagtgtttgcctttcatgacattggcagttttaaagaatcttggtctgttattttgtagaatgtccctgaaattggtttttaagaaaatttttgtagagacagtgtctcgccgtgttgtccagattgatctcaaactctttccctcaaaggaccctcccgccttagcctcccagggtgctaggattacaggcgtgagctactgctcttggctactcaaattgggcttgtttggtacttcctcataattaaatttaggatatgcatttttggcaataatccacaggagtcaggtgccctgctgtgtatcatgtcagaaaatcacattatctgggttaactttgatctcttggcttaagggttttacagagatccttggccaggtttcacctctgtaaaattactgtttccctttgtaattaacaaatattaatatattgtggggagatacttggagactatgcaagtcctttaatcgtatttagcatctactttgcctccaatacatattaatgtggtgtttgccaaatggtcattttctgtttctaccattccttctacatctattaatggaaattctactgtaaaaaaagtgttgtcctttttctcccatttctttgttcatcaattatttgttatattaatataaacttacagctatttattttattctatgggctataaactattactgacaaatatatgaaaggttaaaataggactgttggatagaagggaggaggaaacagcctactacatactgtttcgaggtagttagtttcctgttgctttggatacttggcaaaggttgaggaatcacttaatagagttaacagagtccacccctggcatcagtagatggactcgatgcccttgaaggtctcttctacctttgagatcctctcaacggcttaagcagaaaacacagatggccacttcataacttacttaactactaagcttgcatagtcagggttagcctctggtgtatctgtcacataattagtaaaatccagcaacaccaccaggcaacgggtaaagtgtgtagaaattcagtgtacatcgaaacagaccatccctgatgattccaccacactcatttagctgaggtctcacttgcaagactcaatatactgatgcctaagtagctcaaagcgacttttccttggcatgtacaaagaagattatttcattttctggtgttgttttctagtaacagctacactgctgtgtgatgtgttgtctgctgccaccccaaatccttttccagcactttttcctttgaatttcagccttggattattctcccccagacatttccatatttttcagctgacttgtgtacatgtttcctgcctcccccatttgtgaaatattttcatgaagcaatataatagttttaacacacatattttcttttttctttctttctttcttttcttttttttttgaaatggagtctcgatctgttgcccaggctggagtgcagtgtcgcaatctcggcccactgaaacttccccatcccgggttcaagcaattctcctgcctcagcctcccaagtagctgggattacaggcgcgtgccaccatgcctggctaattcttgtgtgtgtgttttttgtttgtttgtttctttctttttttagacggagtcttgctcttgttgcccaggctggagtgcaatggcgctatcttggctcaccgcaacctccgccttccgggttcaagcaattctcctgcctcagccttccgagtagctgggattacaggcatgcgccaccacacccagctaagtttatatttttagtagaggcagggtttctccatgttggtcaggctggtctggaactcccgacctcaggtgatctgcccacctcagcctcccaaagtgctgggattacaggcgtgagccaccgtgcctggccttattttctttttctctttctttctttctttctttctttctttctttctttctttctttctttctttctttctctctctctctctctctctctctctctctctctctctttctttcttttccttccttctttctttccttctttctttctttcttttttttgagacggagtcttgctctgtcgcccaggctggagtgcagtggcgcaatctcagctcactgcaagctccgccttccgggttcacgccattctcctgactcagcctcccgagtagctgggactacaggagtccgccatcacgcccagctaatttttttttgtatttttagtagagatggggtttcaccgtgttagccagggtggtctcgatctcctgacctcgtgatctgcccgcctcggcctcccaaagtgctgggattacaggcgtgagccagtgcgcccggcttctttttcttactgtatgttctcttacaacatcagttaaattttcttcccttttagtagcctgtagttattggtctcatttattattggcccaacacttggattttactcattttcacttaattgttaaatttagaaggtcttaggttttatttgaatttctactagccaagtttgcccgctcctggcaagggtcctttgttgactgtatttgatccagtatctagtccctatgattgcactgtctcaagccgatttgtttgaatcagttttgcaaagaaaatgccaagaagccttgtagaaattgctttattattaatattcagatgtagaatgcctgccaaggcttcatcacacaggagccttggggtctcaaaagtcccattagtttttgctgctgtcatctcatttgttagcaggcatcaaagtcgcttaaaagcgggtcacaaaaggctacttggcaacgttccacagaggtgtagattaaagatattttagggtcaggatgtaactttaacagaaaaccttcagtgttcacatatcaggaaatcacatggttttctggtgttatttttacctattttcataaaaagccttacactcagctgtgttggtctttgcaaccttccttaattgtatgattttaagattcattgttgtttttagttgtgtaacaccaatctttttggacctctggaattcatactattgaagtaatgcagtcccagatttgaatttatctgtttataactgttaggaaatacttagagtgagccaagtgtaatggctcacacctgtaatctcagcactttgggaggctgaggcaggtggatcgcttgagcccaggagtttgagaccagcctgggaaacatgaagagacccagtgtctataaaatacaaaaaagcctggcatggtatctacatgcctgcagtcccatctactcagaaggctgaggggggagaatcacttcagcccacaagttccagagtgaggtgaaccgagatggtgccactgcactccagcctgggcaacagagtaagaacgagaccctatctcaaaaaaaagaaaaaaaaaaagaaaagaaaaagaaaagaaaatacttaaagggggagggaaaatacggtgtccttttctgtatggttgtactgacttctaatgtcttttaaaaatgttttcttttttactttgtctctctctttttctctttactcgtttttttattttttgttttgttttgttttgttttgtttggacacaaggtctcattctgtttcccaggctggagtaaggtggcatgagcagctgggacctagatactatttatttgcttgcttgtttgtttgtttatgtagatacagagcctctctatgtttcccaggctggtctcgaactcctggcctcaagggatcctcctgcctcagcctccgaaagtgctggggtaacaggtgtgagcaactgcacctggcctagacatttattattgtctttttctttattttaaatttattttattactttattattattattttgtttttgagacagtctcactctgtcaccaggctggggtgcagtggcatgatctcagctcactgcaacctctgcctcctgggttcaagcagttctcctgcctcagcctctcgagtagctgggattataggtatgcgccaccacacccagcaatttttttatatttttggtagagacggggcttcaccatgttagtcaggctggtctcgaactcctgacctcaagtgatctgccctcagactcccaaagtgctgggattacagatgcaagctactatgactggccccttgttattttattatttatttatttattttgagatattctcattctatcgccgaggtttaaactttaggttgtgaaatattcatgcaagtctgtctttaagacatttgtacagttaagaattattagaaaaagaacacttggatgggcgtattggctcatgcctgtaatcccaacactttgggaggccgaggcggtggatcacctgaggtaagaagttcgagaccagcctggccaacattgtgaaaccccgtctgtattaaaaatacaagaattaggctgggcgcagtggctcatgcctgtaatcccagcactttgggaggccaaggcgggcggatcacctgaggtcaggagttcaagaccagcctggccaacacggtaaaaccccgtctctactaataaaatacaaaaatgagccaggtgtggtggtccgtgcctgtaatcctagctactcaggaggctgagacaggagaatcacttgaatccgggaggcagaggttgcagtgagccaagctcacgccaccgtactccagcctgggtgacagcaagattctgtctccgaaaaaaaaaataaataaataaaataaaaatacaaaaattaggcggatatggtgctggacgcctgtaatcccagctactcgggaggctgagttaggagaatcgcttgaacccgtgaggcagaggctgcagtgagccgagatcgtgctactgcactccggtctgggtgacagagcgagactctgtctcaaaaaaaagtaaaaagaaaactcaatcaccatgcagttaagaaataaagtggccgggcgcggtggctcacgctgtaatcctagcactctgggaggccgagacggcaaatcacccgaggtcaggagttcaagaccagcctggccatcatggtgaaaccccgtctctaccaaaaaaataaaaaaatacaaaaattagccaggcgtgatggcaggtgcctgtaatcccagcgacttgggaggctgagatgggacaatctcttgaacctgagaggcggaggttgcagtgagctgagatcgcaccactgcactccagccggggcggctgagcgagactatgtctaaaaaaaaaagaagaaagaaagcactgccgtgcccggcccccaaatatttattattattattactattattatttttgggggggacagagtcttactctgttgctcaggctggagtgcagtggcgtgatctcggctcacttggctgggattataggcacccaccaacacgcccagctaattttttgtatttttagtagagatgggtttcgccatgttggccaggctggtctccaactcctgatgttaggtgatccgcccgccttggcctcccaaagtgttggggttacaggcatgagccactgcccccggccgaaatgacagttttttaacaaaacaaattgagagaagaatgcaataaaggccactaaatctgttttctcaagaaaacaagtctttttctctgagtgaatgactagaaggtgtcgtcgttaagtttaaatctcttaataagagttttctacatgattatgccagtattacaattcctttacattatcaaagttcatccttagatttctccagttgtttcccaaataaaacaattttgagcctgggggacaagcaccaagatctgtccttgaagtccaggaagggatagcattgcaatcaaatcagtaagtacaatcaatggatttgatagagagctgtgtagggatagtaaagggaggggtgcttagttttatctaactgaagctggtgaagaaatgtgtagtttactgtcacctttgtccagttcttagagatgaatgggtgattttggggctgctggaccggggaaggatcgaataacaagggcattctaggacttgaagcaaggctgcttgaaatagcatttggcaaggctccagacctaaggaaatcatgcagaggctgtggttttctaaaacccctcctaggtgatgttgatgtttagcaggtgcagaatgcagcctgaaggaatgagagtttcatattagaaggagccccttaaaactgcagtctaatgtttgaaatttgggtagggcagctaagaaactgactttgtgatttcatttcaatcaatttaaatttgaaaactgaagcaacagaaaacatttttctctaaaatagaaattcatcgttttggtatccctgcattttattttagtcactaaaaatttagcatgtatgccgggcgcggtggctcatgcctggaatctcagcacttgggaagcctgaggtgggggggtcacctgaggtcaggagtttgagatcagcctgaaccacatggtgaaaccctgtctctactaaaaatgtgaaaattatctgggtgtggtggcgagtgcctgtaaccccagctacttgggaggctgagagaggagaatcgcttgaacttgagagacagaggttgcagtgagccgagattgtgccactgcactccagcctgggcgacagagaaagatctcgtctcaaaaaataataataataattaaataaaaatgtagcatcaaattgagatgtattaattgtaacttttactttaaaatatatctatgaaatataatcagatatttagcttgtaagtatttttgaaatgttgagatatttttaatattgccttaaataaaagtatattattatttttaattttttttttttgagacaaagtctccctctgtcaccagcttggagtgcagtggcatgatctcggctcactgcaacttctgcctcccgggttcaagtgattcttctgcctcggcctcccctcccagtagttgggactacaggtgcctgccaccacacccggccaattttttgtattttagtagagacggagtttcaccatgttggccaggatggtctcgatctcctgatcttgtgatccacccaatttggcctcccaaagtgctgggattacaggcgtgagccactgcacccagccaaaagtatattattaatattaatttcatctggttctgttggtcagtgcttacctaaaacaatatgaacgattggaagtgctacatacttaaagtcaccctcaattctgagactaatcctgtaagggtgtgagttgatagaagattaggttctgaaaatatttgtcagaacaaccactagagtgtaatctccataaatctggtatctttttttattttcttaaccatttctagagcatgttttaggtactctatatttgttgagtgaagacagtgaggcagaaggagtatgagtagaggacacgggctggatggaagaggtgctaagtagatcgactctgctgaacttggtggctgaatttgggtcttgaacataggggtattttgagaggagccttgggttattattaagtgggtactgggattaaagcaggtatggggaagaggttactcataacttttagacatggttgagttttgttgttgttgttgttttgacacggagtgtcgctctgttgcccaggctggagggcagtggtgctattttggctcactgcaacctctgcctcccatgttcaagatattctcctgcctcagcctcctcctgagtagctaggattttaggcacctgccaccacgcccagctcatttttgtattattagtagagatggggtttcaccatgttggccaggttggtctcaaactgctgacgtcaggtggtctgtttgcctcggcctcccaaagcgctgggattacaggcatcagccactgtgcctggcctagacgtggttgacttttgtctggtgaagatatccagttggtggttgactgagtttggaattcaggagaaagatcttgtcttgataggggagttatcagcaaataagtgtaggttgatgccaagtatgtggacaagtggagagattggacagagggcataggggaacaccatcatttataggtggacgtgggagccagcaaaggtaagtgaaataaagagtggagaattgaagtgacgacgatcctaaagaagtgagtaatactatcaaaatatattctagtcaggtgcgggggcactcagccttttatcccaatactttgggaggctgaggcaggaggatccctagagcccaggagtttgagaccagcgtgggcaacataatgagaccttgtctctacaaaaaattttaaaattagccaggcatgatggtgtgtgcctgtattcccagctacttgggaggctgaggcaggaggagactcgaacccaggaattcaaaggtgcagtgagttgtgattctgccactgaattccagcctaggcaatagtgccaaactttgtcacaaaaaacaaaacaaaacaaaagaaatatattaaaaacaaagatgattctggcattccattgaatttggcagtggggactacgttggtgaatagtttcaacatagtggtgggaacaaaaacctaattgtagtagatcgaagagtgcatgttagacagacagtgattgcagacaattatttggaggactttggttgtaaaatggtgcaatgtggtagggtattagctaactatccccagaagattttgttttctttcttcttttttttttttttttttttttgtatttttagtagagctgggttttgccatgttagacaggatgatctccatctccttatccgcccacttcagcctcccaaaagtgctgggattacaggcgtgagccaccacccaggttttgttttcttaagataggaaagacctgcttgttattgcctgtggggaaagagccagcaggggacgatttacagatctccaaactttggctccagaaagctgatttttctcttaggaatgtgtaaacacgtctgtgcatattaccaccagctaagtgcttgatggtaaataaatactcggtattcttgcagcttatgttcttagaaagctgagacgtaaatagacattacttttttctttaaggggtaacatttgaggaactgactagagacccaagaccacaggggcaatagtgaaagaactaaaagcctaaacgttgattggtggcttgtcggatcatgaattaactagttatctgatggccttctgcttggagttaggcaaggtccctgaaagctatctttgatcatgagggagcattccacgaaagatgacttgatattggctaaaccctagtagaaaacaggatctggccgggcgtggtggctcatgcctgtaatcgcagcactttggaaggcctaggcgggtggatcacgatgtcagatcgagaccatcgtggctaacatggtgaaaccctgtctctactaaaaatacaaaaaaattagcggggcgtggtggcgggcgcctgtagtcctagctactcaggaggctgaggcaggagaatggcgtgaacccgggaggcggagcttgcagtgagccgagatcccgccactgcactccagcctgggtgacagagccagattccctttcaaaaaaaaaagaaagggtgcagggcgggtggagtcgcggagtagtcctcatggcctccacgccggagcccggtgagcccgaggagaggaagtcccttaagctcctaggatttttagatgttgaaaatactccctgcgcccggcattcaatattgtatggttcattaggatctgttgtggctggctttggacattttttgttcactagtagaattagaagatcatgtgatgttggagtaggggggtttatcttggtgactttgggatgctggtttcactgtaggtataattatgcaaggcaaagaatccaggaaagaattgccagagaagaaattaaaaagaagatattatatgaaggtacccacctcgatcctgaaagaaaacacaacggcggcagcagcaattgaacaatcttgagcatagaaaagaagtcaatgtaaacgaagttaagatcaaccacataaaacatttcatgtgcaataagctctcaatcaagtaaataaagtttaagttgtaaaaaaaaaaaaaaaaagaaagaaaacaaaattgtcttaagaaaaccagatttgtcataggaagaatctcctgaactcttaaggagcatttaaatggtatttgaattttaaaaaaaaaaggacagatcacctgaggtcaggagttcgagagcagcttgtctaacgtggtgaaaccccgtctctactaaaaatacaaaaattagctgggcgtggtggtgggcgcctgtaatcccagctactagtgaggctgaggcaggacaatcacttgaacccaggaggtggaggttgcggtgagccaagattgccccacagcattccaccctgggtgacagagtgagacctcatctcaaaaaaaacaaaaacaaaaaaacaaagtgttgttgaagtctgccttctatattgagcctttacagtatgagtgaacataaaccttatttgtaaaactagtgtgatttaatcttgtctgattaatctatatttgtatggtcttttaatttgtttttttaaaaattaatatggaaatttatactgggttttttttttattgtcttgttttgttttttgagagacagtcttcctctgtcacccaggctggagtacagtggtgtgaccacggttcactgcaaactctgcctcccagactccagtgatcccttccactttagcctcctgagtagctgggacggcaggcatgcatcaccatgcctggctaatttttgtattaggttagtgcaaaagtaactgcggtttttgccattacttgtaatattttttgtagagatagggtttcaccatattgaaggtgaaaccccacgctggtcctgacctcaagtgatctgctcaccttggccttccaaagtgctgggattgcaggcatgagccacggtgcccagccctggggtattttttaatgctaataagttttcactggctcttagtctcccagttatatgaaagtataaaatatgatgaaaaaggtaaaaatatagaacatatcaggattatagagaaatgaggagggtttgtagtccaaggaatatttggagggaaaatggaccatgacctttgaccacatcctcaaggaatggattatttttgtgagaaacagtctcactctcagctcactgcagctttgaccagctgggctcaagcgattctcctgcctcagcctcttgagcagctaggacttcaggcacgcaccactacacctggctgatttttaaattttttgtagatacggggtttcaccatgttgcctagactgttcttgatctcctggactcaagcaatcctcttgtctaggcctcccaaggtgctggctggcattacaggcatgagccaccgcaactagctaaggattggattctaaattgagttctaaatttacccattttccctagcagcttgctctgaactcagtgtgtactgtaaatattgattttggacataagatggtaatattttgaagagcaatgctatactcctacaactcacagttaacatcctttgacacacaaatgaataaaacaggccagtggatttggaaatttgataatctgtacaatctaagaaagtaaactaccaaaagaagtaacttaaattcattgtaactttaattcagtgcatcttagttagcattagtatccagtggaattcattgtgaatgttaacacttactatttgctactgaattgttaattttaaaacagtgcctgggggttagacactaggaccttgttgttagacctctggtttgaggcctggttcttgatactgatctgaataagaaatgttcagtgagtggaaatactaatattacttagtgggagatgcaaatgagagaattcctatgaagtactgttcataatgatacctggcaagtagtaaattctcagtacataataataggtattcataaatgttcttttttgtttgtttgtttgttttgagatgtagtctcactctgtcgcccagtctggagtgcggtgctgtgatagctcactgcatcctccgcctcccaggttcaagcaattctcctgcctcagcctcctgtgtagctgagattacaggtgtgtgccaccatgcctggctaatttttgtatttttagtagagacttggttgtatattttgtatattttagtagagactgggtttcaccatgttggccaggctggtctcaaacacctgacctcgtgatccgcccacctcagcctcccaaagtgctgggattacaggcatgagccaccatgcctggcgcaatatatatatataatatatatattttttccaatattcttttattaattgtgagtttgagactggaattactaggtttttctcaaatgttggaggacaagtagaaaaggaaaggtttttctcaaatgttggaggacaagtagaaaaatgcctatctaataggcatttttcctttaaataagtcagttcatttcaacatatactaaagtccagcaatttggctgggtctggtgtctcacacctgtaatcccagcactttgggaagctaaagtgagaggactgcttaagcccaggagtttgagaccagcctgggcaacatagcaagaccctgtctcttaacagaaacaacaacctacagtttataggaatacattgattcatttaatcctcacaatgaacttctttaatacatgttattactagctctgctccaaagtttgttgtttgattcctgccaaacccatgttcttaaaaatatataaaatagctaagatactgaaaagaataatacactaatcaccagagttggttattaaccttaagcatgggtgggggattgttcatggtaagtgtgaagaatgagaaggtagtaggttttgctttagagtcctctagggcctgggcaaggtggcatatgcctgtaatcccagccttttgggaggctgaggcaggcggatcacgtgagctcagaagtttacagaccagcctaggcaacaaaccgagactcagtctctaccaaaaacaaaacaacgaagtgaaaataaagtagagtcctctaggagtaggctcatcaaggggccaagaggtgtgagagtgaagcttcaaggaagatctacattttagagagttttaagtgaaaattctccttggaggtctacaaaccagaccattaaggggtcatggcaagttaagtctgtggtatttaagaaatgattgaatctgactgataattcaattataatttggtagaagtttaagatatttgaataaggagggaaattggtagaatgacagtttgaggcagattgggtggtcttagaaggtttttcctcctttgggaataaattatactggctcatagccccaaagaaaaaggaagatagccaggaatacttgtgaacagagagcattaactcttaggtcagtcatgatttgctacacatttggagccaatcttcaatttgcacgttaaaaaaaattaaatagaggtttttgatccctccctcaattaacaacctgctcaacttcccctctgcccttcactccagccctgatttgaaaggatttcttgtgagttctaagaagccctggacagatgagggtggagttctcgtttggggtaggaatgagaaaattagaatatcaaagtaatcccagcactttgggaggccaaggcaggaggatatctttagcccaggaatttgacactactagcctgggcaacagagtgagaccttgtctctacaaaagcaaaagtagctgagcttcaggggatcccttgagcctgagagatcgagactgtagtgagctgtgatcctcttactgcactacagcctcggtgataaagtgaaaaggaaagaagcctggctctagtgaagagattctggaaacttctgaagcctctgctgtggctcccatccagcctagatatggaagagccatgaggccctacatcaccaaggtaaggagagtggagtctagggtcacacagtttctcagatccacttttggggcagcactttctttgaccctgactttctgtggacttcgaatctctcagctgatggctgtagtcagtagggaaacggatcagaggcaaagctccaagaatattaggtattcgacacttggtttagcagctgacttttgttttctattattttactcgttgtgtgtgtgtgtgtgtgtgtgtgtgtgagtgtgtgtgacagagtcttgctctgtcacccaggctggagtgcagtggtgcaatttcggctcactgcaacctccgccttccgggttcaagtgattctcctgcctcagcctcccaagtagctgggattacaggcacgtgccaccatgttccgctaatttttgtgtttttagtagagatgggttttcactgtgttggtcaggctggtctcgaactcctgacctctggtgattcggcctcccaaagttctgggattataggcatgattcactgctcctggccagctttctttttatccctaaaaaaagaaaaataaattgatggctgaaattctgaactagtcaaattagttcatttcacttctttgggaaaataaggttgttggaaaaactttgggaaaaactgttgtacaggtcttctttgaagagatttttgttgcttttgccttaaatgttcattttagatttctccttaggtgaatctttggtgggtagccagttgtttcctattctttttttttttttttttttttaagagacagagcctcattctctcgccctcaggctggagtgctgtggtgccatcttggcttactgcaacctctgccttccaggttcaagagatctcgtggtcgggcacagtggctcacaccctgtaatcccagcattttgggaggccaacatggcaaaccccgtctctagtaaaaatacaaaaattagcccagtgtggtagggcacacctgtaattctagctactcaggaggctgaggcaggagaatcacttgaacctgggagatggttgcagtgagccaagatggcgccactacactccagcatgggtgacagagtgagactccgtctcaaaaaaaaaaaaaagattctagtacctcagcctccaaagtagctgggattacaggcatgtgccacctcgcctggctaatttttgtagttttcgtagagccagggttttgccatgttggccaggctggtcttgaactccttacctcaagtgacccactcactgcagcttccaaactgttgggattacaggcgtgagccaccatgaccagccaatcttttctttttatttaaatttggtttaattaaatggccagtggtactgggcactgtatggtggttggttgcagaacagggcctgacctctatacttcttagtagtgtcagtgggaggaagtgaatacagtatcttaaagtcaacattatgaaggcaccagtggttgtctctgagttttttccaaaaacactcagttttcaggctgacagcataggtcctgacagtgtcatttctgattagacaaatactttgtggtctgcccattgtagtgtttcacataatactttgttaataatttggtctttcctcaacaatttgatatatttactttatgcattctcaagagaaatgaaaattggatgttggtgagtggaggacaatctgagacattacaattgggtcacagtacccaaatggtatgtccgtggtattaaaatttcacggagagggttattagggaaaaaaatgtctaaaaaagcctggagggaatggttattggtgaagatgaaaaacagttgacaaaccctgagctacctctagtaaaggtcttacttgaccatgtcaatgaacagacttcgaaaggctttatttttctatatgatttgagtagctgtttctttatgggttgttgttgtttttggagtagctgtttcttgatacaggaaatactgcatgtatggagtttgtgtgtgtgtgtgtgtgtgtgtgtgtgtgtgtgtgtgtgtgtgtggtggaggggctatagtcagattctgttcaaatgactcagtcatttcagaataaaacaccacattgctcctttagactgggtataagattatcaagacaatgggaatctggaaaaatgagaaaatggagagggcgtaggaactactagacccagacttgatctaaggagttcaacattattcttgcttcagggtgggtaggatggtcccagagcaagttctcgtcttaggataatttttaaaagtgatatgaaatataactaataaaaaagttcaagggttcttaattaagctcattaattaatgtgaatgtcttatgaagattttcttttctttctttcttttttttttcttttaagacagagtttcactctgttgctcaggctagagtgtagtgaggtcaggagtgcgagaccagcctggccaacatggcaaaacccagtccctactaaaaatacaaaatttagttgggtgtggtcctgtgagcctgtaatcccagctactcaggtggctgaggcgggagaatcacttgaagctgggagacggaggttgcagtgagctgagatcttgccactgcactccagctcgggtgacagagcaagactccgtctcaaagattactattactattattattactactactactactactactattattattattattattattattttagacagggtctctcgcccaggctgcagtgcagtggttcacactgggctcactggaacctgtgcctcccaggttcacgtgatcctcccgcttcagcctcccaagtagatgggactataggcgtgcaccaccacgcttggctaatttttagtagagaccgagtttcactatgtcacccaggctggtttcaaacttcaagcatgctggagtcaagtctgcctgccacggccttccaaagtgctgggaatacaggcgtgagccaccatgccccgccctttctgtacataaatcttagaaggacctcaagatctttcctatagagaaatacatacactgaaattctcagtgttcttggatatgcacatctgtaaaattaaaagtaccaagtcaaaaaatgagactcctctttctgcaatcctattagtgttaaacactagtaactttttatttttttaagatggaggctcgccctgtcgcccaggctggagtggagtggtgctatctcggctcactgcaacctcctcctcccgagttcaagcgattttcatgctttagccatccgagtagctggaattacaggcatgtgtcacctcgccaggtaatttttgtctttttagtagaaccggggtttcaccatgttggtcaggctggtcttgaactcctgacctcaggtgatccgcctgcctcgacctcccaaagtgctgggattacaggcggaagctgacatgccctgtctgtcatttattttatagcggaagactttctctaccttaaatttttttttttttctgagagggagtctcactctgtcgcccaggctggagtgcagtggctcaatctcggctcactgcaacctctgcccgccaggttcaagtgattctcctgcctcagccttccgagttgctgggattataggcgcctgccaccgtgtccagctaatttttttatttttagtagagatggggtttcaccatcttggccaggctggtcttgatctcctgaactcgtgagccactgtgcttggcctaaatattctttttctttctttctttctttttttttttttttttttttttttgagatggagtcttgttctgtcgcccaggctggagtgcagtggcgctatctaggctcactgcaggctccgcttcccaggttcacgccattctcctgcctcagcctcccaagtagctgggactacaggcgcctgccaccacacccggctaatttttttgtattttagtagagatgggatttcaccatgttagccaggatggtctctatctcctgacctcgtgatctgcccgccttggcctcccaaagtgctgggattacaggtgtgagccaccacccagcctaaatattatttttcttacatctcttgtgtatgtatgtgacatgtaatatttatacaatatttatatgatttttatgtaatgatattatgtaaataaaaatatttatgtaatatttatatgatggtcgcattttagtgtccatagtcttattgcaatactactacactcattagtttgcatattatttttgaggctgcttactagatacaacaggagtaactgtgacaggttgtatggcacatgaagcctaaaatatttactatctgaccctttacagaaaagttcgccgaaccttggtgtaaacaatgtgtcttttggcaacatgataatctgtttaatcttagacatttttattcttttttttctttttgagttggagttttgctcttgttgcccaggctagagtgtaatggcacgatctcggctcactgcaacctctacctcctgggttcaagcgattctcctgcctgagaggcagggtgtcactttgttgctcaggctggagtgcagtgattccaccactgatcagttatagttttgaatttctatgtttgtgacctaggccagttcacatctccttaggcaacctagtctagtggtctcctattcccaggaggttaccatttatttatttatttatttatttatttaattttattttatttgtttatttttttttaagacagactctcaggctggagtgcagtggcacgatctcggctcactgcagtctccgcctcccgggttcaagcgattcccctacctcagcttctcgagtacctgggactacaggcgtacgccaccctgcccggctaattttttttttgtattttggtagagacagggtttcaccatattggtcaagatggtctcgatctcctgacctcgtgatccgctcacgtttgcctcccaaagtgctgggattacaggcatgagccaccgcacctggcctatttatttatttattgagacgatgtctcattcttttaacctggctggggaacagtggcataatagtatctcactgcagccttgaactccaagtctcaagggatcctctggcttcagcctccccagtaggtaggactacaggttcatgccactgcatgcggctctttgttttttcatttattcttttactaaatttacaaataaatattgtgtatatttatcatgtacaacatgaagttttcaaatgtgtatacactgtgtaattggagttatcattctttttacaattggtatcaatgggaacactccactgtctcgattcctgtggtatgtctgatgagctgtttcaaggttttacaaaattagtctgtagtcccagcttctctagagctgaggcaggagacttgcttcagtccagcacttcaaaatcaggcttggcaacatagagagaccctgtctctacaaaaaataggaaaaatataaattaaccagttgtggttacaggcgcctgtagacccagctactcagaagggtgagatggaaggataacttgaacctgggagttcgaggctacagtgagccgttatcgtgccactgcactccagcctggggaacagagtgagaccttgtctcaaaaaaaaaagaaaataaagtagataaataaggattagaggaggaaatagggagtgattgcttaaacagggcacagcatttctctttggggttttgaaaatgctctggaagtagagaatggctatgttgtacaacagtacaaataaactaaaaaccactgaattgtacacttttcttcttttttttttgagatggagtttcactcctattgcctaaggtggagtgtagcagcacaatcttggctcactgcaacctctgcctcccgggttcaagcgattctcctgcctcagcctcctgagtagctgggattacaggcaccctccaccacgcccagctaatttttgtatttttagtagatacggggttttgccctgttgggcaggctggtcttgaactcctgatctcaggtgatctgcttgtctaggcctcccaaagtgctaggattacaggtatgcgctactgtacccagctgtattgtacactttgcaactgtaaagtgatggatttcatgtcatgtaaattcatctcaataagaaaaattaggttgggtgcagcggctcgtgtctgtaaccccagtactttgggaggtcaaggtgagcagaccacttgaatccaggagttttgagaccagcctgggcaacatggtgatatcctgtctctacaacaaatacaaaaaaattagccaggcatggtggtatgtgcctgtggtcccagctactcgggaggctgagcttgggaggatcatctaagcctgggaggttgaagccacggtgaactgtgattgtaccactgcactccagcctgggtgacagagtgagaccctgtctcaaaaaaaaaaaaaaaaaaatgaaagaaagaaagaaattgaaactatagcagttactctaaagacccaaacactaaaaataacacaatgcccatgtccagcagaaaaaataacattgttatgtatttaatcagtgaacttactatacagtgagaatggactacaagtatacttaacagctcattttgtgaaaacttaacaagctatatacttatgatttgtacacctttctatgtgtatgttctacttgaaaacagtttgtatcaaaataataggtatggctgtgcacggtggctcacacctgtaatgccagcactttgggaggctgaggcgggcagatcaccagaggtcaggagtccaagaccagcctggccaacattgtgaaaccccatctctattaaaaatacaaaaattagctgagtgtggtggctgtaatcccagctacttgggaggctgaggaggaaaattgctcgaacccgggaggcagaggttgcagtgatctgagatcacacaactgcactccagcctgggcaacacagcaagaccccgtctgaaaaaaaataaattatttaaaacataaaataaaaaataaataaaatagatattgcctaatgaacactaccgatgtaaaagtagtttatttttttattttttattttttttgagacagagtctcactcagtcacccaggctggagtacagtggcatgatcttggcccactgcaacctctgcctcccgggttcaagcgattcttgtgcttctgcctcccaagtagctgggattacaggtgtgcaccaccacgtcctgctaatttttgtatttttagtagagacagggtttcaccatattggccatgctggtcttgaactcctgaccttgtgatccgcccaccttggcctcccaaagtgctaggattacaggcatgagccaccacccctggcctttgattttgtttcttggagaagaggtctcactttgtcacccaggctggagtatagtagcacagtcctggctcattggaacctccacctcctgtgctgaagcgatgctgtcaccatcagcctcccgggtagctggggccgcaggtgtgcatcaccacacctgactaattttttttgtatttttggtagagactgggtttcaccatcttgctcaggctggtcttgaattcctgggctcaagcgatcctcccatcttgtcctcccaaagtgctgcgattacaggtgtgagtcactatgcctagcctagttgtcttttctttttgtatattatgtccttttggtattttatgacttcgctgaatgtgtgaaaagcaaaaataatattttaggctgtatccacaggggctttacatttagttgttattaaattttaatcttctatggctgttattcagatatttaagtagatgacataagtaatttctgtattttacaggcagattttgacaacaaaccagtaaatggccccaagtcagaatccatggactacagtagatgtggtcatggggaagaacaaaaattggaattgaacccacatactgttgaaaatgtaactaaaaatgaagacagcatgacaggcatcgaggtggagaagtggacacaaaacaagaaatcacagttaactgatcacgtgaaaggagattttagtgctaatgtcccagaagctgaaaaatcgaaaaactctgaagttgacaagaaacgaaccaaatctccaaaattgtttgtacaaaccgtaagaaatggcattaaacatgtacactgtttaccagctgaaacaaatgtttcatttaaaaaattcaatattgaagaattcggcaagacattggaaaacaattcttataaattcctaaaagacactgcaaaccataaaaacgctatgagctctgttgctactgatatgagttgtgatcatctcaaggggagaagtaacgttttagtattccagcagcctggctttaactgcagttccattccacattcttcacactccatcataaatcatcatgctagtatacacaatgaaggtgatcaaccaaaaactcctgagaatataccaagtaaagaaccaaaagatggatctcccgttcaaccaagtctcttatcgttaatgaaagataggagattaacattggagcaagtggtagccatagaggccctgactcaactctcagaagccccatcagagaattcctccccatcaaagtcagagaaggatgaggaatcagagcagagaacagccagtttgcttaatagctgcaaagctatcctctacactgtaagaaaagacctccaagacccaaacttacagggagagccaccaaaacttaatcactgtccatctttggaaaaacaaagttcatgcaacacggtggttttcaatgggcaaactactaccctttccaactcacatatcaactcagctactaaccaagcatccacaaagtcacatgaatattcaaaagtcacaaattcattatctctttttataccaaaatcaaattcatccaagattgacaccaataaaagtattgctcaagggataattactcttgacaattgttccaatgatttgcatcagttgccaccaagaaataatgaagtggagtattgcaaccagttactggacagcagcaaaaaattggactcagatgatctatcatgtcaggatgcaacccatacccaaattgaggaagatgttgcaacacagttgacacaacttgcttcgataattaagatcaattatataaaaccagaggacaaaaaagttgaaagtacaccaacaagccttgtcacatgtaatgtacagcaaaaatacaatcaggagaagggcacaatacaacagaaaccaccttcaagtgtacacaataatcatggttcatcattaacaaaacaaaagaacccaacccagaaaaagacaaaatccaccccatcaagagatcggcggaaaaagaagcccacagttgtaagttatcaagaaaatgatcggcagaagtgggaaaagttgtcctatatgtatggcacaatatgcgacatttggatagcatcgaaatttcaaaattttgggcaattttgtccacatgattttcctactgtatttgggaaaatttcttcctcgaccaaaatatggaaaccactggctcaaacgaggtccattatgcaacccaaaacagtatttccaccactcactcagataaaattacagagatatcctgaatcagcagaggaaaaggtgaaggttgaaccattggattcactcagcttatttcatcttaaaacggaatccaacgggaaggcattcactgataaagcttataattctcaggtacagttaacggtgaatgccaatcagaaagcccatcctttgacccagccctcctctccacctaaccagtgtgctaacgtgatggcaggcgatgaccaaatacggtttcagcaggttgttaaggagcaactcatgcatcagagactgccaacattgcctggtatctctcatgaaacacccttaccggagtcagcactaactctcaggaatgtaaatgtagtgtgttcaggtggaattacagtggtttctaccaaaagtgaagaggaagtctgttcatccagttttggaacatcagaattttccacagtggacagtgcacagaaaaattttaatgattatgccatgaacttctttactaaccctacaaaaaacctagtgtctataactaaagattctgaactgcccacctgcagctgtcttggtgagtacttgtgtgcatgtgttcttatttcacctgcacaaattacctcaatcatgactgaagcaaattctgattcatcttttttgtgtgatattttttccccattcttattctaactaagatggattaagtaaatctataaccatttttctgtgggaacttttggttctgccacaagaatggaaaattcagctcataatttggaaaaacaaacttggaaaaggtaaacccgctcaagtggaaaaataggctgatatatctctcaatgttgaatgtctgtcaatttatcgtgcgtagcataagaatgaatttcgtaggccaggcgcaatggctcttgcctgtaatcccaacattttgggaggccgagtcagatggatcacttgaggtcaagagtttgatactagcctggccaacatggtgaaaccctgtatttacttaaaattcaaaaattagttgagcatggtggtgcacgcctgcaatcccagctactcggttggctgaggcaggagaatcacttgaacctgggaggtggaggttacagtgagccaagattgtgccactcccctccagcttgggcaacagagcaagaccctgtcttaaaaaaaaaagaaagaaagaaataacttaatagtttattacagtttgtttattcttcctatattcaaaaaaatttcaacttacaagcctttcattatatttttgtgtgtgtgagatagaagatacatatagagaatgtaaaacatatgtataagttaacagttaagaaatatatagctggcagttgccgtcctactctagaattgaagctggtttatgtctttttcagtgtctagtgcttttacgctctgtccagtacaagatctaatactgtctttttttgtccaaagagcacttgatattctggaataatatatttctatttctctgcaatacaaagtgtacttatgtataaagaaattccataatcttggccacttgaagaattcataagcctttctgaattttaacatattttaacaaatttgtttaatcctgatttcctatttcaaaaaatcaaagaataaccagtgtgctaacatgagtcatgtgctaatagctgactcatggactgatccctaaccaatgtatttctacatttttgtgccttaggagtcattgaaagagaacattctgaaccaattagttttattagtgtgttaaaagccctgagaaaatcttgctgggtaaagattctcaggcagaccttatgagaaatttcctcagtatttgaaacatgtgaaagcttaatttgaatcctgtactgattagttactgtctatggccaaatttcaggtaagcactcttctaagaaacctgttgactctaatatagctgtaaaaaaatagggaaattcaatagattgtgtcattaaagttcgttaggctgcttgaagccccattactttgtttaccatacaactatgttagaataaattttgtgaaaaatctgttttgaacctcatccaaataggtttagttattggaagtcttacttaaaatatggctccaaatcacaaagactcaagatttgccttgaccaaaggtgatgtttttattagaagcaggtggttccatagggaggctaagtatatcacactgattttttaacaacagtagaaaatatagtgttgtgtagtaataatattgaattcttgtctttccaaagtacacttgttgttctgaaataatatccttccatttctctgctcattgttcaatacacagtgttttttaggtttttgttttgtttgtggatatgaggtctcactttgttactcagactggtcttgaactcctgggctcaagtgatcctcgtgcctcagcttcctaaagtgctgggattacagacatgaaccaccacaccagctaacacacagttttgacaaactgcaatgtgccagttatcaaggataggctgttctgagaagaatctcacaatttggaaagagtgacaatgctgtctgagtggagttgaattgggagaaaaagtttcttgaattaaggagagaagaaagtaatcatcataatggcttccattctggagatcttactacaagtctgatattgtgcttgccttgacttgttattttcacagaagctcttcaaagagagggtttattatccccattatacaaatgcagaaactgaggcacagagaatttcatagctatccagtaactgaactgggactcagagacagcagtctcaactccagaacctatccttataacgaacactctggtgcttaataaaggtgaattataaaagagagaacacttttcggctgggtgcagtggctcacgcctgtaatcccagcactttgggaggccgaggcgggcagatcacgaggtcaggagatgagaccatcctggctaacacggtgaaaccccgtctctactaaaaaatacaaaaaattagccgggcatggtggcaggtgcctgtagtcccagctacttgggaggctgaggcaggagaatggcgtgaactgggaggcagagcttgtagtgagccgagatcacgccactgcactccagcctggatgacacagcgagactctgtctcaaaaaaaaaaaaaaaaaagggagagaacacttttctaaatatccttacaaatggaaataaggcctgtagttcaacaaacacgtgcctttaaagtttatatacctgagctagactactttttctatgtgcatggttctaaaaggatgattgtctagtttgaagaccctttccttatgcaaaataactagtcacagcatataggaatagacagccaggcattcaaagttgaataaatacctgcaggggactcagctgttttatctactgtcactaacatgtcattagtaaatcattacatgtaagtttattgtgctcattgtgtagaaaaaggcacttaaagacagagaaacaaaaagttacttacccagtcactttttatcaaatcatcccaagtagtaccatccatatctgagggtaaagaatttccatggtggaattatgttctagcaaaataatctctagattaggattcctcaaactgagcagtattggtgttttatccttcgtaattctttgttgtggggagctgtcctgtgcattgtgggatgtttagcagcatctctatcttccacccactagatgccagtagtaatgcacacacataactgccaaattgtcacgaccaaaaatgtctccaggtatttccatgagtccccttagcggcaacattcccctggttcagaatcagtgctgtagatcactaagaataagataaaatctatcaagtgtatcttacttaagaagccacagaagtaggctgggtgccgtgactcacacctgtaatcccagcactttgggagggggaggcgggtgggtcacctgaggtcaggagttcgagaccagcctggccaacatggtgaagctaaaagtacaaaattagccaggcatggtggtgcatgcctgtaatcccagctacttgggaggctgagacaggagaatcgcttgaacccaggaggcgaagattgcagtgagccaagatctcatcactgtgctccagcctgggcaacaagagtgaaacgccatctcaaaaaaataataataaaaaataaaggtgaaaaaggaagccacagaagtaattcccctagtatttgacatccagtgaaaatgactttttggtgtaggtataccatggctagaaattcatgaaacgcagaaattccccagtaattcttactacacatgagtctaaggggccaagttaaaaatagcattttttaagaaacataaaattcatgctcacaaaaattcaagtggtgcagaaatacgacgcaaacatcttcctatactcccattctatacaaaagaacattattgattttaattttgtttccatttttacaaaaatttaaaacaatctttctacttggttttttaatataatgatattgtggatgtctaaatgttttataaatattattgtttcaatagatttattgtataccactatataaacatcccataatttatttaaaccacatgttattgacagatgttgagtgttttgctctctttttgatattacaaataattgtaacaaggaacattcttttgtaattgtgcaaatgtatagtagaataaattgtctgcaatgaaattgctcaattttcccagcactttgggaggcacaaggtcaggagattgagaccatcctggctaacatggtgaaaccccgtctctactaaaaaatacaaaaaaaaaattagccgggcgtggtggcgggtgcctatagtcccagctacttgggaggctgaggcagaatggtgtgaacccgggaggcggagcttgcagtgagccgagatcgcgccactgcactccagcctgggcgacagagcaagactctgtctcaaaaaaaaaaggggattgctcaattttaataggattctaagggcaacctttaacatttattgttcttggataacttttagtattacacctcaattaatacagattttttttttaagcaggagataggagtataaatatgacccacatcttaaaatattttttttctcctctgattttcagaggaagaaagaattcgttaggggcaggaagaaaggaacattaaaagttaaatttcatgggctgttgtccttgcctttaattatcaaatcttaccaaaaccttgtcaagattcatggttctgaattgagggggaacaaaaagtataaaagtagcttctcctgtcccctatgcaattctgtaaagctttgggtctaataatcttattccttccacagatcgagttatacaaaaagacaaaggcccatattatacacaccttggggcaggaccaagtgttgctgctgtcagggaaatcatggagaataggtgaggaaatacgcttccctgttaaaatcattcttactgtggatctgactcaacggagataaatcatctctaagaacaaacgccgtgattgaaaaatgatcaggagtatgagttggatgtttcttagggcccaacaaaagaggggtgtcctcgtgtccctactgagccacccatcatacaagctgttgggcacataaaagcacccacaaagcaagactagttgtctttgataaactcagaagtactttttatatatcgcataatggtagaaataggtcaaattaccacccttgacactgcataccctacattcccattgcttgtctggcactcagcctattttttaaagagtgatctttgaggataagtgagtaggactggttaacaaattaaaatacctgccacacaaaagcaaatgtttaacaagagtaaattacgaagagtgtctaatttttgaacttctgtacatctatatcttatatacattaagatgttcaaagccaaagccttcaagtacagattgcaattaattagtacattcccttcactgtgttttatactcaggtatggtcaaaaaggaaacgcaataaggatagaaatagtagtgtacaccggtaaagaagggaaaagctctcatgggtgtccaattgctaagtgggtaagtatttcctatttatacatttttttgaagcttgttattccagagctgatatttatacatttacaatagccagagtgatctttattttatttattcatttatttatttaatttttgagacaggctttgtcgccccggctggattgcagtggtgcaatcacacctcactgcagccttgatctcccaggctcaagcaatctttccaccttagcctccaagtacttaagacttgccaccaaacccggctaatttttttttttttttttttttttttagtggagagctcaagtgatcctcccgcctcagtcccctaaagtgctgggattacaggcgtgagctactgtactgggccagattttttaatagatttttaagtaaattggccatttgtgatgaaagttgcaaatatattttctcagtttgttgtggttttaccagttagattttttttttgactgtaatcagctttttcatcttttatagctttagggtattttatcttaattagaaaaatctttaccacttgtaggttataaatctttcattttcttttgtagtattttaatgattttattttttctataatgaagtattttatatttatcctggtttagaatattggtagctatgtacacttctccagatggctactcagttatccaacaccactcatttaattgtacatctcttcattattgatgtgtatttgtttatatgtgagaattccctattgtgttaaatcactgtctttaatcagcatgagattgctctaattatttagattttataatgtttccatgtctgataggctaattccttttaatttttcaaaagtggtctgactattctggtttattttatcatattagtatataaacaccacgtttcattacaagaataaaatcctactggtaattttattggaatcatgttaacagaatttggagaatttacatatatttcatgttcagtcttcctattctacatattgcatctttacatttacatatgccttcttttgtcctttagaaccattttaaggtagaatttaagggagaatttacatgtttcttgtttttgtacatatttctcttgtgtatcctctaatacagttagtccaacagactaactctaattttatattgctttagtaacgatggtctccttactttgtttctctcttcccatggggatctttccagggttttcccattaagtgtgggttgtcggcccagcacggtggctcacgcctgtaatcctaacactttgggaggccgaggtgggcagatcaccagaggtcaggagttcaaaatcagcctggccaacatggtgaaaccccgtctctactaaaaatacataaattagctgggcatggtgatgggcacctgtagtcccagctacttgggaggctgaggcaggagaatcacttgaacccaggaggcagaggttgtagtgagccaagatcgggccactgcactccagcctgggcaacaagagcaaaaatgtctccaaaaaaaaaaaaaaaaaaagcatggattgtcagggaatgcctttcgggggagggaacatttaagctgagaaaggagtgacaaaaaacaaaaaagagctaagtaggcagaggataagcaggaagtagcattcctaagcagagaaaacagcaagaacaaaggtcttgggtttagaaataagagtccagtaaaaaaaatctaagcagagtcagttgaaattaaggggataggccaggcgcagtggctcacgcctgtaatcccagcactatgggaggccgagtggggcagatcaccagaggtcaggagatcgagcctatcctggctaacatggtgaaaccccgtctctactaaaaatagaaaaaattagccgggcgtggtggcgcgagcctatagtcccagctactcgggaggctgaggcaggagaattgcttgaacccccgaggtggaggttgcagtgggcctagatcgtgcctctgcactccagcctgggagacagagtgagactccgtctcaaaaaaaacaaaaatgaaaaacgaaattaaggagataattaatagaaccaggtgggggtaaaaaggtgaatgattttgtaggccatagtgaggagctgaggttttagcccatgagtaacatgaaggccttcatgtttgaataacaaacaggtattatctcctgcagtttttgtgggttaggaatccaagtggtgcttctgacataggctcctatgaggatgcaatcatctgaaaacttgactgggggagagtggtgcagctggaagacccacttccaagctcccttacaggaggccttagctctttgatggctgttggctggaggcctcagttcctcctcatcttaaatgttttcataacacagcagcttggtttcccccagagtgagtgaatcaaaagagagcaagaaggaaactacagtgtctttctttcatcacctcaagaggttgaggccaggagttcaaggtcacagtgtactatggtggctcctgtgaatccatagccagccactgcactccagcctgagcaacatagcaagaccccacatctcttttgtttgtttaaagaaagaaacaaagaaaataaactagattctcagaagccccagttataaatctcccaacctggctttgtggtaataattttcttgctttccacctttccctgctacttatatatttctcaaacagtatagttttattttgttttgttcttttgtgtctggcctatccatagtaccttgtatatttgaaataaatcacacaattggttcccaatatctggcgctgatagttgttaccaatttattgagctatatctgttagctatttctgaattgttcactcctttgtctattaagtggtaaggaatgaatatgtcctcatgttgtggcagctggcttctcctacagtgagtccaaaagagagaaatgtaactaggcttattggtgggattgggatgatttctttttcctctctttaaaaccttttctaatataataataatgacagtgatataaagaattgtagtgtatagtttttttgtttttgtttttgttttccttaagaaggcaaatataaatgctgtagcttaaagatttcggtaacaactttctattagtatttttccctagcgaaattttatttgttttggatatctgtctgtgttgcctgggctagagtgcactaacccaggggactccaacccctgagccatgggccaataggaacctgacttcatggcagaaggtgagtggcaggagagcaagtgaagcttcatctgtatttacagccactcctcattgctagtattaccacctgagctctgccttctgtcagatcagcagtgggattagactctcataggactgcaaaccctgttgtcaactgtacattcaagggatgtaggttgtgctctccttatgagaatctgatgcttgatgatctgtcactgtcccacctcacccccagatgggaccgtctagttttaggaaaacaagctcagggctcccactgattctttattatgatgagttgtataattactttattatatattacaatgtaataataatagaaataaagtgcacaataaatgtaacgtactcgaatcatcccaaaacctctgcccctggccccacctctgtggaaaaattgtcttccatgaaatgacagactctggctgttgcccaggctggagtgcagtggctcaatctcggctcactgcaagctccgcctcctgggttcacaccattctcctgcctcagcctcctgagtagctgggactacaggcgcctgccaccacacctggctaattttttgtatttttagtagagacgtggtttcactgcattagccaggatggtcttgatctcctaacctcatgatctgcccacctcagcctcccaaagtgctaaaatagattttttaacagattttatgtcagaaaaatcgtaatgttagtcaaactttatttttccaaactttccaggttatcttacttaaaatattcatatcacttactgcttttgcagagagcaatgccgagcctagaattagcactcaataaatttgtgttgagtgaatgaatatggagcttaaatatggctatttagaaaatgtattttagggctgggtgaggtggctcacgcctgtaatcccagcactttgggaggtcgaggcgggtggatcacctgagctcaggaatttgagaccatcctggacaatacggtgaaactccgtctctagtaaaatacaaaaaattagccagacatggtggcacgtgcctatagtcccagctactcaggaggctgaggcacgagaatcacttgaacccaggaggcggaggttgccgtcagccaagatggtgccacggcactccagcctgtgcaacatccagagtctagctccaaaaaaaaaaaaaaaaatttcccatttgggtgcggtggctcatttctgtatatctgtaatcccagcactttgggaggctgaggcgggaggaccactggagcccagtagttggagaccagcttggacaacatagtgagactctacaaaaaaaattttttttctttttttttgagagggagcctcgctctgtcgcccaggctggagtgcagtggcgtgatctcggctcactgcaagctccacctcccaagttcacgccattctcctgcctcagcctcccgagtagctaggactacaggcgcctgccaccacaactggctaatttttcgtatttttagtagagacggggtttcgccgtgttagccaggatggtctcgatctcccgacctcgtgatccgcccacctcagcctcccaaagtgcggggattacaggcgtaagccaccacgcccggccaaaaattttttaaattagccaactgtggtggtgtgcacctgtggtcccagctactctggaggctggacgattgcttgagcataggaagaggaggttgcagtgagccattattgggccactacactctagcctgagtaacggaatgagccctgcctacagagagaaaagaaagttgagtatcttgaatttgaattggtatcttgaaatagtatggctatggtattcattattagctatattctgaggcatgagaaactgaggattagagctgggaatctgctggagttgtccaccccacgcttaaactttaggtagaggttgaatgaaaattggaattaaaaaatgtccatgaaggaaggtgggaaaaattttaaaacaattttaaaaaagaattaatttgtctgtattctacatagtttgtagaactttatcatgaggttattttgaatgacactagtgcaattgggtggattatacgtgggtgagggaggaaatgaaggtcaaaaattttgaactaagaaatcgaatatacacatacagccagtgaattacattgctccaaatttacttttcatcttggatagtgtaccttttttgtgtatttgttataaaacattaatctatatcaagcatcgtttcatgatttcattttttaaaatctccatgtatatgcttaggtttgttaatagtattaaagttctgtcctaaactgccccctcaccttttttttaagttgtgtttctcttgtcttcttttttttgaatcttgctctgttgcccaggcttgagtgcagtggcacaatctcggctcactgcaacctctgcctcccagattcaagtgattttcctgcctcagccttcaccatgttgcccaggctggtctcaaactcctgacctcaagtaatccaccctcctccacctcccaaagtgctgggattacaggcgtgagccaccgcgacagccctcttgtcttctttgcttggaagagagatctattgcttctctttttaatgatcacacacaaaaagtctaacagcaaattctaactggccagcaccactttcttagccattcttatgttgttttgcctatgttcgcaacaccgttttattcttctcttgaaatgtttccttgccaggtggtcattaaaactctcacataattatagtctttggcagagatttttgactctttttctctgctgtcactttggatcttgtcagaaacaagttatcttgttcttcagtagattttgaagaaaagggtaatgtagtttcttagatgcaccttagatgttcaaggagaatcacttgaacctaggaggcagaggctgcagtgaactgagattgtgccactgccctccagcctgggtgatagcatgagaccctgtctcaagaaaaaaacaaaaaaaaatagtattttaaaaattagctggatgtcgtgagtaaatcacatttaagaatttcccagctggccagcgtggtggctcatgcctgtaaacccagcactttgggaggctgatgcaggcagatcacttgagaccaggagttcaagaccaggctggccaacgtggtgaaatcccatctttgctaaaaatacaaaattagccgggcgtggtggcataagcctgtaatcccagctactcaggaggctgaggcaggagtataactctttgtatacttcccctcttgagcttctggggtaatggcagaagtaggtagaagaagtcaaacagtggatggcctcattggccccaatgcctgagtgcttcacattgggcatcatatgatgagttcccctctgtgcgattgtgtattagtcaatagagcagatgtggcaatgaatacctacaagtgatttttttttctttggagatgaagtcttgctctgttgcccagggtggagtacagtagtgtgatcttggccctttgcctcccaggttcaagccattctccagcctcagcctctcgagtagctgggattacaggcgtgtgccaccatgctcagctaatttttgtatttttagtagaggtggggtttcaccatgttacccaggctggtctcgaactcctgaccttaagtgatccacccaccttggcctcccaaagtgctgtgattacaggcatgagccaccgcgcccggccaatattaaactgacttacatgtttttctttacttaagcttattgtctgctaaagtaccattagtactctttttatgttagtttgtttacttgcttatagagttcattttttaaggaaattttaattcaagtataatatacacacagaaaagtatacataccataaggtacagcccagtgaaattgtacaaagtgaacatacctatgtgaccagtggccagatcaagacattaccaaaacttcagaaccccgttgtgtgaactcagtcattaatccctttacaaaggtggaattgtattgtaaaagtctcattttcttgtaatatgtagatagctttaaatgatgttaactggtgacattttggaggagttggccactataattttgttttgaaaaatttactctactttgtctcttacatgattattgatgaaactcaaaatgacccttctttggaaagatacccgctacacttgacatgaatgttgctcccagatctgaatctgatctggaatttgtatgctgcccagatcatttgtgcactgacgaatcaccctattccctttggaaaccttacaaataagattgtgttacagggacttattttttgctttaaaaaaataatcttttaaaaaaattataatttacagcttggatacttccgcttagtttggtttttaatttaatttaacttttttttacttttttcttttcttcttcttcttctttttttttttttgagatggaatttcactcttgttgcccaggctggagtgcaatggcacaatctgggcttactgcgaccaccatctcctggtttcaagcgattctcctgtctcagcctgctaagtacctgggattacaggtgtcccccagccaagcccagctaatttttgtattttttagtagggatggggtttcaccatgttggccaggctagtctcaaactcctgacctcaggtgatctgcctgccttggcctcccaaagtgctgggattacaggtgtgcctggccaatttttttttttttttactttttaaaaaactattattacttttttgagacagagtttcactcttgtcgcccaggctggagtgcaatgacgcgatctcagcccactgaaacctctgcctcccaggttctagggattgtcctgcctcagcctcccaagtagatggtattacaggtgcccaccaccaagctcgactaattttttttgtatttttagtagacatggggtttcaccatgttggccatgctggtctcgaattcctgacttcaggtgatccacccgcctcggcctcccaaagtgttgggattacatgcgtgtgccaccgcgctagccgttttaaaccttaaaattttttttaattgtgtaatcttgctccttctaatattagttgttttttgtttttgtttttgttttttttgagacagagtcttgctctgtcgcccaggctggagtgcagtggtgcgatctcggctcactgcaagctccgcctcccgggttcacgccattctcctgcctcagcctcccgagtagctgggactacaggcgcctgccactgcgcctggctaatttttttttttttttttttttttttgtagttttagtagagacggggtttcaccatgttagccaggatgttctcgatctcctgacctcgtgatccgcccgcctcggcctcccaaagtgctaggattacaggcatgagccactgcacccagcctctaatattagtttttaaatttaaaaattatatatacacattatagatatatttcaaattttaaaagccattacaattttatcctgtgcttagagattataatttttagcagtttgggtatactcaaactaagagttaggctgtgaaaattttctgttttttgagacagggtcttgctctgtcacccaggctaaaagtacagtggcgcaactcactgcagccttgacccaggctcaagcaatcctccttcctcagcctcccaaggagctgaaaccataggcactcaccaccatgccagctagttttctggggtttgttgtagagacggggtctcatttcattgcccaggctggtctttaactcctgggctcaagaaatcctcctaccttggcctctcaatgtgttggggttacaggcatgagccaccatgcccagccagaacttttttcttttcttttctttgttaaaaaaacacacacacacacaaaaaaccaagtattgtgggttttttaatttaaaaaaaattttttttcttttttttttttttttgtgagatggagtttcactgttgcctcccaggctagagtgcagcagcacgatttcagctcactgcaacctctgtggttcaagcgattctcatgcgtcagcctccccagtagctggaactacaagttgcaccaccacactcgtctaacttttgtatttttaatagagacagggtttcaccatgttggccatgctggtctcaaactcctgaactcaggtggtctgcctgccctggcctcacaaattgctgggacaggcttgaaccactgtgccctgccctaatttttgtatttttagtagaggcgggatttcaccatgttggccaggccagtctcgaactcctgacctcaagtgatccacccgccttgacctcccaaattactgagattacaggcatgagctaccgtacccagcctgttgttaatagtcaaaaaaatagaaacaaaatactaagctaagagtgataatttttgtcattgtacatctaaggtgaaagttgacatcatgattcaatttgcattgtaactagcaaagttggatgtctttacttattattaatttttattaataataaattttacgtattattaatttttatttcttccatgaattcactcttcatagcctttttttaggttatcttctattatacttttgtaaatatgtataatagaccacatatatataatatgtgtatgtataatagaccatggctggttttatcatggctgggcgtgggccctcacacctgtaatcccagcactttgggaggctgaaatgcacagatcgcttgaggcctggagtttgagacaaacctgggcaacatagccagacctcatctctaccaaaaatacaaagaagtagccaagcacggtggcaagcacctgtagttctagctacttgggagggttaggcggaaggatcgaatgagcctggagagcttttaaatgatgttaaaggctgcatacagtgagccatgatcaaaccactgcactccagccaaggtgacatagtgagacactgtctccaaaaggaaaagaaaacaaaacaaaaaaagaacagttttaaaagaacaaacttcaatttagaagggcagttcccttatttgtttaaaaaacgtttctcttgagggttggagaattacctgttgggtacaatgttcactattttggaagtgagtatacaaaaagcccaagacttcaccactgcccaatatatccatgtaataaaactgcacttgtaccctctaattctttaaaaacaaattttcctgacatgatgctcatttacccttccatatgaaccttagaagcacgctaaatttgaacagactgggggagagatttgtggctagacatttagggttggctttctcatttaggaacactattatgttcttccaactgaactttcttttataaccttctctgcattttttatagttttattcttaggttttttgcatctttctgttttttaacaaccttactgagatatcagactttaaaccaaacttctatctggttattcccactatatagtaaagctattgcatcctcagtatataaggatccaattgttttactttctttaaaaatcaagtagatttttctgtgattctcttgaaaaatattctagaaagactattatagctataataattgtgtcctattattttaataccagtcatatatcatattgtctgtttcaaataggactgtagaacaattatgaagtctgtataccagcaagaagttagtgaatatagtagaaaaataattaaatgtcactatagtattcattgacattaggaatagatagtatatttttgtacacacagaacaagaatgtgtatacctttagtgttctcctggtttttggaaggagggtaattaaaaagctgtttaaatacttggtttttctgtttcctatatgcatgtgacatgactagaagccaaatttgcctgctgtagcaaaaacctctatggggctttgagctgcttctgtccaagcctcgaatattcaagaataatcttagctgcagttgcctcttggaaatttaacagtatctttatcacaacactctcttctctccaccaacgtaggtacctccttttttttttgagatggagtcttgctcccatcgcgcaggctgtagtgcagtgttgcagtcttggctcgctgcaacctccacctcccaaagtgctaggataacaggcatgagccacggtgccggcctgggtagctcctttttactgtgttttactttgctaggtgacaaatattgtcggacatatattcatatgctcatcatctattttcatattctctattgtgaagtgcctattcaattttttctgccaattttctatgggggcaattctctgtatatgttgtgtcgtatatattatgccaaatatatgtaatgtaaatatatataatgtgtatatatatatcatgtcaaatatatgtcatgtaaatatttctcctgcccttttgcttgccttctttatttttttattttttttaatttttttgagacagagtttctgtctcccatgctggagtgcagtggcgagatctgggcttactgcaacctcggctcccgcctaagcctcccaagtagctgggactgcaggcaggtgtccacacccggctcatttttgtgttttattgaagagacaaggtctcaccatgttgcccaagctggtctcaaattcccgacctcaagtgatctaaccacctcccaaagtgctgggaggtgcgcccagcctgcatttttttttttttttttttttttactctgttgcccaggctgaagttcatgatgatagccttgaactctcccatctcaagtgatcctcctgcttgccttctttatttttttattttattttttggcggggatggagtttctgtcgcccatgctggagtgcagtggtgcaagctgtgctcactgcaacctcggcttcccaggttcaagggatcctcccccctcagccttctgagcaactgggactacaggtacatgccactatgccgggtttattttattttttgtggagactgagtctcagtatgttgctcaggctggcctcgaactcttggcctcaagcaatcctctcacctctacgttccgaaatcctggcattacaagtgtgagctgcggcacccagccttttttatcttttcaattagcagatttggtgtaagccattttaaaatgctttgcccactcctaggtcatgaagatgttttcttctaaaattcttcattgctttattttttgtgtttagatacacattataattcaagttgatcaatgtgaggtaggggtcaagattcattttctttcataaactttggaacaattggtcagtttacacatacacacacacacacacacatacacacgaacctctgatagggttttgattgggattgcattgaatctagagatcaattttgggaaaattgacgtaattataataatgtctattccatgaatttatactcctctgcatatagttagtcctttgtttattttaataatagttttagtttccagaagccttacggatttaatatttaagcagtttatggagctcagatttgaatttaaagactcctaaccattgtgcttaattttctattgtacactgatggaaacttggaatatccagaaaaggcacaaatatcatcagtaaaaagctttttagcatttcctatacaaaaactttattaatataaattcattgttaattttgacaacttgaatattaaccaaaataattttggtactatatatatatataattttgcatttgagattatttgcaagcactgtgttattatttggctgtaagaggacgtataaatatagaaaaaattttaatataaataattgtgtctagggggaaggtcctaaagccaactctactcaagggatgccttggtagcaatgattgttaaccatctggagtgacagaagaaagtgatattgggtaactaacttcttaagaagtttcatctcaagttttgtaatattatagcaacaaaaaattatgctattggttgctccattctggtcacatggatgggcgttttcatcatgtcctggttatgtactgattaatgtggtcaatctctgcactttctaaatttttgatacatggaggcagttttaaatggttggatggttttatgtggtgacaacatttgtatagaattttttttttttgtagttaacactcagaccactgagcaaattttaaatactgccgaagcctttttaacatcccaataattggatgcagtattaaataaacaaataaatatttacaattaatttttctattttgcattcaccaagtcaagtagaccacattagtcttatgaataaaatgcatataatgcatccttccaataacatgtaaaaatcatagaaaccacagaggcattcctttgtgtatattaattctcgatagtaaaatgagtcacccaaaggaaaagccataacattcctcagatggccaaaattcgttgtcaagtttatttttaatgttgagagttcttggttatttccatctaactacattagatggtttttttccatcgtctacatttgttcccttgtgacatttgtggaatttcagtgcagttttctaccgggccctctcttgtctgttgtgcaaactataacagcagtgaaataaaacacagactgccttgtactacttctacaaataataaccacgtgtcacagatttttgttctgcctgttgtttgttagtcatataggttcaggtactcttgtgatgagtctcatggagggaactgttgaggcagtggaaagtcctacagggttttatcccttgagaagtagtaactttaaaaaaactaaaatatggccgggcatggaggcacatgtctgtaatcccagatctttgggaggccaaggaaggaggattgcttgaagctaggagtttgagaccagccttggtaacatagttagaccccgtctgtagaacagattttataaattaagtaaataaactaaaatataatcatggagaacatcaaaaggaatatccattgcattcaaatttggcatacttgtcttccatagatgaatgtattctgttttttcaggttttaagaagaagcagtgatgaagaaaaagttctttgtttggtccggcagcgtacaggccaccactgtccaactgctgtgatggtggtgctcatcatggtgtgggatggcatccctcttccaatggccgaccggctatacacagagctcacagagaatctaaagtcatacaatgggcaccctaccgacagaagatgcaccctcaatgaaaagtaattaaatctgttttatactgccttaccattcagatctctattacatattggtaaaattgttaattagctaccaactatgtatattatatgggagaataggatttgagtattgtggaattaaaaagaatgaacatttctgtaaagagagagtctctattttatagtgagttaaggttactttaaatcattctcctttggaatattacttcactgtgaccaggtgcagtggctcatgcctgtaatcccagcactttgggaggccgaggcaggaggatcatgaggtcagaagatcaagactatcctggctaatatgtctccactataaatacaaaaaattagccgggcgtggtggcgggcgcctacagtcccagctactcaggaggctgaggcaggagaatggtgtgaatccgggaggcggagcttgcagtgcgctgagattgtgccactgcactccagcctgggtgacagagcgagactccatctcaaaaaaaaaaaacaaaaaagaaaagaatattatttcattgcttcccaaaaagggaagcaatgaaagaatattgctgacccaactcacttctagagtctggaggaaagggattttgacttaaaagaatggtcttccacaggagtgtcatatcattttgcatttcctctattcaatgtaagagaatatctgtttttctgtagtcttaccaatgattatgttggcaaatgtgagtttttgcctattaagagaaatgacatcagtgtaattttgacctgaatttctcttatgaatgagagtatttttttcacatgactaaaaaccatttggctttttttgtttgtttgttttaaccacctgttaaataacctagcccatttttgcagagaattcctccatttatctattttctctctgatggtgctattaactcttattctgtgatataatttgcaaatatttttctcagtttgtctttttcctttggctatgttatctcccacaaaaggttttgtttttgatgcaatcaaacatacccatctttttccttatttggatctggatgttgagtggtatttaggcatgtttttctatgactttaagcaaagcaacatataatgaaaccaatatttttctcatcaacgctgtagcaatattgagcgatattcggggaactgctctaggtggtttcacttataatcagtttctaacagcctgttgacatcaagtgagaaatgactatacttgtttaaaatataaatttttgaaatttaaatctctcatacatttaatgaatcactggtgaatagttgtaagaggagataagttttgttgttgttcttgttgttttgtttttttgagacggagtctcgctctgtcaccaggctggagtgcggtggcgcaatcttggctcactgcaatgtctgcctcccgggttcaagcgattctcctgcctcagcctcctgagtagctgggactacaggcatgcgctttgggaggccgacaagggaggaccacttaaggccaagagttcaaaagccagaccaggcaacatagtaagactccatctctacaaaaatatttttttaaaaaaactgtttgggaatgatggcatatgcctgtagtccttaggtaattaggaggctgaggtggaaagattgctgttgcccaggaatttgaggctgcagtgaactatgatgatgccactgaactccaacctgagcaacatggcaaaaggagagagagagagagagagagagaacttcatgggcctgatgtactggctcatgcctgatcaaagcaggaggatttcttgaaaccaagagtttgagaacctatccctacacaaaatttttaaaaccaggcatagtggtgtgtgcctgtgttcctggctactttgaaagctgaggagggaggatggcttgaggccaggagtttgccgttacagtgagctctgattttgccagtgcacttgacagagcatgatcaagtcttcccctcaccaccccccacaaaaaaaaaacagttcacaaatacagaaagatgtaagaatacttcagcggagtcttttttttccttttttctttttgagacagagtctcactctgtcgcccaggttgagttgcggtggcgtgacctcagctcactgcaaactctgcatcccaggttcacgccattctcctgtctcagcctcccaagtagctgggactacaggcgcctgccaccatgcccagcttttttttttttttttttgtatttttttgtattttttgggggggtttttttttgtatttttagtagagacggggtttcaccatgttagccaggatggtcttgatctcctgacctcgtgattcgcccacctcggcctcccaaagtgctgggattacaggcgtgagccaccacgtccagcccagtgaactcttttaagacagagtctcgcactgtcgcccaggctggagtgcagtggtgcaatcttggctcactgcaacctccgcctcctgggttcaagcagttttcctgcctcagcctcccaagtacctgggattacaggcgcccgccaccacgtccagctaatttttgttgttgttgttgttgtatttttagtagagacgaggtttcactatgttggccaggctggtctcaaacccgcctcagcctcccaaagtgctgggattacagacgtgagccaccgtgcccggcctggtaaactcttatatacccttacttagattccacaattgttaacactatgttacatttgtttacgtacacatacaaacacgttactgttgtagacttatttctttcttgatcatttgagagctagatgtagactttgtctttttccctaaataatacttgaatgtatttatcctaaaaatgaggattgttctcttgtatatccccatataatgatcaaattcaggaaatttaaatttgataaaatactgtgatctcatcttagttcatattcaaatatcatccatttcccaataattttcccctgtccatgattgaatgcatttagttattttgtccttttgctcccttaatcctttttgttttctcagtttttgtctgtcatgacattgaaatttttgaagcgaaaaggctaattctatagactgttaatcaattttggtttatctgtttcttcctgacttaagtcaggctatgaaatacaacctatagccaaagatggctgaaacaaaagaaaaaataattaaaaagatgaaatataacctggactattacactcagtgcaatttgtcccactattggtgttgttgactatttaaaataatctgaggatgctcttctagatctcacaacttatcacatttcctctgtgtttcatttttaaaataatagtacatagtaagttaaacaacatttttctctccttccatgtctttttcaatgatatgaataaatttcttatgtttctatttgtttggcaactttaatttattctattcaaaatgttttaaccattttcattccatttgcatctcatttagtgaatttcatcgtagtctttcttttataagcaatgctaagttacgtatcaggcattttccaggctttcacagtgaaaacataaaaaatagtttttttctaaatttttatattattttcactttttcaaaataattggtttctttattgttttatattttaatcattatataagtacaatatatactaagttgtaagcattatgcaattttattttttacttaattattcttttactgttttttttgttctttctttctggtggaatttaaaatcatgcaatccttttttaactttcattttaggttcaggagtgcatttgcaggttttttatttaggtaaattcatgtcacaggggtttgttgtgcagattatttcaccagccagctactaagctagtatccaatggttattttttctgatcctctctgtcttcccaccctccatcctcaagtaggccccagtgtctgttgttcccctctttgggtccatgaattctcatcacttaactcctacttataagtgagaacatgcaatatttcatcttttgttcctgtgttagtttgctaaggatagtggcctttagctttattcatgttcccacaaaagacacgattatgttcttttctgtggctgcatactattctgtggtgtatgtgtaccacattttctttatctaatctgtcattgatgggcaattaggttgattacgtgtctttggtattgtgaatagcactgcagtgaacattcacatgcatgtgtctttatggtagaacgatttatactcctttgggtatatacccagtaatgggattggaagagcatacagttttataactacaagaagaatatatggtactttcgttgtcattcttagcatatagtttagtttaaggctttagaaatgccctaaaagttatacacttaagatttaattaaatgtaaccggttttctgctccatttttttctattatgcactttttaaagtttttaaaattcagaaactgttttgtttttgtttttgtttttgttttttgagatggagtcttgctctgtcacccaggctggagtgccatggcacgatctcagctcactgcaacctccgcctcctgggttcaagcaattctcctgccactgtgccaggctattttttgtacttttagtagagatggggtttccccatgttggtcagggtggtcttgaactcctgacctcatgatccgcccaccttggcctcccaagggctgggattacagtagtgagccaccacacctggccaagaaactgtttttatataaaatatatattgtttttcaatccttagaaaattatatccgtctcattttagatataaagcagctgaattccaaagcagtaataaaatgttctaaattttcatttgtgatatggaacaaatccaggatttaaaacccagatttaaaaaccaggttctgtccaggctcagtgcctcacacccgtaatcccagaactttgggagggtagataacttgaagtcaggagtttgagaccagcctggccaacctgatgaaacccgtctctactaaaaataaaaaaattagctgggcgtggtggcgcacacctgtaatctcggctactcaggaggctgaagcagcagaatcgattgaacttgggaggcagaggttgcagtgagccgagattgtgccacggcaatccacccttggtgacagggctagaccccatctcaaaaaaaaaaaaaaaaaaaaaaaacaccaaaaaaaaaaaaaagaaaaacccaggttctttatttccctatctcagacatctccaaatcaaacaatactgtgagtattttagatctgtatagtttattcccacttatttggatttgcaatcatgaccaaatatttctgctaaaaatttggttataataaagtatagttaaccctggtcccctagtcagatttcttgaaaaaacaaaagttagctttttattgttaacattaaactattttaaataagtaatataatagataagtgttataaccggttctttaggcatccatccttctaaagctatagaaacctgaaatgttctctctgaggtattgtaatgcttcatcaattcactctcttgaattacaatcttacagtcgtacctgtacatgtcaaggaattgatccagagacttgtggagcttcattctcttttggctgttcatggagtatgtactttaatggctgtaagtttggtagaagcccaagccccagaagatttagaattgatccaagctctcccttacatgtaagtgtccttctttattcaaataatttatttttgaattacacattgaatatgtaagtgcattcctttaacattttttgaaacactataaaaactaaatattgaaaagtagtaatcaaatagtaaaattatatttctattatataagtaaataaattaattaagactctaaataaattaggtaaagactttagctatctccccaaattccaattgtccctggcttcctcctcctgctctactaccccaccccagcaaaatcatcattaaaagaacctagaattttatactcagccaaaataggaaaaacccatttgccaaaatttcaaagactcagaaagtttactacccacagacctactatgaaagaattactaaaggacgtaatccagaaagaagatatatgaaaccggaacgaatcagtccgggacacgaggccatggtgagcaaagaaattagtcgaacttggtgttaagttaaataagttcaatacttatatattatattaaattaaaataacctataagtataactccacacctttatcagctcgtgggtgggtaggcagtgggagggggtggggcaccaataggaactaagtattctaatgtgttatgctttgtttgtgtagtgaggatttatatattgattaactataagattgatatcttttaatctttgagcagtgaccaagagtaaaaaacattttatattacaagccactatacacatacatagacataagaaaataattagacctatctgaaaacaatacttacctttcttacatgtaacagcagtaacatcaaaatatttaaaaagttaatatcaatgtagttattctaagagtctatgatacatcatttttttatcagatttctttctttttcttttttttttttctttttctttttcttttttttttttttttttgagacagagtttcgctcttgttgcccaggctggagtacaaaggtgtgatcttggctcactgcaacctccacttcctaggttcaagcagttctcctgccttagcctcccaaatagctgagattacaggcatgcaccaccatcatgcccagctaatttagtatttttagtagagatgaggtttcaccatgttggccaggctaatctcgaactccggatctcaggtgagatctgtagtcccagctactaaggaggctgaggtgggaggttggcttgaaccaaccagctaggttttctttctaaatattatatgataaaagtatctgtccctttttggctctctgagcagcactgtagtggttggcaagaataaggcagcacaaagggagccaagaagaaagtgcttgatccattttctaagaaagatttgtattacgtgaaagcatctgccatgttcaatataagaaatattgggaagacactagtcaccagaacccaaggaaccataattgaatctgatggcctcaagggtcgtgtatttgaagtgagtcttgctgatatgcagaatgataaagttgcatttagaaaattcagctgattactgaagatgttcaggggaatgattgcctgatgagcttccatggcgtggatcttacctgtgacaaaatatgtttcatggtcaaaaaatggcagacaatggttgaaggtcatgtcaatatcaagactaccggtgcttacttgcttcatgtgttctgtgttggttttactaaaaaatgcaacaatcagatacggaagacctcttatgcttagcaccaatgtttcggccaaatctggaacaagttgatggaaatcatgacccgagaggtgcagacaaattacttgaaagaagtggtcaataaattgattccagacaggattggaaaagacatagaaaaaattcttgccaatctatcctctccatgatgtctttgttagataagttaaaatgctgaagaagcctagctttgaattggggaaactcatggagctttatggtgaaggtagcagttctggaaaagccactgaggacaaaacaggtgctaaagtagaacgagctgatggatatgaaccactagtccaagaatctgtttaaagttcagacttatagtagtggcaaataaaaagtcatatttgtgggggaaaaaagtgtctgttagttgataaacataaaggatcttcaaaacattcaaggaaaatgcatattatgaataaactatgtatggatttcataataattttcaccaaaataaactcatacttacttgtaacatgcctgaatggggtctagtttgatgcactaagaaggataagatgtcagtttataaactgcctctatcagagcaacatgaattgtgctaaaattgaagcaagaacaaacatcaaatttctggtgaagcttgggtggaagaatgataaaatcgttgatgccttataaaaagcttatgggcactgccccaaagaaatctgcagtttacaaatggatagctcattttaagaacggatgggacgattttgaagatgaaggccaaagcgtcaaactatccacgtcatttttttttttttttttttgagtctgggtctcgctctgtcatccaggctggagtgcagtgatgtgatctcagctcactcactggacctgacctcaggtgatctgcctaactcagcctttcaaagtgctgggattacaggcatgagacactgtggccaggcagatttttagaaattaagataaaattggccctctctggctgttcaaggaaaaatatttggcccaagatcaatgacagtccctactccttgccaggtgcccaattaatacctaggctcttttataaagctattttgttgttgttgtcttgagatggagtttcgctcttattgcctaggctgacgtgcaatggcttgatctcggctcactgcaacctccacctcccgggttcaagtgattcacctatcccagcctcctgagtagttgggattacaggctcccgccaccatgcctggctaatttttggtatttttagtagagacggggtttcaccatcttggccaggctggtcttgtactcctgaccctgtgatccacccacctcagcctcccaaagtgctgggattataggtgtgagccacagcacctggccttttgtgtgtgtgtgtgtgtgtgtgtgtgtgtatacacaagatatatatgtatatatatacacatatatatgtatgtatgtgtatatatatatatatatatatatatatatatattttttttttttttttttttttttttttcttctgagacggagtcttgctctgtcacccaggctggagtgcagtggcgcgatctcatctcactgcaaactccgcctcccaggttcacgccattctcctgcctcagcctcccaagtggctgggactacaagcgcccaccaccacagccggctaattttctgtatttttagtagagatggggtttcactaggatgatctcaatctcttgaccttgtgatccgcctgcctcagcctcccaaagtgctaggattacaggcgtaagccaccgtgcctgacctggccatttgtatttttttttcgtagagatgggatttcatcatattggccaggctggtctcgaactcctgacctcagatgatctgccctcctccgcctcccaaagtgctgggattatagatgtgagccactgtgcctggcccacatcaatttttgaggaaacattaatcttgtttgttccctaactgaatagatatatcaactggttcagcctacacaattcttactgaaacattatagttgtgcaaacttcctacttgatgggttccaaaactgttgttcccagctcagctgcagaaaagaatagaaattttaaacaagtgggatcaagatcctgaggcattcttaaaattacaacaggagatggagcatggctttaccagcataatcctgaagacaaagcataatcaaagcaaacgccagcaagaggtataggaagtccagtcaaaaccaaagtggaccagtaaagagcaaagttcatggcaacagtttttttgggatgcttaaggcattttccttgctcactttttggagggccaaacaaaaataacatctgcttattatgaaagtgttttgagaaagttggagaaagctttagcagaaaatagcccaggaaggctccaccagagagtccttctccaccgcaagaatgctcctgctcattcctctcatcaaacgggggcagttttgcaaagtgtatcaatgggaactcattaggcatccaccctatagtcctgatttaactccttctgatttctttttgtttcctaatcttaaaaaaatccgtaaagggcacctatttttcttcacttaataatgtaaagaaacaacaacaacaacaaaactatattgacatggttaaattcccaaagtgctccatgctttagaaatggattaaatgtccaatattgtcacttacaaaagtgtcttgacctggatggaacttatgttcagaaataatgttattttattttttgatacggggcctcactatgttgctctggctggactcctgggctcaagggattctcctttctcaactccaaagctgggattacaggcatgtgccaccctgcctggcaatttttttaattgagacggagtttcggtcttgcccaggctggagtgcaatggtgtgatctcggctcactgcaactcctgcctcagcctcccaagtagctgggattacaggcatgcgccaccacgcccagctaattttgtatttttagtatagatggggtttctccatgttggccaggctggtcttgaactccccacttcaggtgattcgcctgccttggcctcccaaactgctgggattacaggcatgagccacaattgcagaccagtattttttatttttatttattttattttattttttgagaagggttctcactctgtcacccaggcagagtgaggagggaggccacccacctcggccttccaaagtcctgggattacaggcgtgagccaccacgcccagccagaatcaaagagttttaaggaggagagtgacatacttacacttgcccttgaatgagatccctctagatgctgtttgaacaatagactaaatgtaaccaagagtggatttagcaagatgagccaaccatctatgagcacaatccatggaggggataatggtcacttaaattatatggggtggggggttcatctttatcatcaggcacactggaaattggaccaggtttgtagagggcagatcagtaattcagtttagatatattggtattgagattcctaagggaaatctacatgggaatgtcaggtcaataataggaatctgaaacttaagaaatggtctaagtggtaagtatagctgtggatgaggatatgatggtcctagagattagatacagagtgtgaacagaggcctggtgtggtggcttacatctgtaatccccgtactttgggaggccaaggcaggtggatcacttgaggtcaggagtttgagaccagcctggctaacatggtgaaactccgtctccactaaaaatagaaaaattagccgggcatggtggcgggcacctgtaattccggctactcaagtgcctgaggcaggagaattgcttgaacctgagaggcagaggttgcagtgagctgagatcgcaccactgcacccccccacacacaaaaaaagagtgggagaaggagttaatcttgaccaccaataggtaaagatctgctaagtaattccctctgtatctgacatgcatgttcattctaatgaaataattagaaggtcaggattttacaatatgaataataagcctgtaatagtaaaataatactaatagggccgggcacagtggctcacacctgtaaccccagcactttggaaagctgaggcaggtggatcacttgaggtcaggagttcaagaccagcatggccaacatggtgaaatcctgtctctactaaaaatggaaaaaattatccgggcgtggtggctcatgcttgtaattccagctactcaggaggctgaggcaggagaattgcttgaacctgggaggtggaggatacagtgagccgagattgtgccgctgcactcacactccggcctgggcaacagagtgaaactctgtctcaaaaaataaaagatgaaaaataataaaataataccaacagtgaactgtacaaactatgagttgcttctagttgtctactttatttcagtgcttctacacaataaatgaggtaatttgagatgacctgttcctcagtaggacttgtgactctgtgtggtccacaacagaataaatattattacaaaatagagtaaagtgatgtgagaatattaaagaatttaaacctgatgctgcatacaaaaagtatagaatttacatgtgacttttccagtgttcatatcaatagcagtacacaagtgttaacatttctctgcattgttccacttgtagtaaaacacggttacccagcccactggatacttccagtgattgaagatataaatagaattgttttaatgggtgttgatttaaaagtttctcccaaataaacataataattagtgtatgggtttagcgagggcatgtttttaaagtagggtcatgactttcctgttttgttttgtttttttgagacagagtctggctctgtctcccaggctggagtgcaatgccatggtctcagctcactgcaatcttcacctcccagattcaatagattctcctgcctcagactcccaaatatctgggactacaggcgcatgccaccacacctggctaatttttgtatttttagtagaggctgggtttcaccttgttggccaggctggtctcgaactcctgacctcaggtgatctgcccacctcagcctcccaaagtgctgggattacaggcatgagccactgtgcccagctgactttcctgttttttaaactacaacggctaagataaaagtagcctgattaacagacaaatctatgaatggatcctatggattttttttgtgtaatcaagtcaatataaatcaataggaaaccaaaatgattatgagtcacacttacggttgctaagatggaggcttgtcagaaaccactaaataattgacttgctgtgtctaaattattgtgtagctttggcttttataataatttgatgcataccaaaggtcaattgattcatataatggtctcctttctgtgttaatggcatctccttccaccaaatctcacatgagcatatgaggcgaaagcctcactcaccctgtttagtccatgttctctatacgtgtttttcttttttgagacaagatctggctctgtcacccaggccggagtgcagtggcttgatatcatctcttgatctgccacttcagcctcccaggttctagcaaccttcccatctcagcctcccaagtagctgggactgcaagtatactccgtcacggccagctaattttttttatttcttggagaggtgtggagtttcaccaagttccccagactggtctcaaatttgtgagctcaagtgatctgcccgcctcggcctcccaaaatgttgggattacaggcgttagccaccatgctaatagagactcatgtgatagttttcctttgaaaaaatctgatgtctctatcagtagcaatccagatttcttgagtgttaatggtcctcatagtccttcaaagtcttcttcaatttgtagttattatggtgtagaaaagagaactatagacaaccacttgcccacttacttcctttgatctgcaggcatttactaaacctctcagttatcctgaccttgctctttcgtagagatcatgcgtaatattcctgtttcatgggccataaggacatgtgtttaattcataaggacatatggattccatttgaaacaggatctcacacagagtaggtgttttatgtatgtactctctcttctccgttataggaacctgttacattgtaaccaagttacttgccatttccccttgccagcaagaacgttgtttgcatttattccaagtgtgcaatactattgaataaatataaaacatagctctcatttttcacaacatgaacagtattgtaatttatctctaacactatttaaatttctaattaacttagaattttcatttcaaaagacttcattaaagcataacaatgtctaatagtttagatggagaaaagaagcagtgtaattttctgtggtagctattttatcaggataagtatgaattgtgcattaaccaccatcagccatgatttatgattcagttgtaccttaaacacatgaaggtgcgattataaaatacctaatggattctgttttcctataggaaaaaaaccttgaagataacttacagagtttggctacacgattagctccaatttataagcagtatgctccagtagcttaccaaaatcaggtatgtattggtatgaactttttatttatttattaatttgaggtggggtcttgctttgttgcccaggcagcagtacagtggcatgatcaaagcttactacaaactcctaagctcaagcaatgctcctgcctcaccctccaaaaatgctgggattacagatatgccagactgttttatatcttaaaaagtcattgttggccaagctcgttagctcacgcctgtaatcccagaactttgggaggccaaggcagtcggatcacctgaggtcaggagttcaagaatagcctggcccacatggtgaaaccccatctcaactaaaaatacaaaaattagctgggtgtggtgggtgtgcacctgtagtcccagctaatcaagaggctgaggcaggagaatcacttgaacccaggaggtggaggttgcattgagctgagatcatgccactgcactccagcctgggtgacagagcaagactctgtctcaaaaaaaaaaacaaaaaaaaccagtcattgttaatagaaaaattttcaaatttgaacaaatatatacatacacagcatatctatctaacatacatttatgtaattggactttttattgatctactcttttttttttttttttttttttttgagacagagtcttgctcttgttgcccaggctggagtgctgtggcgcaatctcagccttttggctcactgcaccctctgcctcccagcaggttcaagcaattctcctgcctcagcctcccgagtagctgggactacaggcatgcgccaccacaccccgctaatttttgtatttttagtagagatggggtttcaccatgtttcccaggctgctctcgaactcctggccacaagtgatctgcccgcctcagcctcccaaactgctgggattacaggcattagccaccctgcccagcatccaccttttcattttaaaaggagttacaaattgactttcagtaatggttcatgaaatgtatgtatatcttctttttacggatattgaaaactctgtgtatatgattaatgcgcttttattggtctttctttctaatggaatgattgagtctattttacttgcttatccatctccaacaagaattagtatcctcaccctgccttcccttgtaaattcagtgattttccttttactccatgtattgtcaagtgctttctcctgaatgttgctaagctacaccttcatgacaataatacatttagtctcagaaattacaaagtgtaattaattagaaacttcatgaggaaattatttttactctttactgaaggtaggtgatttccttctctctcttaagattgtgctccatgctttcttttctaggtggaatatgaaaatgttgcccgagaatgtcggcttggcagcaaggaaggtcgtcccttctctggggtcactgcttgcctggacttctgtgctcatccccacagggacattcacaacatgaataatggaagcactgtggtatgtacctgtgtgaatttgtattctaaaagctccatcactatatgcttaggctgcagtccttacgtatactgtgatgactattactgtgaaaaatcttaatttatgtgttattagaaataagtggaaaataaagtgaaaaaaaagaaataagtgtgtagtgcaggtcttcattaaatgcattatctatgcacttctaaaaagtaacagggccagcttcaaacaaacattttattgaaaggctatgttacatatttaattgttgtgtttttgctgggaggcaggagtacttttttttaaatttatttatttatttattttttgagacggagtctcactctgtcgcccaggctagagggtagtggcacgatctcagctcactgcaacctctgcctcctgggttcacgccattctcctgccttagcctcccaagtagctggggctacaggcgcccacgaccacacccggataattttttgtatttttagtagagatgggatttcactgtgttagccaggatggtcttgatctcatgacctcgtgatccacccaccttggcctcgaaaagtgctgggattacaggtgtgagtcaccacgcccagccaattttttgtatttttagtagagatggggtttcaccgtgttagccaggatggtcttgatctcatgacctcgtgatccgcccaccttggcctcccaaagtgctgggattacaggtgtgagccaacgcgctcggccaattttttaaagtaacaattctctgctatcaaactagtaggtatgaagttgagcatgttacttgatatttgtttttgccatctgcacttcagggtttttgtgaggcaactgtgccaattatcagcaatatttgcattctggtatgcctactatgtttatagttatgtaaatcatcacatgtccatcgcctgaagtcaattaagaaatacgtaaattaggcagaagacccagtggaaaatcttgaaatagtatttttgtctgtttgcttcacctgtttgtcttcctgtcatctagtaaagcaagatcaatagagagcaattgcttttgtttttctgctgcaccagttttttaggtttgccagagaattctaaaaccttcattaagtcttggctgcaggatgagcatgttggctcatgtctgtaatcccacctacttcggaggccaagataggaggattgcttgagccccgggagttctagaccagcctgggcaataagaccccgtctctttaaaatatacaatttttaaaaaataattttttttaggtttagctacagcctcttacagtgtgattgaaagtatatgatcagatctatcaacaggcagtctttcttccttgcttggtcagtagaagagtattggtgatagattaagccacaacaacttttttttttttttttgcgtatcattcctgtatacaaaaatgttttgcagagtctttgagaccaatgttatttctaagtgttgaagttatataaatccagcctggtaaatactagccaggcagtggttcatcaccatcacttggccaggacattttacctgaattacagaatatctgtgatcaggctgaagtcagttcagagtcaagctaagtttcagtttctcttctctgcgctctttgacttccagggcccggattactcactcaatgagggtcttatccggaacttgacatcactccaaattcccccatcttcaaacatgtgaactcttgaaattctaccactacctctcccttcaccctgttttaccataatttctattttttttattttttttattggtttactctctactccttattggtttactttctaattatgctcctcatgtcaactccttatgtccttcttagtctctctgtgaccaattaaattggttccagtaaacatttattgatgtgacattctgattttcagcatgactattattagttatgaacagattaccaccatgacagtttaatattgcaggctttctccaggcaccatggctcatgcctgtaatcccagcactttgggatgctgaggtggaaggattgcttgaacccaggatcttgagtgtagcctgggcaactttgtgagaccctgtctctacaattaaaaacaaaattagctatgcgtgatggtacacaactgtactcccagctactcgagagactgaggcaggagaaacactcaaacccaggagtttgaggctgaaacatatatttatattttagactttgctgaaaaatgtgactacagatattgaaaaaaatgaatttttttaacctttaactttgctttaccttggtatctatcaagttctaccatgaatacaaaaatgctttggaaatcaaatctgtttatttcatttatctccagtcttcgctatcactgaaagggtttacagctccgggatatatgtttttattattaaataaataaaacattttataggtttctgttggatttttaatatttgaaaattaatttggctgggcccagtggctcacacctgtaatcccagcacttagggaggccaaggtgggtagatcacttgaggaaaattaattacaattaaaatattagttttataataaaatgttagtttttaaagcagaatattaatattaggtatcaaaagtcaggaatcactatagtgcctatagttctgtattttcatttctccataataaatataacctttaatgtaaggaggagggctaaaataggttgcatttaagatgaaaaaagttggctattagtatttcatatccaaagaaaggcaaatttattgatatttattgatatggctcctcactggaatagagcagtaatagaacagaaagagaatatttatcaatataaaattaaaaaaaaattttttttaactgttagcgtataagtctttctggaaagagaaatcaattatgtccctgctatccaaggaatgtgacattcttgaaatatcagaaatatggtgctatgtgagctaaaatcatatcttcctaataagttatacttaatatgaacacaataaacatagttcaatagccattccttaatttaggcaatgaagtaagatgaaatgtaacaagaatgtttagtatcaaaaatacgtaagtattttataacgttatatttacttagaaaattaaatattattctggtctgcctacaaacaactgggaagttactatgattgaacagagttgggtggcttgatataaaataataatataccatcagcaaccaattgaaaataaaatgggaatacaaatctctttcccaaaggcaacaacacgaaggtaggaatagccacaatgaatgtgcacgacccgtatatctttcccatttcatgtttttctccctatcaggtttgtaccttaactcgagaagataaccgctctttgggtgttattcctcaagatgagcagctccatgtgctacctctttataagctttcagacacagatgagtttggctccaaggaaggaatggaagccaagatcaaatctggggccatcgaggtcctggcaccccgccgcaaaaaaagaacgtgtttcactcagcctgttccccgttctggaaagaagagggctgcgatgatgacagaggttcttgcacataagataagggcagtggaaaagaaacctattccccgaatcaagcggaagaataactcaacaacaacaaacaacagtaagccttcgtcactgccaaccttaggtgagccctatggaacctggtaatctctgcacaactttgatggatagatgtgtttggactttgccttgccttatttgtttagagttaaaactaagacactgaatatatttttacatataccagaaccaaaagtcaacaaaaaagtgacccatcagtatttcttggtaactttttcgacttatccttttttttttttttgagagggagtcttgctctgtcacccaggctggagtgcagtggcgcaatcttggctcactgcaagctctgcctcctgggttcacgccattctcctgcctcagcgtcctgcttagctgggaccacaggcgcccgccaccacgcccagctaattttttgtatttttagtagagacggggtttcaccgtgttaggcaggatggtctcgatctcctgacctcttgatccgcccccgcccccccgcccccgccttggcctcccaaagtgctgggattacaggtgtgagccaccgcgcccggcctacttatccttttttatactttaacatattctttttttatggcatggggaggggtctcactttattgcccaggctggcttggcacgccttggcttaagcaataatcccacctcagcctcctccagagtagctggaactacaggcacacagcactgtgcccagctaattttaacatgttcttatcattgttcctgtgaatttccccatctaattcgaagccctactcgttgttggcatagataagagacatgactttcgggatgccttccttggtcacctttaccatcaatttaagcaataattaaataaatattactaaacaccactttcaacagtggtattgtgggttgtcgttgttgtttttgttttgtttctttgttattttgtttttgtttgtggagacaagatctagctctcttgcccaggctctggagtgcatgcagtggcgtgatcatggctcaccacagcctcaaccttccaggctcaagcaatcctcccacctcagcctcccaagtagctgagactgtagtgtgtgtgccactgtgtctagctaattattgtattttttatagagatagggtttcacctgtttgccaggctgatctggaactcctggactcaaatgattctcccaaattggtgtaattacaggcatgagccatcacacctggcttgatttgttgattataaagtctcgttagttttggttttgggttttgggttttggggttttttttaaaagacagagtcttgctatgttgccaaagctggagtacaatggctattcacagacacaatcatagcacactgctgcctcaaactctgggatcccatgggaacctctctagcagctagaactataggcgtgcaccacacctggctcttaccagcttttcgcctaatatatattttgagtcagagtctcactctgtcacccaggctggagtacagtggcaccatcttggctcactgtaaccctccacctccttgattcaagcgattctcctgcctcagcctcccgagtagctgggattacaggtgcccgccaccacgcccagttaatttttgtatttttagttgagacggagtttcaccatgttggccaaactggtctcaaactcctgacctcaagtgatccacccgcctcggcctcacaaagtggtgagagccaccacgcccggctggcttctcagttcttttgtcacaacctcaattgtcttttgatagcttttttttttttttttttttttgagacagagtctcgctctgtctcccaggctggagtgcagtggcgcaatctcagctcactgcaagttgtgcctcccgggttcacgccattctcctgcctcaacctcccgagtagctgggactacaggcacccgccaccacgcctggctaattttttttatatatttttagtagagatggggtttcaccgtgttagccaggatggtctcgatctcctgacctcgtgatctgcccgcctcagcctcccaaagtgctgggattacaggcgtgagccaccgtgcccggcctactttcttaacttctataacaagttgttccaggcttatctatataattctgccccatatttaaaatcagccatttctttgatgagcctatagaaggaaaaaaaaatcatgaattcatactgacactcaaaattaacattataatgtattccttagcttctttcatttttacatttatgagaagctgtttatttgtttttataacatgagcagagttggcagtgcaggcatttatataatgctgaaagaaatgcaataatacagagaaatactgagaagaaatgtatattcccagatatttgtaagcataatgtacaatacttgggccataatgtccttttgtaattctacccctcagtcatttagtctttccttcccatcatttaccttctgtggacaacttaacctctataataatagtgccactgataacaatagaggtttcctgatgtaccatttctgggtcttatgtatgcgttatctttagaaatgagagctctcaaggctccaggttgtagcatctgagaggagaactgcagagcttctgaaattgatcattatgtattatattatcaatttattatatttttaattactttaaaacatggctgctttaccttttcttggtcctaagatttgctggttttgcacttccaaatagttttttagaagttcacaacaggggctaggcgtggtggctcatgcctgtaatcccatcactttgggaggcagaggcgggcggatcatgaggtcaggagttcaagaccatcctggtcaacatggtgaaaccccgtctctactaaaatacaaaaaattagccaggcgtggtggagattgagaccatcctggccaacatggtgaaaccccgtctctactaaaatacaaaaaattagctgggtgtggtggtggtgtgcgcttgtagtcccagctactcgggaggctgaggcgggggaatcgcttgaacctgggaggcagaaattgcagtgagccaggatcgcaccactgcactccagcctgggcaacagagcgagactccatctcaaaaaaaaaaaagaacttcataacagggagaatgtcctcaaggaaaatgttcccattggatgtgagatttatgtggatgtgtcagagcaaataacccacagttgacatcttgagagtaatgatctccttccttaatgagaaggaaactaagctgaaatactcttgcttttgagggtcacaaagatttatattcaagtacaatattttgcttgacttccctctgcctaaccttggactttgccagttaagatgttttgttacctagaaatatttataaactattacttgtttttactttttaaaatatagggtcatacaatgcctaaaacgtatctaaatatctttgaatagttaaatattgctgtatgtgattgtattacaatacctgcacaatattacaacatttagttgtattacttacttcctacctaattagttcaattctaatattttactatttcaaacaatgaacagccatccttttggctagatttttgcacttatttatgcctctttcccaaaggaagagttctttaaagaaaattatggccgggcgcagtagctcaagcctgtaatcccagcactttgggaggccgaggtgggtggatcatgaggtcaggagatcgagaccatcctggctaacacggtgaaaccctgtctctactaaaaaatacaaaaaattagccaggcgtggtggcaggcgcctgtagtcccagctactcgggaggttgaggcaagagaatggcatgagccgagatcgtgccactgcactccagcctgggggacagagcgagactccgtctccaaaaaaaacataaaaataaaaattattagatgaaaaattatacaaaactacataaaatttttaattcgtgtttgtgatttgaaatgaacagaacaaaaccaaccaacacaacatcagcgttttcttatataattctttgtacttgtctttgaaaatactttttaaaaggcaacccctaccaaaagtaatttgtatttttcttcacatttggtgtccttgtttagggagtaacactgagaccgtgcaacctgaagtaaaaagtgaaaccgaaccccattttatcttaaaaagttcagacaacactaaaacttattcgctgatgccatccgctcctcacccagtgaaagaggcatctccaggcttctcctggtccccgaagactgcttcagccacaccagctccactgaagaatgacgcaacagcctcatgcgggttttcagaaagaagcagcactccccactgtacgatgccttcgggaagactcagtggtgccaatgcagctgctgctgatggccctggcatttcacagcttggcgaagtggctcctctccccaccctgtctgctcctgtgatggagcccctcattaattctgagccttccactggtgtgactgagccgctaacgcctcatcagccaaaccaccagccctccttcctcacctctcctcaagaccttgcctcttctccaatggaagaagatgagcagcattctgaagcagatgagcctccatcagacgaacccctatctgatgaccccctgtcacctgctgaggagaaattgccccacattgatgagtattggtcagacagtgagcacatctttttggatgcaaatattggtggggtggccatcgcacctgctcacggctcggttttgattgagtgtgcccggcgagagctgcacgctaccactcctgttgagcaccccaaccgtaatcatccaacccgcctctcccttgtcttttaccagcacaaaaacctaaataagccccaacatggttttgaactaaacaagattaagtttgaggctaaagaagctaagaataagaaaatgaaggcctcagagcaaaaagaccaggcagctaatgaaggtccagaacagtcctctgaagtaaatgaattgaaccaaattccttctcataaagcattaacattaacccatgacaatgttgtcaccgtgtccccttatgctctcacacacgttgcggggccctataaccattgggtctgaaggcttttctccccctcttaatgcctttgctagtgcagtgtattttttcaaggtgctgttaaaagaaagtcatgttgtcgtttactatcttcatctcacccatttcaagtctgaggtaaaaaaataataatgataacaaaacggggtgggtattcttaactgtgactatattttgacaattggtagaaggtgcacattttaagcaaaaataaaagttttatagttttaaatacataaagaaatgtttcagttaggcattaaccttgatagaatcactcagtttggtgctttaaattaagtctgtttactatgaaacaagagtcatttttagaggattttaacaggttcatgttctatgatgtaaaatcaagacacacagtgttaactctacacagcttctggtgcttaaccacatccacacagttaaaaataagctgaattattatttcatggtgccattgttccaacatcttccaatcattgctagaaaattggcatattcctttgaaataaacttatgaaatgttttctctcttaaaatatttctcctgtgtaaaataaatcattgttgttagtaatggttggaggctgttcataaattgtaaatatatattttaaaagcactttctatttttaaaagtaacttgaaataatatagtataagaatcctattgtctattgtttgtgcatatttgcatacaagagaaatcatttatccttgctgtgtagagttccatcttgttaactgcagtatgtattctaatcatgtatatggtttgtgttcttttactgtgtcctctcacattcaagtattagcaacttgcagtatataaaatagttagataatgagaagttgttaattatctctaaaattggaattaggaagcatatcaccaatactgattaacattctctttggaactaggtaagagtggtctcttcttattgaacaacctcaatttagtttcatcccacctttctcagtataatccatgagaggtgtttccaaaaggagatgagggaacaggataggtttcagaagagtcaaatgcttctaatgtctcaaggtgataaaatacaaaaactaagtagacagatatttgtactgaagtctgatacagaattagaaaaaaaaaattcttgttgaaatattttgaaaacaaattccctactatcatcacatgcctccccaaccccaagtcaaaaacaagaggaatggtactacaaacatggctttgtccattaagagctaattcatttgtttatcttagcatactagatttgggaaaatgataactcatcttttctgataattgcctatgttctaggtaacaggaaaacaggcattaagtttattttagtcttcccattttcttcctattactttattgactcattttattgcaaaacaaaaaggattacccaaacaacatgtttcgaacaaggagaattttcaatgaaatacttgattctgttaaaatgcagaggtgctataacattcaaagtgtcagattccttgggagtatggaaaacctaatggtgcttctcccttggaaatgccataggaagcccacaaccgctaacacttacaattttggtgcaaaagcaaacagttccagcaggctctctaaagaaaaactcattgtaacttattaaaataatatctggtgcaaagtatctgttttgagcttttgactaatccaagtaaaggaatatgaagggattgtaaaaaacaaaatgtccattgatagaccatcgtgtacaagtagatttctgcttgttgaatatgtaaaatagggtaattcattgacttgttttagtattttgtgtgccttagatttccgttttaagacatgtatatttttgtgagcctaaggtttcttatatacatataagtatataaataagtgattgtttattgcttcagctgcttcaacaagatatttactagtattagactatcaggaatacacccttgcgagattatgttttagattttaggccttagctcccactagaaattatttcttcaccagatttaatggataaagttttatggctctttatgcatccactcatctactcattcttcgagtctacacttattgaatgcctgcaaaatctaagtatcacttttatttttctttggatcaccacctatgacatagtaaacttgaagaataaaaactaccctcagaaatatttttaaaagaagtagcaaattatcttcagtataatccatggtaatgtatgcagtaattcaaattgatctctctctcaataggtttcttaacaatctaaacttgaaacatcaatgttaatttttggaactattgggatttgtgacgcttgttgcagtttaccaaaacaagtatttgaaaatatatagtatcaactgaaatgtttccattccgttgttgtagttaacatcatgaatggacttcttaagctgattaccccactgtgggaaccaaattggattcctactttgttggactctctttcctgattttaacaatttaccatcccattctctgccctgtgattttttttaaaagcttattcaatgttctgcagcattgtgattgtatgctggctacactgcttttagaatgctctttctcatgaagcaaggaaataaatttgtttgaaatgacattttctctcataaaactggtcatctaacattatttctacccctctattatgttttactgtaatgatcaccttttcttatacctctcttataacacttaaattgggttttaaatctgcgtttgttcatagtatgatcattgaattcactgatacatgacctcctaatagcccactcagttcataatatgctacaaacttaccaattttaatgagagaataattcctgcctattgcagaatcgtacaaaatatcatgctgcccttgatattccatttcttttttcttttttcttctttttttttttttttttgtagagactgtctcactatgttgcccaggctggtctcaaactcttggccccaagagatcctcctgcttcagcctcctaaagtgcaaggatgataggcatgagccactccacctggcctgaaattccatttctaatggctcttcagccattgttgaaatttcttttttttcttgtgcttgtctgtctcacctacctcttgtttccaattcatctacaaagtaccaaatagaccaggtcataaacataattgaaatacattcttattggaaagtgaggctatctgaaaaggcatagctgtaggcaaattattgcaacatgtttacatcttaaataactttccaacatctttgttactcagtctgcatgttgataatttcatttattaaatatagaacttcaactagatgagatccataagtaatttacttaagacataaactcaatacatatttaattgaatgcatacccttgtgtaaataagctactgatttaattcacatgactaacctactttctaacattattacagtggatttctactgataacatttcacaatagcgtgtgtgaaaataaccctgaaccagtttttaaaacaaaaattatattgactttttatctgggacataggactttattgcacgaaacttccactgacaggggcacagcatttccttcgcatgtgccaactaaatcagtagctgtatgcaaactttaatagatttatagctactaccttcaatttcacaccttgatgcatggaaatcttttttatctagatttaatacaactgtgagttttgatcttttatagagatttatgacaagagaattttgaaataagttcatatagtagtggcctctcatagcaatggaagacacctgagaaatcacagagctcaatcactggggcccagagagcagatcttaatgctagattgtaattagaatttaaatagatgaaggccactttgtgttgagaactgtagggaaacttgattttcttacccaaagggtattttatcactgggaaataaacaagtatcagatgcttataaagtataggctttcaattcccctggaactagtgttaagcatatacaagaagttataaaggcatggatgattgaaataattaaggaaagtgtatttccactgtatatactacctagccatgcttacaaagttcattcatgccctttgcctagttagcctcacaattaagccccagcatagtttattttgatgtagctgtctacatgtattggaatactattttattgcacatagcttctaaacttgcccataagtatattgaacaccagttgtgtggcacactcaaccaagtgaatgtaatcaatacgtaattgctgaaggagtctggatttatccaaatcaaattatgctccatgttgagctacctcttaacagctttagaaaatgatgtcatccattgctctggaatgcagttcagaaagtcagactcagtatgtccatcagaaattaaatttgtgtgttttcatagaatgtattgagatttattgaaatgttcttgcttttcctatatgtataaaggggaaactgagttcctttattacttcctgagatggtagagctgacttttatgcaggatatcatcactatttttgtctgcattgatagctacaaattttattattatttttttggtacaaattttaattctctacctttcagtgtctggatgactttttaattccctatttcttctgggcttccaatcatataccattgtttgcttcaaaagggatatattatactctctctagtaatccaaaggtattcctaattttgccactcctcattttcgcttctctttaagggccttatagtatgttctaatttctcatttggtagtatgcaacattcaatatttctagctctaaagttccatcattaattatttctttttttctttttttttttctttttttgagacggagtcttgctctgtcgcccaggctggagtgcggtggtgtgacctcagctcactgcaacctccgcctcccgagttcaagtgattctcctacctcagcttcccaagtagctgggattacaggtgcccgccaacacgcccggctaatttttgtattttagtagagacaggatttcactatgtaggtcaagctggtctcaaactcctgacctcaaacgatctgcccgcctcggcctctcaaagtgctgggattacaggcgtgagccaccgcaccccgccaatcacttctttatcagctatacttctttcctacctttactgtaatacttatgatcttgcttgggtcataggttttcttttagtttgttcagctatagatgacctttatgttggagcaaaactaggtccaaggtaggaatgtcattattagatgtaaaacatgttagctgatttaacccatttatgtttgaatgcaactttgaaaacccttggttaacagtgtaaagctagctttcctaaaaatagaaattttgtccttggcagctgttatgtaagtcatgacccttgtcttgttcatgagaaagaaattttgcagctgtcagattttcattttaggagaaacaatattggaaattaatttggtttcttctccatttggcaaggtatgaaccttgactagaaactctacttgttatttttcttttttctcattttactgaagctgcaatatcactaagcgcactttcattctttttacagtgttatttttcttctcattttctttaaattaaaaatctattgcttccccttctctgtcctgtctgcattcctctgatcccctacacaaatacacatggttcatttaaaaaatagcaaccatcctggtaaagctgtcttttccattgtgtcctgcaagttcttttaggtgtaacatcataagaaatcacaaacttgtattcaactcttttcagttttaggcaaattccatttttaggaataatagttaagcagtcacaagaccacaggttaatattgagtgctctctctcactttaccaatcccaacaatgtttaactcttatttattagtgtttgagtgttttatttgtgtacaaagttaaatattctaagttcttctgtatggctttactatttctaatgtaaatttactccattggaattctttggtttttggcagtaataggaattattctgtaatctgtgtgagaaatattaggaaatgaactgaaagtaattgaaagaggaggcacaagtaaaccatcagaaacgcttttgaccataagaaggggaaattaagggacagaacggaagaactgtgctcctatcagcaatctgagggttcgctctacctgcttaaaagcaagaaatatttttaatatttcttctctctactctgtactaattttatctgaaaaattgctgctgaaacttaggagccattttgaaagcaacggtagtaatcaaaggtataatcctcatgctatataatgttttagattaccaactgctttactatgtggagcgttttctgcccgttactgagggttagatggagaacactgttcccatcttagaggtgaggaacctacagatggcaagaatagcatatggctggctccaagtcacacagcaagtcaatcaatcggagactaaaatatttattacctgtagactgctaaatttctgcatcatgaacaatgacttggagagaatgttgctgagcagaaattttgtcacacctgatctgagaatataaaatttgttcatttgcaaaacatgcttctgaaatattttgtttccattatttatttagccagctagtttcttatgggtactaaagaaggtctcccaaattacctaaattccacaatagggcttagatttatgaagttttatattttttcctccttataaaaagctctttttataaagaatatccatgtaatactaaaacggggaaatctcctaaataatatattttttaatattacttttttaaaaagctagggtgagcacctcacaatcaaaatttaatgtatttgtcatattgaaatgcagggttttttgaaggaaacatggtaggtaaacattttagttcccaactcctgatcgttaaaatgcaaaattgggcctggtgtggtggctcacgcctgtaatcccagcactttgggagaccaaggcgggtggatcacgaggtcaggagttcaagaccagcctggcctagatggtgaaatccccgtctctactaaaaatacaaaaattagccgggcatggtggcagacgcctgtaaccccagctacttggtaggctgaggcagagaattgcttgaacccaggaggcggaggttgcattgagccgagattgtgccactggactccagcctgggtgacagagtgagactccatctcaaaaaaaaaaaaaaagcaaaattgttggcatctctaagacagagcaagactccctctctaagagatagtagtgtctcccacttaattgaattcgttttgttttgtttgctttgctttgattcttgccacgtaaaatctgtgggtcttgacccagagatttgctcagacagttaagaaaaataataagatgtatttgtaaatttttacataatgaaaaatgagatgtatttgtaaaattttaaaataacctctttataaatacgtttataaatataaagaggtaggatgttttggctaattagcacattctgggtcatacacacacacacacaaacaggccaaacactctagatagtcaaataaattccccttttggtgattcagttcagtaatggtgattcagttcagtaactgcctatcctcatcaatgcttgtttgtgatgatgaaatagttgacaaccgggactttacaaaaatagctcctgaaaaaaattaaatattttattgcaatatatgttcatattttttttaacttttatgaaataacattgtgataggtgctttaagaaaaatatttttccagaagtggtttatagtataaactaagggcagtttttacattgtgatgtgtgggtggatggtcatatttagttaggttattaagaaatcatgaagtgttccctaacaagaaacttgcaaagctatttggcaggaagaaaatcattaacttctagtttatttattttttttctcatgctatacgcttaattaccaagtaaattcacttgcataccattaccttaattcaaaggagaagccagaatgtttatcattggtgggagtaaaatatacacagattctttaccatggtgaaatagaataatactgaattcccaatacagaaatactaatttcataagctaatattcctatcttttagctgacttctttctctcttcaggatatatttactatttattatttacctttgaatttttgatttgggggatttttacctattgccatcctactatcttaagtatcctgtacaatgaaatatcttagcaaggaaacacttttaaaacttcacaaatatccaatttcattcttaacatatgggggaagcagtaaaagaaaaagcacttcaccacgtagaagagaaagtgatcattttaattaagataatttcaattcattatcaacatttaatcctctgcaaacaagggaacacttactagcagtacttgaagacttgtgagttggaattgcatgttacttgaaagatctaattaagctaaattttggtgcacagcaggttgtacatgatttcatgtttatgtagcaaaatgcattgaaatgtattagtgttgaaacatacatgtaaaggtagttgtggaaattgttatattttccttgtgtgtcatttatttagagcataaaggttttttttattcagcctaactgaataaggctaaatgaatactgtaattgaaaatatattttaaatctttgtcatgagtttttttaaaaaaaactattgcaaattgtatcattcctgattacacagaactttgtgggtggttttaaataaattttatacttctattttgcacctgatagtctaatttttctttccttctaaaaatcacatttaaaagttttaatattcaataaaattcacacattttaactacaaaggactataagatttaatatttggagatgactaaatgtatgcatgtgctcaccataaaaccaaaatggctagcatttgtgaaatcctcattatgtgccagaaaccttacattttatgtaaattatgtaattcccatggtgattctattaaggactcttatcagcctcattacatagatctattctgaggcttgaagttattaagttcacagccctagtaattggcagagctgttactctactcatgtccttacttggctttataattgtttcaataaacttaatacttttccttaagtctgctaaatttaaatttaattctgaatgcagtttgccaatatattttactttttttactttttttttgagacagtctcacactgtcgcctgggctggagtacagtggcacgatctcagctctgcaacctcttcctcctggttcaagcgattctcctgcctcagtctcctgagtagctgcgattataggggtgcactaccatgcctggctaatttttgtatttttaatagagacggggtttcaccatgttagccaagctggtcttaaactcctgacctcaagtgatctgcccaccactgtctcccaaagtgctgggattacaggcgtgagccattgctcctggacgccaacagtattttaaagacttcaatattaaaggttttttttactttttttttttttttctgagacagagtctcactctgtcgcccaggctggagtacagcggggcgatctcagctcactgcaacctccgcctcccaggttcaagcaattttcctgcctcagcttcctgagtagctgggactacaggtgtgcactaccatgcccggctaactttttttttttgagatggagtcttgctctgttgtccaggctggagtgcagtgggtgatctcggctcactgcaagctcttgtacctcagcctcccaagtagctgggactgcaggcatgtgccaccatgcttggctaatttttgtattttttatagagatggggttttgccgtgttggccaggctgggctcaaactcctggcctcaagtgatccacctgccttggcctcccaaagtgctgagattataggcatagccactgtgtctgacctgtatcagtgttttttaaactgtaagttacagtatatgattgtgaatgaatgagttgtgaccagcattatagaaaatgaaatagaacagaacgacatattcaaatattaggaaagtcctatttaaaattaactggttttttaacctttgaaattgtgaaatataatgccaacagaaaaatacaaatatacagcttaatgaattataacacaaataacctgtgtaacctccatccaggtcaagaagagaatattgcccatctttttatcatcttttctgtttgtcttgaatgttaataaatttcttttccttttttttttttttttttttttttgagacggagtctcactctgtcgcccaggctagagtgcagtggtgtgatctcggctcactgcaagctctgcctcctggcttcacaccattctcctgcctcagcctccccagtagctgggactacagacgcctgccaccacacccagttaatttttttgtactttttatttattttatttaatttatttatttatttattttttgagacggagtctcgctctgtcgcccaggcaggctggagggcagtggcgtgatctcggctcactgcaagctccgcctcccgggttcatgccattctcctgcctcagcctcccgagtagcagggactacaggcgcccgccaccatgcccggctaatttttttttttttttttttttttgtatttttagtagagacggggtttcaccatgttagccaggatggtccggatctcctgacctcgtgatctgccctcctcggcctcccaaagtgctgggattaccggcgtgagccaccacgcccggctttttgtattttttagtagagacgtgtttcaccgtgttagccaggatggtctccatctcctgacctggtgatccgcccgcctcggcctcccaaagtgctggaattacaggtgtgagccactgcgcccagcaatttttatatttttagtagagatggtatttcaccatgttagccaggctgttctcaaactcctgacctcaggtgaagcacctgcctcggcctcccgaagtactgggattacaagcgcgtaattttttttttttttttttttttttgagtcagagtctcactctgtcacccaagctggattgcaatggctgatctcgtctcactgcaacctccgcctcctgtgttcaagtgattctcatgcctcagactcccaagtagctgggattacaggcgtgcaccacaaagcctggctaattttttgcatttttagtagagatggggtttcactacactggccaggctggtctcgaactcctgacctcatgatccccccgtctcggcctcccaaagtgctaggattacaggcacgatccatcatgcccggcctggaaaaaaaaaaagttctgtttcatctcacacataaaaataataaagtcggccaggtgcagtggttcatgcctgtaatctcagcactttgggaggccgaggagggcagatcacgaggtcaggagatccagaccatcctggctaacacggtgaaaccccgtctctactaaaaatacaaaaaattagccgggcatggtggcgggcacctgtagtcccagctacctgtgaggctgaggcaggagaatggcgtgaacccgggaggcggagcttgcagtgagccgaaatctcgccacttgcactccagcctgggcgaaagagcaagactccatctcaaaaataataataataataatacaatctgtgtaaaatgttatgtattttctctttccatggttattacacataaattatttcataagaatgaactagtttaggccttgctagtccatgctcacctagagacaggttattgattccatatgttcctcggtgaaaaaagcacagtcatatggcatctggccaagcctttctacctactgaggctgggctatccaaaggtcccatggcatgctgacagaatcccaactctcataagaaaagacagtcggctgggcgtggtggctcacgcctgtattcgagcactttgggaggccgagttgggcagatcacgaggtcaggagttcaaggctagcctgaccaacatggtgaaaccccgtctctactaaaaatataaaattagccaggcatggtggcatggacctgtaatcccagctactgaggaggctgaggcaggacaatcacttgaacctgggaggcagaggttgcagtgagccaagatcgtgccactgcactctagcctgggtgacacaacaagactccatctcaaaaaaataaataaataaatacatctcaaaaaaaaataaataaatatttatcttcaataaagtatttctaaggaaagctaaaaaattatgtcaacatctttatttgttctgtagtttactttttttttttttttttttttgaggatccttgctctgtcactcaggctggagtgcagtggtgcaatctcagtttactgcaacctctgcctcccgagttcgagcaattctccctgcctcagcttccagagtagctgggattacaggtgcccaccactgagcctggctaatttttgtattttttagtagagatggggtttcaccatattggccaggctggttatgaactcctgacctcaggtgatccacccacctaggcctcccaaagtgctgggattacaggtgtgagccactgtgcccggcctctagtttacttttcttcttcttctttttttttttttgaaacagagtttcgctcttgttgcccaggctggagtgcaatgggtcaatctcggctcactgcaacctctgcctcctgggttcaagcaattctcctgcctcagcctcccgagtagctgggattacagtcttgcgccaccatgcctggctgattttgtaattttagtagagacagggtttctccatgttgatgaggctggtctcgaactcccaccctctggtgatctgcctgcctcggcctcccaaagtgctgggattacaggcgagagacaccacgcccagcctgtagtttacttttcataaaaattccattacaggccaggtgtggtggctcatgcctctaatcccaccaatttggggggctgaggcagtggatcacttgagctcaagagtttgagaccagcctgggcaaggtaggcaaaccccgtctctccaaaaaatacaacaaaattagccaggtgtgatggcaagcacatgtggtccaaacgacttggtatactgaggcgagaggctcacttgaacccagaaggttgaggctgcagtgaactgcgatggagccactgcactccagcctgggtaacaaagtgagaccctgcctcaaaaacaaaaacaaaaaaattggctaggtgcggtggctgacaccacacctgtaatctcagcactttgggaagccaaggcaggtggatcacctgagatcaggggttcaagaccaccctggccaacatggtgaaaccccatctctatcaaaaaaaatacaaaaaattagctgggcatggtggcgggtgcctataatcccaggtactcgggaggctgaggcaggagaatcacttgaatctgggaggcagaggttgcagtgagctgagattgcaccactgcactccagcttgggcaacagagcgagagtgcatctcaaaaaaaaaaaattatatgttactgggcatgagggtgcatgcctgtagtctcagctacccaggaggctgatgcagaaggactggtttagcctagtagtttaagtccagccagcctgggcaacatagcaagatcccatctctaaataaaaacaagcaacataaaaattgtataagaaacaataggatcatttattttttataatttcagagtgggaaaagcatgttacaaaatttgagaggcataaaataaaaaaattaccaatttaactatataaaaataatagggctgggcatggtggcttacacctataatcccagcacattgtgaggcaaggggggaggactgcttgaagccaggagttcgagaccatttcaggcaacatagtgggatcgcatctctacaaaaacttaaggcctggggaagtggctcacgcctgtaatcctagcacttcaggaggccaaggcgggcggatcacaaggtcgggagttcgaaccagcctggccaacatagtgaaactccatctctactaaaaatacaaaaaaattagccagtgtggtggtgggtgcctgtaatcccagctacttcagaggctgaggcaaggagaattgcttgatcctgtgaggtggaggttgcagtgagccaggactgtgccactgcactccagcccgggcaacattgtgagactccatctcaaaataaaaaataaaaaataaaaatggctgggcatggtaggctgagcttgtagtcccagctatttgggaggctgagatgggaggatcgcttgagccggagatgttgagactgcagtgagctgtgatagtggcgctgtacttcagcctgggtgacagagtgaaaatctgtctcaaaaaaaattttaatttaaaaaataaataataggccgggcatggtggctcatgcctgcaatcccagcacattgggaggcaggggggagcggatcccttgaggtcaggagttcgagaccagcctggcaaacaatggcgaaaccccatctctgttaaaataatacaaaaatgcctgggcctgggcaaggtggctcacgcctgtaatcccagcacttcgggaggccgaggcaggcagatcacctgaggtgaggagttcgagaccagcctgaccaacatggagaaaccctgtctctactaaaaatacaaaattagccaggtgtgttggcctgtaatcccagctgctcgggaggctgaggcaggagaatcgcttgaacccaggaggtggaggttgcggtgagctgagatcatgccattgcactccagcctaggcagcaagagtgaaactctgtccagtaaaaaaaaacaaaaaatagtaaaaatggaaccttctgtacaaaaaattttcccaaaatcaaagttgaaaaaaaaaaacaagacaaaaactaacaaaatatttgaagctcggtcaggcgcgatggctcatggctgtaatcccagcacattgggaagctgaggtgggcggatcaccggaggccaggagtttgagaccagcctgagcaacatggagaaacctcatctctactaaaaatacaaaattagccaggcgtggtggcggatgcctctaatcccagctactagggaggctgaggcaggagaatctcttgaacctgggagacgaagattgcagtgagccaagattgcgccattgcactccaggctgggcaacaacagccaaactccgtctcaaaaaaaaaaaaaaaaaaaaaaaaaatatatatatatatatatatatatatatatatatatgtatatatttgaagctcgtataacagaagattaaaataatgagctctcaataatgaataaggatcagtggcctaatggaaatagaacaaaggataggaacaattggctaatagaaaaggaaatacaaatgtctcttacaagtataaaaagatatcttcatgcatagtaagaaaaatactatagctacattaagatgccaacaatggccaccctcttttcctttcttctctttttgtgcatgacatatccttatggagtggtggcaactgttcttccaccttctggaatctcagttgacagtgttcccttcttcactttggagccctgaggtattacgagtgaaggccaggttgctctgggggaaagagaacctgagagtaatggagtactgaagtgctagattgtgacttaagaaacaacactgggccaggcacggtggctcatgcctgtaatcccagcactttgggaagccgaggtgggcagatcacctgaggtcaggagttcgagaccagcctggccaacaatgcaaaaccctgtctctactaaaaatacaaaaaaaaaaaaaaaaaaagaaacaacattgggcatgctagaatcaggtaactctagccccagttgccatgtgaatacaagaatatgagagaacttaagcaatagccagatagctgagcccagtcattccacagagccagcagatattactattttaagccactaaattttgtgatggtttgttatgccataaagcatgggataacataggcacgtgccaccacgctcagctaatttttgtatttttagtagagacgaggtttcatcatgttggccaggctggtctcaaactctaccgacctcttgatctgcctgccttggcctcccaaagtgttgggattataggcatgaaccaccacagccagccataaattggtataattcttatggaagtagaatggcagtaactattaaaatcataaatgcacgaaatctgtgaccaagcaatccttttaagaagtttgttttttttttttttttagagacagtggaggggtcttgttatgttggtaaggttggtctcgaactcttggcctcaagcaattctcccacctcgtcctcccaaagtgctaggattacagtcatgagccacttctcccagacttaagaaggtattctattgatataattatatacaagtgaaatcacataatcacgaagttgtttattgcagcactgcctatgaaagtaaagaagaataagtagctcatgcctgtaatcccagcactttgggaggccgaggcaggcagatcacctgaggtcaggagtttgagacgagcctggccaacatggtgaaaccccatctctactaaaaatacaaaaattagccaggcatagtggcatgggcctgtaattccagctatttgggaggctgagacaggagaatttcttgaaccccagagctggaggttgcagtgagctgagatcaagatatcaagatatcaagatcccaacactgcactagactccatctccaaaaaaaaaaaaaaaaaaaaaaaaaagaataaaaaggggcctaaatacctatctattttggattgagtaaatatcacatggtaaattcacaaaagaataagcacttcaatggttaaaaaaaaaaaagtgggggaggggaagcaatttatatttggatatggaacaatttcttttcttttcttttctttttttttttttttttgagaccagggtcttgctctgttgcccaggctggagttcagtggcgttatctccactcactgcagcaacctctgcctaccaggattgagtgattcttgtgcctcagcttcccgagtagctgggattacagacatgcaccaccacccctactttattttattttattttattttttgagacggagtttcgctttgtcacccaggctggagtgcagtggcccaatcttggctcactgcagcctccgcctcctgggttaaagcgattcttctgccttagccccctgagtagctgggactacaggtgcccgccaccatgcctggctaaattttgtatttttagtagagacgggttttcaccatgttggacagactgttcttgaacccctgacctcaggtcatctgtctgcctaggcctcccaaagtgccaggattacagacatgagacaatgcacccagccctagctaatttttgtatgtttagtagagacaggattttgccatgtaccccatgctggaacatggaacattttctaagatatattatttaaaaagcaagatatagtacttgtgtaaaaacggggagaaaaggatatttgccatattcacttcattctaagatgcattttataaaccacagtaaaaaattgctgtcacttttatcatgttacagactgtgagatgcatttcattttaaggaagaaagaagataaaaataaacccaaaataggatcaagaggtcagaaaggaagcaaataatgatcagagtggaaattcataaaatagaaggtagaaaaacaacagagagaatcagcaaatcaaaaagttggctctttgaaaagatcagactgggcatggtggctcacgcctgaaattgcagcactttgggaggctaagacgggcagattgcttgagctcaggagttcaagaccagcctgggcaacatgacgaaatgttagaaatttgatcttttctaagttatctcatttatagcattacaactgttaatagtattttttttccctttttatttctgtaaggtcagtagtaatgtcctcactcatttctgattctagttatttgggcgaccttcttttttttttccccgatggtcattctaggtaaagtttgtgaagttcactgattttttgttttcttcttcttttttttctcctcctcctccttcttctttcttcttctttttttttttttttttgagacggagtctcgctctgttgcccaggctggagtgcagtggcgcaatctcggctcactgcacgctctgcctcccgggttcacgccattcgcctgcctcagcctcccaagtagctgggactacagtcacccgctactacgcccggctatttttttttttttttatttttagtagagacggggtttcaccgtgttagccaggatggtcttgatctcctgacctcgtgatctgcccacctcggcctcccaaagtgctgggattacaggcgtgagccaccgcacctggccctttcttcttcttcttttttttttttttttttggaatcagggtttgactgtgcctcccaggctggagtgcagcagcatgatctcagatcacagcaacctctgcctcctgggctcaagccatgtcatggcctcagcctcccaagtagctgggactaaaggcacctgccactacatttggctgattttttttttttttttttttgagatggtgtttcactcttgttgcccaggctagagtgcaatggtgtgatctcagctcaccgcaacctcacctctgacttccccagttcaagcgattctcctgcttcagcctcctgagcagttgggattacaggcatgcgccaccatgcccggctaattttgtactttttttttcttttttttttttgagatagagtctagctctgtcgcccaggctggagtgcagtgggcgatctcggctcactgcaagctccgcctcccaggttcacaccattctcctgcctcagcctcccgagtagctgggactacaggcgcccaccaccacacccggctaattttttgtatttttagtagagacggggtttcaccatgttaagacaggatggtctcaatctcctgacctcgtgatccgtccgcctcggcctcccaaagtgctgggattacaggcgtgagccactgcacccggccctaattttgtatttttagtagagatgggggtatctccatgttggtcaggctggtctcgaactcccaacctcaggtgatctacctgcctcggcttcccaaagtgttggcactacaggcgtgagccaccgagcctggcatttttgtagagacaggtttctccatgtcacttacactggtctcaaactcctggattcaagggattcacccactgcagcctcccagagtgctgggattacaggtgtgagccaccccgcctagctaattttccggtttcttaattgccttttttttttttttttttttttgagacggagttttgctcttgttgcccagttgcccaggctggagtgcaatggcacgatctcggctcaccgcaacctccgcctcctgggttcaaacaattctcctgcctcagcctcccgagtagctgggattacagacatgcaccacgcctggctaattttgtattcttaattggcttttttaaaaaaattattgccgagatggtggctcatgcctgtaatcccagcacttttggaggctgaggtgggtggatcacgaggtcgggagtttgagaccagcctggccaacatggtgaaaccgtctctagtaaaaatacaaaaaattagccgggtgtcgtggcgcgcgcctgtagtctcagctattcaggaagctaaggcagaagaatcacttgaacccgggaggtggaggttgcagtgagctgagagctgagatcgtaccactgaactccagcttgggcaacacagcgagagtccgtcccaaaaagaaaaagaaaattattattattggccaggcatggcggcttacacctgtaatcccagcactgtgggaggctgaagcgggtggataacctgaggaccagagtaggagaccagcctggccaacatggtgaaaccctgtctctactacaaataccaaaaattagccgagcgtggtcgcacacacctgtaaccccagctacttgggatgctgaggcaagagaattacctgaaccccgggaggtaaagattgcagtgttctgagatcacaccattgcactccagcctgggcaacaggagtgtaactccatctcaaaatatatatatatatattattattattttggtaatttttttagtattaactttttttttttttgagatggagtctcattctgttgcccaggctggagtgcagtggcgtgatctcagctcactgcaacctccgcctcctgggctcaagccattctcctgcctcagcctcctaagtagctgggattacaggtgtgcgtcaccaagtccagctaatttttgtatttttagtagagatgggttttcaccatgttggtcaggctggtctcaaactcctgacctcatgatccgcctgcctcagcctcccaaagtgctgggattacaggtgtgagccacagcgcctaggcagtattatcttttctacaagctattaattgccttcagctcaaagtaattgttacgtcaaagaggcatgttttgtgatgacatattctggtttccttcaactcacagcagcattattcatactagccccaaagtagaaaaacttaatagatgaactaatgagtggataagcaaaatgtggtatatctattgtgttaaagaaaagtttttttttatctgtttgtagtcataattgtgatggttgagttttcatgtgtgagatgtgtatcactcaagcctttttacaatgtcggtatattgccgggtgcggtggctcatgcctgtaatcccagcactttgggaggccgagacgtgcggaacacctgaggttgggagttcgagaccaggctgaccaacatggagaacccatatttctactaaaaatacaaaattagccgtgcgtggtggtgcatgcctgtaatcccagctactcgtgaggctgaggcagagaatcacttgaacccgggaggcggaggttgcaatgagccaagattgcgccattgcactccagcttgggcaacaagagcaaatactccatctcaaaaaaaaaaaaaaaaaaagtctgtatattacataaaaaaaaaaaaaaaaaagaggccgggcgcagtggctcatgcctgtaatcccaacactttgagaggccaaggtgggcagatcacgaggtcaggagtttgagaccagcctggccaatatggtgaaaccccatctctactaaaaatacaaaaattagccgggtgtggtggcgggcgcctgtagtcccagctactcaggagcctgaggcaggagaatcgcttgaacccgggacgtggaggttgcagtgagccgagatcacaccactgcactccagcctgggtgacagagtgagacactatctcaaaaaaaaaaaaaaaaaaattaaaagaaaaagaagaaaaatcagtgacatttgttaaagcatgataaggaagactttacttgggaccattatgattatgtatagggaccactacagtgggattttacagtggggaacagagttggcctaaactctgaatacaacatgggcacgggggaatttatagccaaggagcagtttagggtcagtggatagaaaattactaagggccaggctcacatctgtaatcctagcactttgggagggtgaggcaggaggattgcttgaggctagagttcgtgacccgcctaagcaacaaagtgagatccccatctctacaaaaaaattattgcaaaaatcagccaggcgtggtggcacacgcttgcagtcctagccacttgggaggctgaggtggacagatttctcgaatctagcagatcaaggccgcaatgagccgtgatcttgccactgcactcgagcactgctgcctgggtgacagagtgaaactttgtctcaaaaaagaaaagaaaagggccgggcgcggtggctcacgcttgtaatcccagcactttgggaggccgaggcgggcggatcacgaggtcagaagatcgagaccatcctggctaacacggtgaaaccccgtctctactaaaaatacaaaaaaaattagccgggcgtgatggcgggtgcttgtagtcccagctactcgggaggctgaggcaggagaatggcgtgaacccgggaggcggagcttgcagtgagccgagattgcgccactgcactcccacctgggccacagagcgagactctgtctcaaaaaaaaaaaaaaaaaaaaaaaaaaaaagaaaagaaaagaaaagaacattactaacaggtaacatcagagtccggggattctgactaaactcattcaacaggattcttgctgaagacaggtggaggtgatgagacatcactctagtggttggtggaggatgaggaacttgaccagatattgagggtgattagatatcaaatgtagggggttcttgggctgggcgcggtgtctcatgcctgtaatcccagcactttgggaggctgagccgggcagatcacttgaggtcaggagttcgagaccagcctggccaacatggtgaaaccctgtctctgctaaaaatacaaaaattagctgggaatggtggtgtgtgcctataattccagctactcgggaagctgagacatgagaattgcttgaaaccaggaggcagaggttgcagtgagctgagatcacgccactgcactccggcctgggctacagagtgacactatgtctcaaaaaaaaaaaaaaaagggttgggggagctcttgacaaacttacttaacagggttctttgctaaaactagattttagctgggtacagtggtgcacacttttagtcccagctactcaggaggctaagtccagaggaatgcctgaggccaggagtttgagactacagtgtgctatgattgcacctgtgaatagccactgcataccagcctgggcaccatgcgaagaccctatctttcaaaaaacggtaaatacaagtaaaagtgggttttaagtgcacaggtgggcctaggtcaaggtgaggagcctgactaaagtttggtcaagcagagaatgtctgtcagtctcttatcttgcttttttttttttttttttttttttgagacagagtctcgctctgtcacccaggctggagtgcagtggcacaatctcagcacactgcaacctccacttcccgggttcaaaggattctcctgcctcagcctctggagcagctgggactacaggtgcatgccaccatgcctggcttatttttgcatttttagtagagacgggatttcaccatgttggccaggctggtctcgaactcctgacctcaggtgatccacctgccttggcctcccaatcaactaaccttccttccttccctactccctccctctctcccttccttccttctttcctctctctttctttccctccctccctttcttttttctttccttcctttttcctttttttttttgagacagggtgtcactctgtcacccagaccagagtgcagtgacgccatctaggctcactgcaacctccgtctctcaggctcaagtgatcctcctacctcagcctccagaatagctggtactacagggtgcatgccaccacacctggctaatttttgtttttgttttttttttgtagagatggggtcttgccatgttgcccaggctagtctcttctcttttctttcctttgcacaatttaagtctgttttttcattcaatcaccttttattctttaaggaccagctgaatcatctgttgggccttggtagcagagaatattcaccggattgttagcggtcaagaatttaacaagggggaatttctatgaaaataaagaaaaataacgattaatagaaacccagtttctgaatctagagggcagtgagtcaataagatttttagatgttgggcttgaggatagcaacccaatggatttcctggtttatggtttgaatgtctctggtaatgacatttggtgtttctgatgaagtttctgattggtccacccagtagcatgcacaaagttgatttcttttaagtttatatcacattttccagcttcggctagcaaggcgctgggaaaatgagcagttttaatattttgtgactctaagccataagggtggaaaaaaaaattggaaataatagtttggagagtcatagccagatactgaaggaaactagaagaatttaggatccaggtcagtccgcagatagacctctaagacgatgaacaagactagaattttttttttttttatgagacggagtttcgctattgttgcccaggctggagtgcaacagcacgatctcagctcactgcaacctctgcctcctgggttcaagcaattctcctgcctcagcctcccgagtagctgggattacaggcacctgccaccacgcccagctaattttgtatttttagtacagacagggtttcaccatgttggtcaggctggtcttgaactcccgacctcaggtgatccgcccacctcggcttcccaaagtgctgcgattacaggcatgagccactgtgcctggccaagactagaacttgataatcacgaggatgttctatagttttccattgaaactatattgtctctaaaatcaccgttatttttattaaagatgatcaaaggctgacttgtttgcaaagtaagtctagtcattaaacttgacctcattatttacataagtatagcaagaatagtgattgattttgatcttaggctttttatttttattattatttttttgagagtctcactctgttacccaggctgaagtgcaatggtgtgatctcgcttcactgcaacctctgcctcccaggtttaagcgattcccttgcctcagcctcccaagtagctgggattacatgtgcccactaccacacccggctaattttttgtttttttttagtagagacggggttttgccacgttggccaggctggtctcgaactcctgactttagacgatatgcccaccttggctttccaaagtgctggggttacaggcgtgagccaccacccctggccagaatcttaagaatctgagaatcttaggacagctttcttcggctccacaattcttccatcctccttgtgtgaccttgcattcatgttgtatccaccgtcttcacagtggcatacatgacaaactgaaagcccctggactgtttggtgtttggatctctcattactacacaatctgagtgctccccattgtttaaaatggctcctcaggctctctcaccagttccccctccccttccccctcccctcccctcctctcccctcccctccccttctctcccctctcctcccccttttcttagaaggagtcttgctctgtcgcccaggctggagtgcaagggtgcgatcttggctcactgcaacctccgcctcttgggttcaagtgattctcctgcctcagcctctggagtagctgggattacaggtcatgccatcacacccagctaattttatcagttgtttcaaagcccagtcctctgctgaagagcttccataggtgttcaggctcacaatgacaatgaaaagagagagtttaattttaatttttaaaaatagagacaagggtcttgctatgttgcctaggctggtgttgaactttcggcttcaagcaatcctcccacgtcagcctctcaaagtgttgggattacaggtgtgagccactgtgcttgtccagaagagagactttcaggattcttcctcagtgggttcatagggaaaggaataaacgaaggaacatatctctcaaattggacttttaaaagccctttggccaagcgcggtggctcacgcctgtaatcccagcactttgggaggccgaggcgggcggatcacgaggttaggagatcgagaccactctggctaacactaaaaacactggtttttcttttagtagagaaactctgtctctactaaaagtacaaaaactaattagccaggcatggtggcgggcgcagtggcgggtgcctgtagttctagctacttgagaggctgaggcccgagaatggcgtgaacccggggggcggagcttgcagtgagccgaggtcgcgccactgcactccagcctgggagacagagtgagactccgtctcaaaaaataaatgaataaataaataaaataaaaaagccctttaagggtatgaagcccagccaaggacctgccatcagattttgcttgcaatacctatggatttgggtgaattcctcttaagaggctaaagtatcttaagccccaaagcatcttaaggtttctgagcctgccagaaagtgacatcccttactcacttaaaagccagaccttattggctccataaagtgaagcttattttttttaagttgtctgatcatatttgaaaatatgacatatgggttaaagtcttggcaataaaaccaatgtctctaattgtgtagtgctacaaggttatcaaattcatattgaatttatgcgtattactatactgtcatgaaaataagaatactaatagtttctgaattctggagggatcagatagggagaaaaaaataagttttatctttgttcacaatggtatattttaccaaattgctgtaagctatagatagcttaagagaaaatagaaagattccttaaatttggaaaaaatattaaagaatgcgcaatgtggccgggcgcggtggctcacgtctttaatcccaatactttgggaggccgaggcgggtggatcacgaggtcaggagatcgagaccatcctggctaacatggtgaaaccccgtctctactaaaagtacaaaaaattagccgggcgtggcggcgggcgcctgtagccacagctactccggaggctgaggcaggagaacggcgtgaacccgggaggcggagcttgcagtgagccgagattgcgccactgcactccagcctgggggacagagcgagactccgcctcaaaaagagaaagaagaaagaaaggaaagaaaaaaaaagagaagaaagaaagaaagagaaagaaagaaagcgcaatgttagccataaaatggaatgagttctgatacatgccacaacatggatgaaccctgaaatcaatgtgctaaaacaaagaaaaccaacacataaaaggccacatattgtatgatcctatttataggaaatgtctaagacacagaaatgttagtggttgactgagactgggaagagcagggattagggggctgttgcttaacaggtatgggtttctttttctggtgatataaaggttcttgaagtagtggtagggatggttgcacaaccttatgactatactaaaagccactgaattgtactttttttttgagatggaatgttgcttttgttgcccaggctggagtgcaatggcgttatctcagctcactgcaacctccgcctcctgggttcaagcaattctcctgcctcagccccctgagtagcgggattataggcatgcgccaccacgcctggctaatttttgtatttttagtagaggtggggtttcactttgttggccagactggtcttgaactcctgacctcaggtgatccacctgcctcggcctcccaaagggctgggattacaggcgtgagccaccgtgcccagcctgaattgtgctttaagatattttaaatagtgaattgtatgttaagtaaattttatgtcaatttttaagacgagttaagaatgttacagggtataactagttcaactattgtggaagacagtgtggcgattcctcaaggatctagaactagaaataccatttgacccagccatcccattactgggcatatacccaaaggattataaatcatgctgctataaagacacatgcacacgtatgtttatagtggcactatccacaatagcaaagtcttggaactaacccaaatgtccatcagtgatagactggattaagaaaatgtggcacatatacaccatggaataccatgcagccataaaaaaggttgagttcttgtcctttgtagggaggacatggatgaagctagaaaccatttttttttttttttttgagtcggagtctcactctattgccagggctggagtgcagtggcgcgatctcggctcactgcaagctccacttcccgggttcacgccattctcccgcctcagcctcctgagtagctgggactacaggcgcctgccaccacacccggctaatttttttgtatttttagtagagatggggtttcaccatgttagccagtatggtctcgatctcctgacctcgtgatccgcccgcctcggcctcccaaagtgctgggattacaggcgtgagccaccgcgcccggcgaaaccatcattctgagtaaagtatcgcaaggacagaaaaccaaacaccgcatgttctctcataggtgggaagtgaacaatgagaacacttggacacagggtggggaacatcacacaccggggcctgtcgtggggtggggggaggggggagggatagcattaggagagatacgtcatgtaaatgacgacttaacgggtgcagcacaccaacatggcacatgtatacatatgtaacaaacctgcacgttgtgcacatgtaccctataacttaaagtataataataatttaaaaaaagaatgttacggggcatatcctttctctcaaataatggaacgaggttaaaaaaaaaaggttaaacataaaatggcggcgggctggatcggatcacgtgaccgccatttctttccttcccacccaaaggaaagcccttccttcagagcaagcgcaagacatatagccccgctcattgttaagcgaggccaaggcaacccttaggcgcgctctatttcccctttcgtagcgaaagggccaggcgtattgagcggtcaggggagcgcgcacgcagaacgtcagccagtaagcgccgttcctccgggagatgtggaggaggggggcggcgtggaggaagagggggaagttggcgcatgcgcctaaagctgacgggtttgaaatggcttcgatgttagccgggacccgactcaggtgaaggtctggtccccgtagttggagcagtgggcggccaagccgggtctcttaacatcttgtcgaatctgtggaagggccgggagcgatcttttgggtagcccggcggccccgggcggcgacggtggggctcttgtgggactgggacgggagggacgcggtcccttttgtgcgggtcggagcaggcccggcgcggccagccccacccccaccgctcggctcctcaggtgcccccagcgcccctcagcctcggcatggcgacgctgcagtccgccgccccattgctcccgagccgctgcggttttaccctcctggccccccggcccgggacatcgtggcggctcccggcggcgtgggtcttggggaatagaggctttctccgtgcgtggtaaacgagcccagggctctcgggagccatcgagtgtcgtggggcggtgggttccgccttccgtcgccggcggccggcacggagctgggactggaggaagatggacggccgagctctggcccttgagggtcgtggcggccgaggagggggtgcacgggcggagaatcttcgccttttctggtttatcttggggggaggggttttcccagtggttctttaagggacatccattatctcaacggccttttccttcgaggtcggggttggaaaagaagccccctaggttccttttctactttggaaagtagagatgttcgttatttaaatgatatctttaaatacctgtgatgggggtcttgtcccagtatccgttattggttttaacattaccctggcctcactccccaacccattgccagaagaaacacgcaggctgtatttcctgtgaatataaagttgtgaactttttgttaacaattgggtggatacagcagatggtcttcgtttaaatgtgacaacttgtagtcccagaaaggagtgctttttctgagtctccctctaatgttatcttgtaaaatagggcatttttggtgatctacttgatgtaaaatgtttttgctgcattttggatgttcatttgccctttttctacttaacagttgttatttctgctgaaatctgcgaagacgtcctcgacacattaaacatttctttctattgtaatatccttttgtgatatctgtagcttggttggactttaaaatgtggatccttttcttgatagatcgatgctatagaagacaaacaagggaaggttttttttccttttgcatcatggctcaatttggaggacagaagaatccgccatgggctactcagtttacagccactgcagtatcacagccaggtcaggcttctaaatacatgtactgtaattgtttgtgggggacttgttaaaactacgtgaattagggccgggggtggtggctcacgcctgttatcctagcactttgggaagcggaggaggtggatcacgaggtcaggagttcgtaaccagcctggccaacatggtgaaaccccgtctctactaaaaatactaaaattagccgggcctggtggcacgcgcccataatcctagctactcaggaggctgaggcaggagaatcccttgaacccgggaggtggaggttgcagttagctgagatcgcgccactgcactccagcctgggcgacagagagatactccgtctcaaaaaaacaaaacaaaacaacatgaattaggctgttctgatattctgatattgtaaagtgtttgcaaattgtgaattcattaactttctctgtgaagctcctttaaaaatccatagatcaactaacaagctgttttacatagtagtttggacagttttgtagttttttttttccccaaacatttatttttttatttatttttatttttatttatttatttttttgagtcttgctctgtcgcccaggctggagtgcagtgacgcaatctcagctcactgcaagctccgcctcccgggttcacgccattctcctgcctcagcctcctgagtagctgggactacaggcacccgccaccacgcccggctaattttttttttttttgtatttttagtagagacggggtttcaccgtcttagccaggatggtctcgatctcctgaccttgcgatatgcccgcctcggcctcccgaagtgctgggattacaggcgtaagccaccgcacccggcagttttgtagttttttaataccttagattaacttttaattgatttaattctgttagagtttagctactcattcattacaatatactgtatttggcatgttaagttgtcagtattaatgagttatgtttaaaagtaaatgggccgggcgcggtgactcatgcctgtaatcccagcactttgggaggccaaggcgggcagatcacaaggtcaggaaatcgagaccatcctggcttacatggtgtaaccccgtctctactaaaaatacaaaaaattagtcgggcatggtggcaggcacctgtagtcccagttactcgggatgctgaggcaggagaatggcgtgaacccaggaggtgaagcttgcagcgagctgagatcgcgccactgcacttcagcctgggtgacagagcaggactccatctcaaaaagaaaaaaaaaaaaaggtaaatttaggctgggcgcggtggcttgtgcctgtaatcccagcactttgggaggctgaggtgggtggatcacctgaagtcaggagttcaagaccagcctgaccaacatggagaaaccctgtctctactaaaaatacaaaactggctgggcatggtggtgcatgcctgtaatcctaactacttgggaggctgaagctggagaatcgcttgaacgtgggaggcagaggttacagtgagccgagatcacaccaccgcactccagcctgggcaacaagagcaaaactctgtctcagaaaaaaaaaaaatgtatttaggctaggtgaggtgtctcatgcctgtaatcccagcattttgggaggccaaggtgggcagatcacctgaggtcaggagttcggagaccagcctggctgacatggtgaaatcctatgtctacctaaaaaatataaaagttagcttggcgtgtttgtgcaagcctgtaatcccagctactcatgaggctgaggcaggagaagtacttgaaccggggaggcagaggttgagtgagctgatatcgcaacgctacactccagtctgggtgataaagggagactctccccaaaaaaattgagtcggaggtctcactttgttacccaggtggatcttgaacttttgggctcacgcgatcctcccatcttggcctcctaaagtgctgggattacaggtgtgaaccaccaggactagccagttgtttgaatttaaagttgaaaaactacattcaaaaaaaaaaatcacctggacctggtgttatgtacctgtggttctagctattcagggaggttgaggtagaaggattgcttgagccagggaggtcaaggttgcagtgagccatgatggtgccattgcactacagtctgagtgagacctggtctcaaaaaaggtaaagaaaaagaaagaaaaccaactctaaagaatttagttactagacaaaggaaaaagatagttgtaaaagctgctggatgcagtggctcactcctgtaatcccagcactttgggaggccaaggcgggcagatcacctgaggttgggagttcaagaccagcctgacaaacatggagaaaccccgtctctactaaaaatacaaaggtagcctggcgtggtggcacgtgtctgtaatcccaactacttgggatgctgaagcaggaaaatctcttgaacccggcggaggttgcggtgagctcagatgctcagattgcgccattgcgctctagcctgggcaacgagagaaactccgtctcaaaaaaaaaaaatagttgtaaaagcagtaaaagaacatttacattttcaaaataaagtcaacaaggcccggtgcagcactttgggaggcggaggtgggcatatcactgaggtcgggagttcgagaccagcttgaccaacacagtgaaacctcctctctactaaaaatacaaaaattagacgggcgtggcagaggttgcagtgagccgagatggcaccactgtactccagcctgagcagcagagtgagactccagctcaaaaaaaataaataaaaataaagtcaacaaaacgtcattttcaaagtaaatagaaaatgttattgaagctttaaattcttcccaatctttttaggaagaatttttttttttggtcattttttgacttatttgttgaatctcaaaagctttaactcctgtagattcagaattttttacttgaatgaaaccagttgtgtttagggatttcaaataagtttcccaagaattctacagaatgagattttgattgtcttttaatttgaatatatttttatttattttatatctcttactctttgctgcattttacttgcttaaaatatcttttttaattcgaggtcaatttcggagacactgtgatcttctaacttcagtgttccaaaatttgatggaaatgattagttatcttggtgacctttctctttaaagacgtggagacctggcacagtggctcatgtatgtaatcccagcactttgggaggctgaggcaggaggatcagttgcatccaggagtccaagaccagcctgggcaatataacgaaaccccatctgcagaaactcaaaaattagccaggtgtggtagagcacgcctgtagtcccagctattggggaggctgaggcgtgaagatcgcttaaaccttgggaggtctaggctacagtgagctgtgatagttccgccatattccagcctgggtgacagagtgagaccctgtcctaaaaaaaaaaaaaaaaaaaagaaatgggtacttcagggttttaattttttttttttgagattgagtctcgctctgttgcccaggctggagtgcagtggcatgatcttggctcactgcaagctccacctcctgggttcaagcgattctcgtgcctcagcctcccaagtagctgggactataggcgtgtggcagcaagcccggctgattttttatattattagtagagactgggtttcaccctgttagccaagatggtcttgatctcctgaccttgtgatccgcccacctcggcctcccaaagtgctgggattacaggcgtgagccactgcgcctggctcttgacatgcttaaacctttgtatcctaatccacagtgcttaccatagatccttacttccctaaggaagcttttctcctcccatctctggcttggtggtgatactctatctttagtattattattttaaattctaactgcttacttttatttgtttttctctcttagttactatgtgtgataatccttatttttcctccagctccagtgcatccatcagatctgatattcctaaaacatagtttctgtcaaaatcacagaattttggctgggcgtggtgactcatgcctgtaatcccagcactttgggaggccaaggcaggcagatcacgaggtcaggagtccgagaccagcttggccaacatggtgaaaccccgtctctactaaaaatacaaaaattagccggacatagtggtgtgcatctgtaatcccagctattcgggaggctgaggcaggagaatcacttgaacctggaggcagaggttgcagtgagcccagatcgtgccactgcactccagcctgggtgatgagcaagacttcctctcaaaaaaaaataaaaataaaaaaataaattcacagaatttttttcaaagctggatcaggcctaaactagatttttttttttgtttttttttttttgacagagtcttgctctgtcacccaggctggagtgcagtggcacgatctgggctcactgcaatctctgcctcccgggttcaagtgattcttgtgcctcagcctttgggactgtagctgggactacaggcgcgtgccaccactcccggctaattttgtgggttttatttttagtaaacatggggttttgccatcttgcccaggctggtcttgaattcctgagctcagacaatccgcccatcgtggcctcccaaagctaagctagattctatcccaacttaattctctaagagatgaggaaattgaggccaaggacggtgaaaaaaatttgtttacgtctcacaggaggtcatagcagagtcagtgttaggacctcagaattgtggttcattttatcttctatttcttcattttctcattcgtctgcaaaagtatcttcaaagagttttagaatacagttcagattctaggatggtattcaaggtcttatttttgtggccctgtttttcatttttctcaccccttgaaatatattcttaatatttaccgtatttttccatatcctacctgaagtgctttgatacgtcttcagtgacagccattctagggaccagagcttttagttttgaaaatttctgttgtgtaaagagacgttgagagaaatggccaatgactcaccagtcagtgaccagtcaatcaaatctttaagtagcccttatatcaattatcttattttatttttttgaacatggagtctcgctctgtctgctcaggctggagtctgtctcactctgcctaggctggagttcagtggcatgatctcagctcactgtaacttctgcctccagggttcaagcaattctcctgcctcagcctcctgaatatctggggctataggcttgctaccatacccggctaatttttgtatatttagtagagacacggtttcaccatgttgtccaggctgctcttgaacttctgacctcaggtaatccatccgccttggcctcccaaaatgctgggattacaggtgtgagccactgtgcccggccttagatcaattattgattatagaggtaccttcagtatatttgatgaaaaatatttacatgtgtatctgtatttaaactattaaaatatggaggtggatttaccagattcagacctattgtcacccatttcatatatttttttaaacatccatttcattttttgattttttttttttaatctttttagctaagggaaaaagacatccaaaaataatcctggaggtttttttttccgttgtttttgtttgtttgttttttgagacagggtctcactttgttgcctaggctggtctcaaatttctgccttcaagggat

SEQ ID NO: 183 - DNA, 101934 bp, Homo sapiens
ccctgttccagggaccctgaagaccagccctgcaatgtgtgcatagggggtcctatttggtgctgagagagacagggtctagagcatagagttggatttctgcacagtgaaagcaggactgaagtctggtctttaaagatttcctccttttcatgatatggcccactgtcattgtcattgttatcactgacaatgatgacatctcttcaagattaataggtttcagacttatagtgttaccatcctgggaacaggacctagacacctgtgaggttccaattattgacctaaacggttgacaattggaggacctagctgttcctctaactcttggggtcctactttcacctgaatgatggattgatttgttccatcaatcaaatgtgtgaaaatgacagtggagcttcctgctctttaaaagttggtggtagaaatcatagctgtcatattgatcttagctttgccacctactagctatatgatttaagtatgttattttaccacactaagcctcagtttccttacctgtaaaacagcaatgacgaaaatgtctaccagtaggatatgtgagcatctagcacatagtaagtgtccaataaatgtgaggaggaggatgataatgatgatcatgatggtggtgatagtggtggtggtggtgatggttatgatcatggtggtggtggtgatagtgatgacaaatgatggtggtggtaatgatggtgataatagcaatgatggtaatgatggtggtaatgatggtgataatgatgatgaaggtggtgatggtgagagtgatgataatggtaatgatgatggtgatggtaattatggtgatggtgatgatggtaatgatgatggtgatgatggcaatgatgatgagggtgatgatggtgatggtagttacggtgatggtggtgatggtgatgatggtggtgatggtgatgatggtggtgatggtggtgatggtggtgatgatggtgatgatggtgatgatggtgatgagggtgatgataatggtaattatggtaatggtaatgcaatgatggcaatgatggtgatgatggtgctggtgatgatggtggtgatgatggtgatggggatcacgacggtggtgatttaggaccagaatctccttcagtgggaaatctgtctacttcaagacttttgtgattaatgaaagaaaaagtataactctggctaaatttatatgggttaaacaaagcattaattaattaataaatgcccatttgtcattgtcttatgttcaggttagttaattgtccttgaagaaaatgctggtttagtgatctaatgctctttcttagacactgcaatagtgttgcccctgaaaagtaataatcttttggttttgttattgtttcctaggataactttctttgggatccttttgatatactaagagcatctgtgaggatagccgaataactattaggctgaaaaaaaatagtattaaggcagcgaaaatactttagctgtgaaactaaacaatacatatatgaagtccttagcatcatttagggctgttaaatatatgtgatgtgacattacaaagcaatttgagatgatttccttagtatgcatgatggaaatgattcataattaccccaaataccatttcttaggtattgtttttatgcatgtattaattatggctgtggttgtttttgtttagagatgctttgtactccagtttgtcttcttaggcacagccttgcctgtgatggggcaagtctcaggatgtgggtttcttgcattggccactggtcccactgggtgaggatggaggtgtcattggtatagaaggtagggaatttgtgatgaaacttgcatcttttgaaaagttttgttttgtacagtgctctgaaatttgtcttttatatatgcgtgacgcaatctagttgcacatgttgcagctaaaagcggaaccaactaattgaacattttcagagtctgacggaaatggtgggtgccagcattcctagtctatcatccagttagtttggaggcttgggtaagtgccaggtacggtaagaaatgaccactttctcccagaactcacatctagccttcactcctgtaatagaaacagggatttgttgagcggctgcgataggtaggaattctgctagcagacagggacacaggacaagggcaaagtccctgccctgaaggagatctttacctacatgagtttcttttcatgctgcttttctgcagacacacacattttcctctcagctatttatccctttgccatgcacactgatatctgggaggttaatcaacttgagggacacatggttcattttggaaagcagctgcaattctttgcaaagaggtttctagacctgtttttgagaatatttaaatcgctgagccaaaagccagtgtgactgtccttcctgccctaggtgagtgtgctgggaagccaccgaggacattgatcttggctcttctttgtatcagtgattgagaaaacaaacactatgctggagagccactgaacgctctccctgaaggcaaagatttgctttatctaaaattttccattgcgtccaggagcaaatctgcatcacagcaatttactattttctgctccaggaactggaaaacacaagcttgagctacgttagctgcttccacgaaacgtgctgtcatcactgaaacacatgtattttttttttttcaggattccaggttgagggaaatttgcttttgattgtttaattgcattattatagatttttagtggcatctctggcctccatctactagcaacctccagacagtgtcaaatgttccctgggggggcaacatcacccccaggtgaaaatcattgccctagaaataatgaagatcattattagtcctctaagcacattccatgttctcagtacatccctatttaaagactaacacaagtgggtttctggtgacttgcacaggaaactgagtccttatgctgcaaaatgttggagtctttcttttaagtgacccttggcagtgcagaatgctgatgtcaaaatataatcaaaagctcattccgggcttctgggtagagttccaaatcctccagattatattagttcattatagcagaccatgctggggcttttccagttgacaaattagatttttttgaaagcatggcagttggatttatgaaaatatttaggattaaaggggaggatgagggaaactaattttctcttgtcatgaatgcccttaattgaattttagaaactgtttgaaagagcaaggtgaatgctagacagaaggttgtaaagatgtgcagataggtcgaagtaaaaacacatccgagatgctttaaggacccagagaaaaatcagccgcaatgaacacttactttagctaattttatgtgtcaactcggctgggtcatgatgcccagatatgtggttaaacattatcctacatgtttctataaggatgttttgggatgagattaacatttaaatcagtagactttctgagtcaagcggactgtcctccattatgtgggtgggccacatccaatcagttgaaggcttgaatagaacagaagattgaccttccctgagcaagagggattctgccagcagacagctttcggacttgaacagcagcaccagctcttcctgggcctccagcttcctgccatccctgcagatatgggatttgctaggctccatactctcatgagccaattccttaaaataagtctcttcctatatgtgtagcatgtgtgtgtacacacggataaacatgtacacacacacacacacacacaccctactggttctggaggacctggcgaatacaactgtgatgaggatgtctcaagttcgcaaagcctcatgattcgccaccaccaccaactccctccctccctccccattcttcaggcgcatatggctgccggcgcctcctgggagggttacaaaatgcctatttttttgttttgttttgttttgtttttgtttttatactgcagaggtcagcaggatgccaagtcttagggaaaaagtttactttcgaatttgtaaaaagcagcatttaaccagcacagcagctgtgaagacaagaaaagctgcagaacagcagaatagcatgggctgccgaggcagaggcagatgctttaacaataaccaatgaatgacaaacccactgggtctggccctatctccccatggctctgctctctcgcccccaatccctgccctttctcaggctgcctgcgtggcgctcatccaggcctgggtgtgccctctgcttggctggtggtcattccacggtctccttgaccaggttcctgtccaagccatgggcacatcacaccctgtagcttcacttcctgatacacacacgggggttcacctggtgcccaaacctagtaagtggcaggaggcaactgaacctgagccctgcctgagcttccgggttctgcggtccaggcactggctccatcaggggccggttttagtttgaagaactggagctaaggaggttctttgaaatggtgtcgaggtggcagaactccaggacacatttgaatagggtccctgttctccttcctccctggacccagaaaggaaatgtcccagggattctctccctccaggaggggtctgcggagagagggggtggccccagggacctagcctctgggtcagggtggagcaacagggatgtcccaggggcacattgcaggcacagggaggggctgcttgcttctcgggtggtcgcaggggagagctcagggcttgtggtccatggggcagcagatgaatgagtcaggggcactggaaaacgatgtgctcctcttggtaacccctccagtcttggatcattccagtaacacttgtaaacgttatgaagaaatttatcagcgaaaacattcaaggcgctgtgctttgtgctggggccacctgagtccagagactgcggtggatggcatgcgggaaccagaggcacgcacgcgccgctgacctctgggtgacaggtagcccctggagggtccttagggcccagcaccctcctgcccatccctgctccgccaacactcacctgggcccctggcctcctctccatctcctcattgtttctgaacacagtcttgattggcattgatccaaccatccctttctggaatcttcttgccaactgcaaatctctgtacccctctagcaccctttgtccatactgggacccctgtcctcatgatcccagtcacgcctctcatttactgagcatctgtattaaccatgaggttagcgtgtatgacttcttttcatgctcacaaaactgagaatgcagaggtgcaattgggtaggtggagactggggtccagagacgctgatggaggagcctcttgctccagcagggctgaagtttgagcctgggcaggggtgactctagagcctgtgcttgccccggtgcagtgccatcccccctctcccttcctcaagcctgccattcaccatctggcctttaccacacataggtgctcacgaccctgtcttccccggctctgcacagcagaggacagcttgtcccccacactgtgtccctaatccaggggcagcagctaagcagagcttcttgctccctgtgggggtttttaggtcaccatttgtcctccttacaggtctcctttctccgtgttttatgccttctgtttaagctcagcctttcccggtccttactgctgtcatctaatcacccctgggatgtgctgcttccctgaggatttcagtatcagtttcatagtctctggggtctcagcatccacactgacccttccaggttttctcttttcctcgactttcctcaaatggctccttgccatcctgctgactagctcccctgagtttctctgactgccagtctctcttgcctccttcagacccccgagctgccctttccatgatatctgtcccttctgggctagcaggtgataacgtttgtttggtaattgaacataagcctttacggtgacactgcctgcgtgcaagtcccaagtcttccaagcctcagtttcctcatcttgtaaatgggtatgacaacatggggatccatctcctggagcagatggtgcgcgtctatggctcagacagtaacgcacgcctgcacagaaggagcacctggtgtgagtcagccatccctgtcccctgggctgggtcccgggctcagtgattgtgggcactgtgggaagcgctcttgatccttcggcccatggccatgctctggccccatgttaatccccacgcttcactgcaggcagcctctacctcttccaaactcccccggtcatggctagagaaagtcctaagactggatgcatcacttccactacagatccactctcctgtctcagctccgtctttccaggctcagtaatctttcgaatcatccgttagtggccttgcatctcaaacaacctgatcttctcagcgccctattctgcagaagctttctcataggtttgttgagaaggctggctgtacatctgcggtgggtgctctctgctgtcctcttcccaacctcagtgtgactttcctgcgtccacattgacttctgtccctctcgcctcccctcaagggtgaccttcctgctctggctcatgaactcaccctctgtggggccccgggacctctgctgtcaatgaacatcatgcagttgttctctttcttatgccttaaatcactctggggcctttccccacaaccatgtccaagtctccctgtagctcaggctaaaaacaacttttcttcttcaaacctaccctcccctccagtgaaggtcttacctatagcttcccattataggcaaacttttccattcctaattttgcgaaatctggcttccatctctccacttaccagaagcccctgctctagggtcacagggtgatggaatgcagtcacctgtctgcagctccctgtgtcccatctgccagaccccctggcactcatgaccttgtgtgtgctggtgtgcctctccaaccttccctcacctggcacctctgcactcatgccttcagtgtgtctccatggcctctccgtcactgagtccctgcctttatcagcatctccaagcagatggatcccagatgtctctccagccctggcatccctccaagcagtggtctcaccttgtcaaagccctgcacagtagctctgcttggaggccacgtgggcacactggagtctgcccagaatggtctcttgcttcccatgttaattcctcctccattcacgctggcttttcttaacaccttcgccaacatcctggccatccagtcttgaaaccgcagcatgctcttgacccccttgcccttcgcatcaaaccacattctgtgttttctgttatttagtccctagaccatggcagggtgaggtgtgatgggttgtgggatcagaatgatctggattcaagcctcagctctgccatttgctaacagtgacttttaaaataaacatctttattgagatgtatttcccataccacacaattcgcctaaaagtgtataattcaatggcttttaaaaagcatattcaaggttatgtgcaagtattaacatggttgattttagaatattttcatcacctcaagaagagactctgtaccctttggccatcacttccctactctccctgccccccaccagccctaagcaagcactgtctctacagatttctctgttgtggacatttcatatgaatggcatcacacaagtaatctttggtgactggcttctttcacttagcatgatgttttcaaagttcatccatgttgtagtgtgtatcagtccttcattccttttcatggctgagtagtactccactatgtggctatacattttgtttattcattcttcagtggatggacatttgtgttgtttcttccttttagctattatgaataatgctgctataatcgtttacaaatttttgcatggacatgtttcatttttattgggtgtatatacctaggagtggattgctgggtcatataactctatgtttaattgtttgaggaactgttttctcacttgagaaactgtttttctgttttttcacttgggactgttttcccaagtggctgcaccattttgcactcccaacagcattgtacgagttccaatttctctgcattcctgtcagtacccttgtgccatagactttttggttctagccatcttggtgaagtggtatttcattgtggctttgatctgcatctccctggtgacgaaagacgttgagcatcttttgatgtgcttattggccaactgctaacagtggctttgacactggatgctgaacttcagtctttcctcctgtaaaatggtacaaccaccatccatggagcacagtggcaacaccgcgactctctgggctgaggacacatgcgacagcaagtaatcccacagccactggacccagggacaggcagcctctgcagccaagggtcctgtcccttcatgtctctgcttccagtcttttctctgtacgtcctgcagccaggcttgggctgctgcacggctagagatgctttatcatgaaacctgcagcaggtgaaggttctcccagcaaagtttttgcagaaaagtgatgcactaagtgaactgttcttcaaatggtgtgagctgggagtgaggtttctggcttttcagcacatgggtgatgttcttgggtgaacgatgtttccccaaaagatatgtggaagtcctaaatctcagtgcctctgaatgtaaccttaattggaaacagagtctctgcaggtgtaattagtgaaggcgaggtcatagtggcatagggtgggcattcatctaatgactggtatcctcagaaaacaagaaagatttggagacagacacatagacaggggatggccatatgacagcggagtcagagaccagagtgatgctgcccacaagccaaggaatgccaaggatggccacagccgccaggagctgggtgaggccaggaactcccactgagtctgtggagggcgtgtggcctggccaacacactgatttcaaacctctccagaactgtgagagaatacattcctgttgttttaagccacccagtttgtggcttaatttgtgactttgttaaggcagcaatagaaaactgacacaggataatgatgttcaggaatgatgtggagagccctgggggtggttctgttccatgcttgttggatgcttggcatttctggccaccacaatgtatttactgagaatggactctctgcccagtgacagaaaatgagtatggccctggttcctgtcctcagcttagcatgggagacaggaggcaggaatacaagcagcagcttcagaggcaacaccaggcaaggccagggttgttggaggcgtgggctccagccactcccaagccggggctctgaatgtggcccctggtgctctctctggtgctccctgacaaatatggccctgggtgagaaaacctcaggcccctcccactcaaattctgatttgattctggattgccagtgtaatagttgtgattattttctcacaagggttacaggagaccttctgattaaggcaaacatcttgtacatcaaaagctgctcactgtcacccctgggcttactattcatcattctctcttaaatctgttcccaaagggcctacctggcacaggccagctgctgggcccaagtaatatgttttaatcaatggtattaagctttttccatgttctgacattttaagtagataattagactccagtcaccaggtgtccaacagttctacttttctatctggaaaataagttttgaaaatacctatcatgtacacgtttgtatttctactgaaaccacctggcaaccctggtaaaatgtaaaagggaatctctgatctataagaaaaaacaaagctggagagaaatgcaggagctttattataaatcatttaatattcttgaagttaacaactgataaactcatttaggcaaacattttggatttaatgatctaaagctcacagatgcatgccacatctagctaaaagtacataaaaagcgcacctctggaaataacagccctccctctggctgaagactgagaagcattaaggatgcttctggatttctgcagcggcagggcaggggtctgcacaggcctgacctggtgttgctggagcgcggcatcccctcctgggtgctgctccgaaaggcaggctgggaggtgcttgctggggtgttccatggcagcgctgccaaccaagtctgggtctctaaaagccaccctcagtttataccaactgatcaggaaataggtggtgacagggccttgaagggtacatgccggcttcccttaagttgattagatgggaaaccaaacaccgtctttcaagtgtgaggctgtgccatgctccctcagggaggaggggcgctgggtctgaccaggtctgcctctgccctcaccagctggcagacgtgaactggagaacagcaccagaaaggctggtggttggcagctgctcacgacacagttgctgacctgcagcagatcggctgtgggtgagcaggacagtcaggccctccacaagcactgttctggagtttcgtctgactaggtgaaccctctggcttttcgaggacgcagggtaccctactgccaccagccagtgagcagactaggacatctctagacaggaaactcatctaaaaatcggaggacaacctgatgcacccaagtgacaatggacccaggcagctgtgcacaccaggtgggaggcgtttggaacagttagactcatcagtggataggtttttctagcacaaatggaatgtggtgtctcatgtccctagggagacaaagggcaggtttcttatctggtctttccaagctttcaactctctggctcaagtgtcccagaatgaactagaagtctattcctccaccctggtccgtggtcacttccagaactctgaagtggctcaggaggtgactcctgaaaggcagcccttgcttgatctcctggtggagcctgtctgggctgaggcgatgctgggcttgccgtgccgagatctcatgccagaagtcctccctcggagctacctgtctccagcctcattctttggcatgttgactcctggaattgaggggctatttctaagatgcatgctttttcggcttttctcatgggtgcctcatcagcctgcacaggatcccccatctcacgagagagggaaatttggcattgctgttccctgcctctaaggtcctttatgaggggccgcccaaactcattcccttagttcttactctcccacaggtgttgagattttattggcccatactaaaaagcatgcaatgactgaggttttctcctaaccttaatctcatcttctcaaatgtgtgccttcttgtttttaagaccatagacaaggacgtcaggtgactgctgaaatagaactaaagctaaaatttttctcggatcttggcaaattctgctaatggcacctctaggggcacaatgatcctcaaatgacatccaaccagactccccataaacaaggtttgggctggagctgtttctagttttaaatatggaaatgtaaggcaaaggacagagcacttggttttgccttagatttcccagcagagtaggatttgggcgaaactgctggttctctctgtcagggaaataccaagtgcagcagagccggggccatggggcaggctggtggactccaggctcacttgcgtggctgctggatgtgctgggttcttggggaaggatgcttgtccatggaggcatgcggcttctggtgagccacctgcgcagccgccggggggaaatctttgtcaccctgtcaggaaacacggaaagctcaggttaatcaataggaagcatggggtttgtgggtgaggaagccccaggccagtgcccaccagcgtccctgcggaaggatagcaattgtgtgtgaggaagcctcaggccagcatccaccagcgtccctgtaggaagcatggggtttgtatgtgaggaagccccaggccagggcccaccagcgcccctgcaggaagcatggggtttgtatgtgaggaagccccaggccagcgcccaccagcgtccctgcaggaagcatggcggttgtatgtgaggaacgtccaggccagcgcccatcaacgtccctgcaggaagcatggtgtttgtgggtgaggaacccccaggccagcacccaccagtgtccctgcaggaagcatggtgtttgtgggtgaggaacccccaggccagcacccaccagtgtccctgcaggaagcatggtgtttgtgggtgaggaagccccaggccagcgcccaccagcgtccctgcaggaagcatggggtatgtatgtgaggaagctccaggccagagcccaccagcgtccctacaggaagcatggcagttgtatgtgaggaagccccaggacagcgcccaacagagtccctgcaggaaggatggcggttgtataagaggaagctccaggccagcacccaccagcgttcctacaggaagcatggtgtttgtgggtgaggaagccccagaccagcgcccaccagcatccctgcaggaagcatggcggttgtatatgaggaagctccaggccagagcccaccagcgtcgctgtaggaagcatggggtttgtatgtgtggaaactacaggccagcagccaccagcatccctgtaggaagcatggtgtttgtgggtgaggaagccccaggccaacgcccaccagcgtccctgcaagaagcgtggggtttgtatgtgaggaagtcccaggccagcacccatcagcgtccctgcaggaagcatggtgtttgtgggtgaggaagccccagaccagtgcccaccagcgtccctgcaggaagcatggggtttgtatgtgagtaagccgaaggccagcagcaaccagcctccctgcaggaagcatggggtttgtatgtgaggaagccccaggccagcgtccaccagggtccctgtaggaagcatggcggttgtatatgaggaagctccaggccagcgcccaccagtgtcgctggaggaagcatggggtttgtgggtgaggaagccccataccagcgtccctgcaggaagcatggcagttgtatgtgaggaagccccaggccagcacccaccagcttccctgcaggaagcatggggtttgtgggtgaggaagctccaggccagcgcccaccagcgtccctgcaggaagcatggcagttgtatgtgaggaagcccaggccagcacccaccagcgtccctgcagggcaggcgtggactgtgaatggataaaggaaggtggaagtctgtcccttgtgggtgttagggggcctgggcaatcaaaaccagggaatggcaggtggcactgaggcccacacactggcaggacagcaagaatgctcactggctctgccccatgccgtgagacacaggaacatgcgactcccacagaactgacttggatgctgcggggtttcttctgctacatctgtatttgtgactatttaaattgggggcaggacagaaccaaatccaggatcttaagttcagatgtgccaccacagctgtgagccaggcctgggacgctggctgggaaggaaatgcacagggcgcctacgagacagagccaggttcggcctgtccagtctcaggagggactccctattttccagagggatcaatgggcttctgtgccaactgtgggtgtggccagggtggggtccacatgggcaggctggagccacacttctctggctggcaggttggctggctgcggtcacagctccaccaacagtgggctgtccccaacactggcactttcttcaggcatcctctgataagaaagtgaatgttctgagaacagcagccctatggacggcaatactgtggggttcactgcgggggtttgctgatgggagttcactggtgggaggtctgcgcttaagtcacaatgttgggtctcaccagacggcggctctggaaaggtaaaggatgcgagtctggcctgcggtctgcagaagcagcctctggggaaacgcggcaatgaagagagccatggccacagaggagatgagcagtggtgctgggttattccaggtagagtttaacaaaaccagaagcaaccaggagactccatgctgccatgcaaaagcctcaaacccaccgcagacactcccagacttacccgggcgatgaccccagagatgaacacagtgggtttaggtggactggaaaaaaagaagggaaaaggcagatttaacaaaacagtccacaacagggaacacggtggcagacgatgtgtatgtggatgagccaggctggagggcgtggaggcagaatgggaagcaaacctctcctctgcgttatttgttgtaatgatcacactacggggctcgggagcctccttctcctgaggctagttcagccccaagtacgagagagaaacagactgcagccaactgcgagtgaattgccttcaaccactttctatttgtgttttttttagggacagggtctctgtcacccaggctggaatgcagaggcacgatcatagctcacagcagcctccacctcctagactcaagtgatcctgcttcagtctcccgagtagctgggacaacaggtgtgcagcatcatacctggctattttcttttatttttgtagagacagggtcttgctatgttgcccaggctagtctcaaactcctggcctcaagccatccttccaccttggcctcccaaagtgctgggattacagggatgagccactgtgcccagcctatttttgttttttggttaaatcaacacattttaactatgggcaagcccatttatttggatttaatgagatcgtgaaacaggcgcttccctaaagcaggggagaagtagctttacatggtgtggacttggagactttctcactgcctcctcaaccctaggcttccccttccagcgtcctcacaggggagattctagagccaacacaaacctcccgtccccatcaatccctgagcattacaaatataaggtccttgggaaacatgtcacctcttgacatgttaactcacactgagctcacctaaactgccgagtattgagggaatggatgcagtaccaaagcagtacagctcagtgtgaaaaaacagacaagcccaaacaggctcaaatcgccagcaggtctaccacctggaaacacacactgttaacgtggggctatcctcccaggctttccttctatggacagatgtacgtgcttgtcttcttattaacttttttcttacaaaaatagttatactgttttgtaatctgccttctgaactaaggctatggcaagcatctctccatgtaattatatactcttctgtacacttattttttatggctacgtgtgccataatttaaaaacatcaggacacagtttgaggtagtggacaaggtgtgtgcacttccaaatgcctccaccaagaggtacagacacccaagacctggaggtgaatacaaggtcagcccagctgggacagcgcgatcgatcggggacactcacggaggtgggtggaggggaagcatctccctcttagttcagttttgcttaaggccagtcctgctgggtagagggggtagaatttatcccctgagctcaccagcctgtctcttcccagctctgcttctcctctgctgccagtggtcttttttaaggaatccacttgtcttagctttgttttgctgcagtcaaaagtcccagcattccgaaagttcactgactgtttacttccccaaagagtttaccaaaaacacctgaaattcccccaagtaatttctgttacttcgcgacattaagaaacttcaagttttactaagcagcacagagatgccccatacattaccttggttttatttagtgtttgttgtgtggttacccaggttggatttttttccccttcctttacgtacatgatttagctataggattaatagtcggccagaaatgagtaagctcagctcaagtttaaaagtcccgccacgtggtataactgaattcatttggattcttaaagcacatcctgctgtgatggctgataccatccacaggggagggcttccagggattcagggccaaggagtttgcatccaaagctcaggaactgtggtctgaattctaacattttagaaaagatttggaaaggaatacacaaatggcagcacaaagtttcttaacgtcgtttggaatgttcttttaaacatctaggaacagcctgaagcagggatggccccactctggtagcgaatcatatagtatcatcttcaacaaggcacagccgtctttccgtagcaggagtgcacagtggcttccactgtctccatgtcctatttgttttttaacctgctgaggctctgaaaggcggaaatgcaggacatcaccccactccagaaacttgatataaaatgtcatccatagagagtcaatctagtaagaatacatgcataataaagggaattagcttcctcaccaaactgagccctaaaaggtggctgaggaagcttgagtaattatatacatatataaacaccctcccctctacagacacacacacacacaaacaaacaccttgttttatggcatctgcttatcgcacttcacaggtaatgtgtttctttaggaattgaaggtttgtggcaactctgcataagcaagtctatgggtgtccatcttcattattattatgtctgttacagtgatctgtggtcattgatctttgatgttactactgtaattgttttggggcaccacgaaccgtgcccatataagatggtaaacttaatcaatacttgtcatatgtgttctgacagttctactgaccagccattccctgtctctctccttctcttcaggcctccctattccctgagacatagcaatattgaaattagggcaattaacaactctacaatggtctataatggcctggaagtattcaagtgaaaggaagagttgcatgtctctcactttcaatcaaaagctagaaatgacccagcttagcgaggaagacatgtcggaagctcagacaggctggtctcttgcaccaaatagccaagttgtgaatgcaaaggaagagttatgggagaaaattaaaaatgctactccagtgagcactggagtgagtgacaaggaagtaaaagagcattattgttgatatggagaaagttcgagtggtctggataaaagacaagccacaacattcccttaagccaaagtctaatctagagaaaggccctaactcccttcagttctatgaaggctaagagaggtgaggaagctgcagaagaaaagatggaaactagcagaggttggttcatgaggtttaaggaaagaagccatctccagaagataaaagtgcaaggtgaagcagcaactgctgaggaagaagctgcagcaagttctccagaagatctagctaagatcattgatgaaagtggccacactaaacaacagattttcaatgttgacaaaacagccttttattggaaaaagatgtcatctaggacttacacagctagagagggaagtcaatgactggtttcaaagcttccaagggcaggctgactcttagtagggactaatgcagctgatgactttaatttgaagccaatgctcatttaccattccaaacatcctagggcccttacgaattacataaaatctactctgtctgtgctctatacatgggatgacagagcctggatgacggcacattggtttacatcaaggtttactgcttattttaagcccactgttgagacctactgctcagaaaaaaagattcctttcaaagtattactgctgatttataatgctcctggccacccaagaccaagtatacaaggagattaatgttgttttcatgtctgctaaaacaacattcattctgcaacccatggatcaagaagtaattttgactttcaagtcttattatttaagaaataagtaattccactggtagatttgggcaaagtaaattgaaaaccttctggaaagaatttactactatagatgccactaagaatactcatgattcatgggaggaggtcaaaatatcaatattaacaggagtttggaagaagctgattccaaccctcatgggtaactttgagggggttcaagacttcactggaggaactaactgcagatgtggtgaaaacagcaagagaactaggattagaagtggagcctgaagatggaactgaatggctgcaatcttgtgattaaaatcctcagggatgaggagttgcttctcatggatgagcaaagaaagtgatttcttgagctggaatctacacctggtgaagatgctgtaaacactgaaaataacaacaaaggatatagaatattatataaacttaattgataaagcagtggcagggtttgagatgactgactccatttttgaaagaagttctaccatgggtaaaatgctatcaaacaacattgtatgctgcagagaaatctttctttcctgaaaggaagagttgatctatgttctatgtcacaaacttcattgttgtctttttttttttttttttttttttacagagggagagggtctcactctgttgcccaggctggagtacagtggtgtgatctctgctcactgcaacctctacctcccaggttcaagtgattctcatgcctcagcctccagagtagctgggattacaggcacacaccaccatgcctggctaatttttgtatttttagtagagacagggttttgtcacgtttgccaggctggtctcgaactcctggcctcaagtgatctacccaccttgacctccgaaagtgctaggattgcaggcatgagccatcacacctggcctgttgtcttattttaagaaactgccacagccactccaaccttcagcaaccaccaccccaatcagtcagcagccatcaacactgaggcaagaccctctaccaacaaaaagactgagcctcactgaaggctcagatgatcattagcatacagaatttttaaatttttaaaattttaaattaagttatgcattgttttttagacgtaatgctactgtacacttaataggctacagtggagggtaaacataacttttatatgcactgtgaaaccaaaaagttgtgggactcactttatcacaatatttgctttattatggtggcctggagcagaccctgcaatatctctgaggtctgcctgtacatattcattattgaaacgcagacaagcaaaacaagttaaaatcacttgtacttctgtattactgtacgtgtgtatttataaagattgacacacacacacaactactgtcccatcacaactgctgaatggccatggagactctggaggctaaaggagatccccagcaatgagggtggtctaccctgtgagtacgccaccctttgcagaggtggagtggaactccaggacgcagaggcgccatccagcagtagggcgccagcctggagaggcctccatgttgggtgttcctgacaggctccttggttgagcccagccccactgtgtagtagctgccacgtgaggctctcgggggacctggctatcaggaatctgtctccagcactggtcccctgtgtgcactgaggacgggagtctggagcccaggggcctgccacagtcccgcccttcctccctgccctcggtgctcctcagaggtgctgtcctctgggcgtctcctgcattgatcacgacaagggtggggttctatgcctcgagtatgtacccggagaaatgtgtgtgaacagtgatgatatgagatcatgacagctctgctctagcctgagtgctggaaaacacacacggaagctgaggcctagaaaccagcctctgactcccagggcacgctctttcctttcctaaacccacatttagcacctcactcccatgtgagctgctcaagacactgtcccatcgcaactgctgaatggccatggagaccctgggggctaaaggagacccccagcagtaagaatgaccctccccccacaggcccagctcattccaggagtgtccagggccatggttgcaggttgcagcgtctaagagtccacaggagtcattcacagatggcgctgtccttgtgaaaccccaaattcacggagatagctcctttgtgctgagtcatgactgaatctgctgagctttagtggcttggtggattctgctcataaagacagaggatgtcaatgaaaatcatgctaggctcagcataagaaatgtgcctctgccaaccactgggtggcgaggggtgaggtgaggcccaccgggtgtggcgatgagccagggactggtgtcctttgtgctgcatcctatacaaagtggctagtcattctgctggatgtggtgctggcgacttggctgagtgatggcaagactgagggtctgatgccgcagtcaaagggactcactcaggatggaaaggccgtgaacttgcccttgtgcacaccctgagggctgactccgagctgaggagcagggacagggaatgtcactcagtggcaagcttaggtcagagcagtctcttggggcacaaccaaaacagtgtgcattccacctaattaacctggggaagaacaacatgaaggcctgagacttcatcctgcactgctgtgctccagcgcccccatctgtttggcactggtaagaaataaggcactgaaagaaaagaaccccatgtgtccagcacttccgcaggcgaggtccttgctttaagactgcactttttacacaatattcaagaattgtgttgcatgagaaagtcttatcgagccgcaagaggcgactcggcgggaagtgacaggacaccagactgagggtctcctttagctctggtctgctcaaggcaaacgttcttcctaaagacagtccaagctctccctcccttctaacttcgctttgaaaccccagccagctcagcaactaattacaaaaaaattatgtaccattttagccatttttaagtatacagttcagtggcattaagtatattcatattattatgctatcatcacctttatctatttccagaactttttcatcattcccaacagaaagtctgtccccattaaacactagctccccattctctcctcctcccagcccctggccatcaccgtgagtttaactgccctagggatctcatgtaagtggaatcatacagtacttgtctttttgtgtctggcttattccatctagcataatattgtcaaggttcatttatgttgcagaatgtgtgggaattcttttttgaggctgaataacattccactgtacagacagaccacattctgcttatccattcatctgctgatggacacctggactgctgcgaatggtgcagctatggacgtgggtgtataaatatgtgctcgagtttctactttcaattattttgtgtgtaactcagaagtggaattgctgggttatatggtaattctgtgtttaactttctgaggaatcaccaacctgttttccacagcggctgttccattttagattcccaccagcaacgcacatgggttcctatttccccatatccctgccaacgctcgttgttttctgttttgttttattctgtttttttggataaaggctctattctaatgggtgtgaggaagtatcgtactgtggtttagatttagcaactaattttaagaataagcttccctgccacagaataataaatatcaatctgtattgatcattcattaaaggtctttatgaaccaaaagtcgcccccaaaattcttctctaaaactgaaaaggccataattggctgtaaggacatatggcagctgcccatgaaaagatggcaaaaggcaggcctcttccaaaatgtctaacagcgatatgtattttcatgtaacttgtcccgtgacagagcgtatgttgtgttgaaggttttcatcaagtttggcccaaaggcttcagagcccaatccttttttccaactataattaacagcaacttaaattggcaaataattatttatgacgtttataaagtaaaaacagttactaaactctttgagatgtggtagcttgaacaaaatctcacaagcgagaaaccccagtcaaaggtctgggtgtaaggctgtacatgcaaaacacacctattttaaatgccattaggcttccatgcaaagtataacctacatttctcaagtctaagaagtatgatagctgctttgaggatttatttaatctgatgaaaatcattctgacagatgctgttttgaagatgcaacattattttctctcaggaaacagagagtgaaaactatcaaccctgcccgccccatatcctcaggcctttccagactttaaaaactacacttatttaaattgaaaagaactgcaagccaggcagaattagccaggattagaatccagataacacttcctatacactagcagaaactgcagctttttcacacccagactaagcagccacctgatgtccgtgcacgtgggtctctattgtccatctggcaaggaccacatcaaactcttaaaaggaccctttgtccttaacaaaagtttgctattacttattttctaaattttcttaatgaagatttataccttattggcattctgtggaaactgcagacagacaggataaaatgccagaaacgctcagtgactgagtaaccctgtggaatgcagatatcatcaagactgagtttgatggtctcatctttaaaggaatgtggaaagggctgagaaacccaaattcatagttttaaaacttccctaaactcccaaacagcaactatttaactcaatatattcaagttactgctaccccaacatgtaactcatataaaaattgagaagacttttaacattcttttgtgttctaaggctttacaccctccctcatcatcgtggtgctctgacagcctggtttctgccccagttctgagaggtgtaaagcgatgcactcttgtgagttagagctggacaggaggttccctaccaggcagacggctgctgcaatctataccttcatcctttcgcagttgagagcttaagggccttcagtgggggccgcctggatgtctcccaggtgggccggattctgtctccctgcacttagtccagcgcccatcccaagtctaacgctcttccacaggacagtcctttggtatttgaagaaggctaccacaagcccccagaacatccctttcccagactcaaaggcatgatttcaaattccttcactctctcagctattctcccaactgcattccagtgcggtttctagagttttgcctagaactgtacgcgacaccccacatgtacctactcagtccccacaggacaccgatattgcaataatactttcccctgggctacagagagcaggtcagccaggaaatgaatccgggctccccaaaaggaccgattgctagtaatcttcaaataggactgctactgacaggcaacttgtgaacaaagtaatttgtatctgctgccctgctccagcctggctcaccacagctagttttgtggggtccttacccttcttcccttaaccctggagagcttctgcactcttagaaaaatgcagtgcccttcttcaccccaaaataggattctgtgcaacagggagggtccgatgtgcatctgactggtcagcctcttccttcccaagcatcctggtagggattagggtcagcttagttaccacgaaggtgaattctgggatggggagaaacatgcacacgcacacacacacacacacacacacacacacgtgcgtagtagtagtgaaactgggaatctggtcaaatctctgatcccactgaaagtaatcaaaatggcagcaaaggcattactggagagttgtacgtaacagaatcattttcatgttagttttgacctgggttcatggaagtctactcaagttatcctctgcaaatgctgtctccttttcatgtaaatgtactctatcagcaggaagcatgtacacagaaggcagggacacatggcctttaataagccactggtgctctattttccctaaaggatagaaatgatctcaggttgataaaagctactgtttatcaatcaccactatgtactatggaccaggtgctgagttaggcgctccccttagaagtgctgtatctaactctcttggtcctgtgaggcaggaactgtccatttcacagattggaatggtaaatcagaaaggaccagtcatttgcccaagggttgcacagtaataagtgctgggaaccagacttggaacgagggctgtatagtgcatgtaatcttggctccaagcccagtcccctcattttaaagcagagttttagcttgtcttctgtatatgatttagagatgcagagttttaaggtaagcaatctaaatgtaacctgagggtcctttattcaaccagacagtacaatatattcaaatctacctaaagatttactttctgacttgatagtggattttttttcctgaaaaatgatcacttatgtctctagcatttaactagcatacaaagcacttccacataaatcattagctcatctgagttccttcggcaggtgatgttctattttacggaggaagaaatggtgcctcagagaggctggaaccttgcttggggtcctgggggtggagcccgggaggaagcgcaagggctgtgctcttcagtcgggtcgtctgagatctccaccatctcagacgactctgttcctcagtctcgggaacaaaatgcaggggaggcttcaaaccatttaacagattcgaggcagccgacagggccagagacgattcagaaccacgcaaaggagggaccgtggcaaatggacaccatgagtgtgggctagagtgttggatgatccgggttcaaatcctgactctgccagggacaagctggtgagctggtggttgacttttctgaggcttagtttccttgtctataaaactggacagcaacagaccctaccttcttaggtgactctatatatgtgcatacacacacacacacacacacacgcacatacacacagcagaaagcaacagattctaaacagggtcgaaacacagtttccaaatttgcttctaggctgcctggcgggctctgtgctttcctgaggagggtgggcaaagagactgcttttccagggtaatgaccttgagaactgggccgcacctcaaatcaaaccctctgtcagtgcagaagaagaggcccttgggcctcacccactgtgtgctgatgaaaggtagtcacagtgtgtgcttagcacttgtgtaacagagaggacacgacactagagcactgcagtgggaggacagggtaccctcgatcagcttctgcccatacaaagtgaatggggctgggggctcttctcatgcactgatgaagggggtgacataggttgtggcccagcacatgcgctcattgaccgggaaaagcagtctcctcaggaaagcacagagcctgcagggcagcctagaagcaaattccaaaactcttgttttgactctgctcagaatccatagctttgtgcttccagagtttacagaaaatatattcccagctggggtgactttttaaacatttcccagtaagtcgatggaaaacaaatccgttcctgccatttttagttcttgaaataccttcttggcttggtcttaatttatttgggctattaattttctggacagcaaaataataattagcatggctggtgagcagagggaaacgtctcactcgattgcacccagacatttctggataacatcattcttcagagtgtgacagtcgaggctgtctccctccttcagcctggcttcagcactgacaacatttccacaagatggcactgctggtcctctcagcccgcgaacgctccggccagctcagccacctcaaggagaaatggaagccggccaggcactgcgggcgagggctgctggcacctgggcacgagggtgccccttctccccaggagtggctaattgtcacgagtctgaccaaaggcatataaaactcaacttcagtgtcgtaaacacaattctaaacccgagagaaaataatctggaacctaattccttctaaatttggcataagaaatttataacatttttcaaaagggcacaaccagaggtgcttttctaggtgagaatgcttgagctcatgttcacattggtctaacagcaccttctttgcagtgagatgctgttttcatacaactggaatcagccttcaaatccttcagtgaagaggctgggacggcaatctgccccttcctcagaactactgcttccaggacactgtgatttcaggacaaaacttcatctcaacctgttcttctgggtctgggccaggtctgggtctgtgtgggaaggatgctctcatttgggggttctgaaatatttctctccaggtagcattccacccacagatatttggctaattgttgatccagatgtcaaaacttcacagagatttttttttttttttagttaggaaaggctaaacccccaagttctgagtgtgttgggtgaatagggctcatcagtagatgacgtgttccacactctgcatgtagtgtgaaagccacagactgggagtctggtttaaacaggagggaaccttcattttccctctagacacagctccagaaagctcctgtgtgcccagcactcttcccattccagaccacttcagtttctggcgtgtggatcttccctccccctcctcctgctcttccctattgtacccctttccctggatgcaaagaaggggaaataacaacaggaagtgttaattacccttctcacatcttatggatttaatacgtagtgatggtcctgggccactgagagtctcaaaattcatcacatatacagaagcgaccacatctgaggggcacagcccaggcaccacttcctgaaagtgagccagggaatagggggtgtggcgggggggaggcttcagcctggtgtagaaatcccagacattctgctgccatctccacaggagtcataggcgattcagaaccacagacaaaagcagtgtcatggcacgtttgagggcttgggcttaggaaatagatggttctggggttgaatctcagttcagatgagcagcctctcaaagcctcagtgtccatctgtaagatgggaatgattcctactttgtagaatagggagtttaaagaaaataatgtattcactgtgcttggaataggcctccactgacaagctcatgtttagtggcaataagtaatgaattagtttcctatgtaaagacagtctagaaattgctttttgtcttctaaagcataacacttcctttctctctctctcatttctttcaagactggggaatttcagagtttctcagggcttctttgaagaatgccagcgggcccaccttgagtttcctcactcctttgttctaagcattgcgctgtgccatggcgcagggtttcagggcattactatgagaaaaggttcccccagcaccaaagagtgggaatccctgtccacctccactgccagcagcctgaacaattcaaacagtataaagcagcaaaaatgactgcttcctttccttaatgaaatgttccagagaaggtaacttttaggaagaatgtaggttatcattaagggcaaggggcaaacttaaaaaaaagggtgcatgtttaactacatggcaatgtggaacatactggggggaagcccgcctaggcttagctctaaagctacattgttgggagaccttggctgtaggtgggccatctctaaagacgctagatcaggcattggacatagtcctttgcagtattcagaaaggctcctggcactgccctaggaagtgcctgctcaccgtgctttattacatggttagctcgttacaagacagatgcgcggctgtccagcagggcctgaggacaattggtatgattattagtctgtataacgatcatctatgtattaaaaactttacatgttgcttgatttcagtatgtaacatttaccctaaaaaccgttccatctttgattctgaacacgtccacgctttagagtcactctttggaatttcaattatggggaggtgctggtgactgcttaatgctgattagacaggtgctttaaaaatcactctatttattgtctatattttgaaatgcaatcttcaggctcaagggtcatgttataaatggtttaatttttgggaggtgggtgtccatggttcaaagtacaaagtattttaaataggataaaactatggtggctctaaaaaggaaaatgatcatgtaggtagaaaaaaatccaacaagacaactgtcattggaattcctattagaaagaagtacacattaatccaatacagacaccaaaaaactcatctggtctgagtctacttccatctccggaagcacaggtggctgaccttaaatgggaccagctgtcactaggatgtttttgtgtcgaacccagcaacagaattagagagatgccagagttaacttgcactgaggatactttccagccaggtgtctggctggaaagtcacagagctacgcatctagcaagaatcaaagcctggcctgtgagaaccacgcacagtgtggactcaggtcagggacactgcatgatggacaagggctttctgaattcctgaattcaccaggaattatgtccttagtccacctttcccacacacagcaagggagggagttggtgagctgagagcacagctactcaccagccagccaggctgatgcagtaagtgtcctcagtggtctctggatctgcaaattcaactgctacctgactggaaatgctagctctggggaccctcctaaggcccttcctcagatcataccaagcacttgggccttttccagacttagcaaaaaaaaaaaaaaaaaaaaaaaaagagagcaaggtcaagtagacagaaaactaaactcacaaccaattctgcttactttccaaaaccagctagtgagttgggataacttacgttcaacccaacaaccctaccttcacccacgtttatagcaaacaccgccgagtattagaatacaatgggagcgcagcagggcaggctgtggtatagaccagcatcaaaggcccctaaagtttgggtttcgagaaatgcactgtgagccactaattaaagtcttcactcactccctgatattgactattcatgatgccctgatctctagtgactgggtctctcctgggtaaattaatattcagggccctaaggtttattgtggtttatttattagttggtttcattcatttattcacacacatactatacatatatatgtagagtgtcattctatctatcaatcatccatctatctgtcaacaaaagttctctgaaaaaggaatttggaggaaagagactttattccagtgaacagtttgcaaaccagggagacacagcctccaatataaaatgaaggtatgttccaaagaacaaaggaagacttgggttttagagcaaaagttcccacccaggttcccaatcaggtctgtttattcaaattaaaaaaaatgaaatttgcttagttctgattggctgatacggctgagtactggttggttggttcaggtgagctctaaaagtcccaaagataaaaaggtgcaggtttgggggggatctcagcatacctgtatgacccctagtcggcaaatggccacttggctctatttcaaatctggacccagtgagccactaaggatctatattggaagactggcccttccaggttcacatttgttcacatctacctacctacctacctacctacttacctatctgtctgtctgtctacggtgtttataagtatcaagcatgcctgaaaataaggaagcatttgcacaatctctggagcatctcctactttttcctgcctgtccagttgctggagggacataggagcttgtctccgcttcttatcactgtcatcttcttcctcctctccactaacaggcatttggtgttcacacactgtataggacgctgggttagggactgaggtgaagactggtcccagagggctccctaaatagcaagaggccaacaggccacacctgtgaggtttaccagaagctaatgcgaaagcaggtcaccatgggtttctggaaaagtgggctgtctctattttgatgtggccggtctctgtggcaaccccatgaaaactaagaatgtccttattgacaggaaggacttccacaagactgatcctccatcagggatgagaattcccccagagctattcctgaggacatgcagggaaccacagaatctctgtgaacttggtgaatgagcctttccagagaggaatgaaagggcaggggcaggaagcaaggggaattccagagtgtgctgcactaggccccaggcccacggctctcactccttcctgcttctcccaaaggttccctggggtgtcccctgccttgagggagcttcctttgctttccatgaggacagccagataatatgctttaccaccagcaaatctcaccagtgaagatatctatgtgccctgttattcacaaagtgaggaggcagatgctggatgatggacagagcaagctgcgaccctgagggcccctctccgagctgagatgcacctggagggcacaacctcgagcatgaagagggtaaccagaatggggccctgggtgggcccctccgcgggcaggatgtgacatacttctagggagcattagggctcaatggaaactttccactaagacgtcagaggggaattgatgtgtagtgtataatcctcactttgaggcgctatgtacacgtagacatctacatgagagccttccttcttccacatggctgggcagataagtccacccacctgacttctgaggcccactgagaagtgacagaaagtgcaagaacaacacaggtgcatttcaggagaactgccaccaccatctctaaggacagctgcaagccaccctgcaaatgttaatgaattagaatgcaaactaaggttggggccaaaggaggaactggaggctctttattctccttttcacatctgctgggacctgtaggaaggggagtcgttagggatgggagaagggaaggaaattttcagctgaggcacaggttctggtggggagttctcactggcactgttgcgccccaggggcagcgtggatgtgtggggcatggtagtcagcgtgcatggatctgtgctcaccaccactgtgcctgggcgcttccatcaggtaaatattcactgagcaaccacccagtgcctgcccagtgctgggtgctggagacccaggagccaccacccagatggggccggccttgctgcggcaagagggtgctgggctctctgcagcattataggactcaaggctgacttgacctgctttgcaaactaacccagggcccttgtttctctgggtcacgtgctataggtaagatggccctactgttttacattctgttatctcaaaccagaatacattggctgaccagcacaaggcagaatgtgtgaaaacagaactttcccagaaaatctgggccatggggcccctgctctgaatagacgggtgtgaaatgcctgtgtctgtgctgttccatgcatctgatgaacaagctgtcaccttagaaaccagagggaagaagcccacagagaggtgaacacccaggaggcaaaccatggcatctggctggggcatccgggtacttggtcaagacctgaagcaaccattggctatgagggcttatttcccaaggaaacaaaaaacgcagtgtttaaagtgagatacatgcataaagcacccagagaagtcatctgcctctgtgttgcttgtttaataaaggcaggtgaagatggaacaggagcactaactcacaacaccgatttaaaagaagtcagctgtatcatggagaacgcaagtcaaagaggagttcttttcaagctcaagatgcaatctgctgcttttcctcagcatttgcctcaataaggaaccaatttgaatatttttaaacccagcatctttatggttcagtaacggggctgagagccctaaaatggttttcaaggatgtaagtacaaacatactgtgcattgtagtttccaataatgattgcaatgtcagatgacattgtatttgtcttctatcagtttcttaaaataaataaataaataaaaaggttgagggggacggggggcgggggggcagtgggtggtgcaaccaatcccctgccatctcgtctctgaccagtagagggagaatgaacttcattcagggcagcaaattaggcctcaagttatccctaggatgatggttatgtccctgattccctgggacggtctgggttcaggcattggtcctggtgttattactagcagtgctttctttcactctcaaagcatgtcagactaaatatgctgcatggtcactccaagctgagacacagaattctggtatgatcctcaacttttccgggacacttaagtttcatttttcatggaagaaatgctcggattgcctgtgcttggttccaccttgatacttgagccagctgataaacagcaacttcaaggctggctcatgttctctttccatcactttccttcccctccaagggcaggacttatactttcccagctgtgttgccataagaacttcccaacatggctttaggcttatcacaacacagctttaggcttctgcacgcatggctccccttcaaggtcaaggaccatggtggaatttgttgtgtgcccagcgcctggcacatggtctggtgcgcacacatactcaacaaatgctttgagcaccaaatgacatcaccggtcagcgaccctcagcttagcacaagtttgtggtcgtggccaggcagtgaatgaaccagggtgcttagctggaactgtttgttgctcatttcttaggaatgagtaactctcatgccctgcccgcctcaaaggcttgcaaaagaggcaaaagagcgattagagatagtggatttatttttgtgacccgacaatctggctgagctggatctgctggccatgggttgatatctggagtccccaagcaaatgggcccttcctccagcttttgccagactgacctggaagattggcttttctccctctttagagggagctcaggctaacaggtacttcttcagatcttttcaaggcaaacttgagaatggtgatagagccatgagctgaagcttaaatgataagcacaattagctagaggcggtaaggaaaagagggatggggtgttatcaatgaccacattcacgagcctgaattaacgaattcaacaggaaaaactccatctaccttctttatggcaactcctggcagctgccaacaacagctggatggctttgcaggactcttgcctaaaccagagaaagactaagcatcaaaggtagctcatcttgttaagaaagcatgtctttttaataaagtgcgatgtcactcatgaccaaaaaaacccttgcaaaagggacagtaacatgcagacagatgtgcacccttaccctgagcataaacgatctggcatgccttgcctcctcagccagagtctcaaatgcctgaagaatctgggtcttaagttttcaactttcgtctccttacctaaggctactccacaatttctgggtttagtcatctgcaagtgaatgctgggaaacagcctgtttctgttgattccccttatcaccaagcacctaggagcagggctctgtgaggaatgactcactctgggcagtaggacacatcttacaaagcaggggtgctcccaaaatagggagcttacttgttgggacacagtaagatgtttttccctttagaaacaatatgaatgatgcttaggttcctaaactgtctcagaagacacgtaatccaagtgtaggctgtgaaatgctagtgtgctgagttggggctgagagctgggcctggctggctgtgggcttctacagagtagttgcagccctgtgcacaggcagggggggtgtcaccgactcgcatgtgggcaggtctttgctgcgcatcaggtgctttaagcttcggaacaactgtgcaggattctattttagtattctggaagcatcattgaggaagtagtccagtgaagttagctctaaaaaaactctttactctaacaattaaaagaaatatgccaaaggatccataagggatgaataaattattaaactattaagaagttgctataaatatgcagtgttaattcaataattcataacggactggtacaacaagattttttaaggctcataaaatactgctggctttggcagtagctagtgtcctggggctcatgccaattgcttctttacacagcagcctgggtgtggggggcacagggagccttcccctggctggctgcccaaggactccaggtagaggacagcgcagggcgtggctgtggggatgtgccttcactgcctctccagccttgctgggggccaggcactggcttgtctctatggcttcacaaaaaatacagcagcggtgaagagggggagaattcacagcaccatgctgtggcagaaagcagcatcccgagggctgggcaacctcttgcctgaacctgggaacagggcgtcctgcctgtcaaataccagccagcctggtgaccttcatctccacaggtgcctttgtaccccagagtttcctttatagtccctgatctcttttacctggagcccttggggctacataggtttcagaattcaggatttttcaagttttataaaggcaatatgttataaaaatcatatatagtgaacagttctggaggggcttgggcagcaccccatattcaaacccattaatttttctacagcaaaatgtatggatattacactaagtaggatttagggaccataaatatcctcacatcagctcaatttttgccaccatgagtttcagtgtgaaaacataaagccctctgcagttttctgagtgctctggaatgtgtatttgccttggagacatgggcactttccgctcaccacttcctatgtgtctctgtgctgtcgcccagtctgctgccaagaaagggaaatggattagaaacaggtaagacggtaaaactgtcaggaggtaaaaagattactcctggattacatggagatgccatggtcagctctatacacttatctgtatagagtaaaattggattcattcaattaagtgaaacccttggcaaagcagaatagaacaaatgtaatcagggaattttccccaaattgtatcttggtcttttctgggttaatagaactgagcaccaacacctgtcttctgtttgtgtggcctttcactgattctagagcccgttgcctgtgatccctcagtctttcctgcgcagtgtacagggccaggagcccacaagcatcactgacctccttttcatacaggtgagaaagcagcttagaggtagacagtccctgtggtcgagggaatgggaggaagtggagccaggacaagcacgtgggtcctcaaactttctggctagctctggtcttcctacacctgtcggatgcacaacctcagaattgtggcccaaaatacattctgcctggctctcatcctgcaatgcaatttgagtagcctgtggtcaactaaattctggaaacactacttcctgtatcctcctctgagagactgaaatgccccttagtgtaatggggctctgagtcatcttaaggaaaccagattaacttcctttcacccatttcctgatgcgtttgaatcaggaagccttttgggcagaacttccattagcatcagcccaccgcggcccacactacacacggtcgtgacacatgtattaaaggctgagttgcaattgtgttccatattttatgtagaggtgaaggtggtttacacattttggaaagagttttacctcggaggctaaataggggtcacagtgatctagtgggaggcccaggctagggaatccatttctccatcctccttttctccaccactgggtcacgtgctgtttggtcactggaaggacaagtctgtgtggcagaagcctgggctctctccactgctgtgtgagaacaaggctgtgcatttggccccagcctttcagctgccttgtcatttgtgatgaaacagaagcagttccatgcagggccacatgccctcatggtgtgtactatctgggcgaaacctgtcagacaacgggcatttttcatagagaaaggagaactcaactttggtctaagatgctctctgccctcctgcagttttcctttcctactcagtatcatctttcatggggagagaagcagatttaaatgtaaggtgcagtcatacctttgagtgctgattttcttttgttatgatttgatatacctatgtgttgaaaaattccacaaattatgaaatccttggttaggtgggtatgctggaccaggtgtgcttggtgagacattagttccatgagccataaaaaaagtgacattcctttggggatttactgcccctgaatcatgtgagagccccagaaacaaagcatttctcaaatatgcatcattttaggtagatgagaaagaagccacagtcacctccgccctctggactgcagagagcttagctcacatcggcatttgcatccaacagcacaacatggaaagcagtacacaacaagaacaggcagaagtgtcttcataaacacattttgcctaaatattctgtattaaccacagccatccacttacagggtgttaggataacttttagttctaggtgcttgactataaaatgatggcgatacatcaactactaatgaacatactactaataatagctagtatttctttctgactctgggcccagaactattctatgtactggagacacattaactcatgtaatcttcacaacagtcagcttaggtaatattattaataatcacagtttacagataaggacacatgcacagagaggttgaataacctgcctaaggctacacagtgagtaagaggagaagctaggaaccaaactcacaagtgtgacaccgaagcctgggctcctaactgcagctgatgctttcaaatccaaacctcaaatgcattaatgccttatatggcttgggcacaatcttgagaatttattcaaatgttacctggtttgtcagaaaatcggacagagatggacttgttaagacaaactcactttactaatcagtgacgaggcagttgagaaacattttacctggaagaatttcttgtctcttgtttatgagacaaaaatgatgatcggatttgataaagacacacttttactaacctagaaacagtatccaaatttaatacattaaattgtacctaatgaagaggccaacagatgtgtgcacctgatcctatgctgtaggtgggagcactgccctcgagaaaagggctcagcattccagaaaagcccagaaaaacccgatgcacacggcatgcttcaggtccatcttcatgaacaacacgaacatcctgtgtcctcccctaattaggtaacctggtcacgcgcttcctcctttcttgatctgaattcccacaactataagagggaaggatggcaggctaagttcaaaacccacatggagaagtcagaggggactggccttaaaaaaagccatgggtctgtccccaagtcagtcggccagtttgcaacgtctgaggtggctggggctcaatgtcaaatgaataatgaaaactcaactgggcatttacatttaagccaagtgctatgaaggggaaggccaaggtgctaaaggagcacacagcaggggtttaaactggtttggagggccagtgagatttcagctgatatctgaaaggtgtagcttagtcagctgagcaagtgttgagaggcagacatgtgggtgggttcgggaatgggagaactgcccaagggtgcattctgccttttctcaacagcagcacaaacttgagtaatttaaagattcatattcaaaaccccgtaacaatgtggccccagcactgagctgagggcaggagagctggtggtgtgatgcacgggtgatgtggtgcataaactatgtggtgcacaggcagtgtgatgcataggtggtgtgatgcatgggtgctgtgatgcaggggtggtgtgatttgcgatcagtgtggtgcacaggcagtgtgatgtgatttgtgagcagtgtggtgcacaggcggcgtgatgtacaggtggtgtgatgcacgggtggtgtgatttgcgatcagtgtggtgcacaggcggcgtgatgtacaggtggtgtgatgcatgggtggtgtggtgtgtgggtggtatggcacacaggtggcgtggcataggaatcatgtgatgcacaggtgctatggtgcaaagatggtgtgatggatgggtggcactggatgagtactggctctgctcatcatccagttctcttttagattaaattctccatgaatcacattaatttggtgcctcaccccatgctgtcgctacctccaagtggctctaattcttatttaggcttgaaattcttaagagttggatgctacactgaagagctgaatcatcctttaatattaagtacaaaggaatttcacgggcaatacaaacttgagcattgttacaactccaggcagatataccaacaggcagattataaagggcatatgctgtcagagcagagaaataacttgggagaatataaactgaaatgaccactttgaggaggaaaatttttaaaccaaattattaattcttctctactctggaattgcttaaaagattttctatcaaatggctttcctacattttcagtatgacccacaataaaaacctggatcattttacattgtgatgcagtgggcacaagtgcacacacacacatagagacacacagacacagacacacacatatacacacacagatacacacagacgcacatacacacatgcacagacatacatacacacacacatgcagacacatacacgcacacaggcatacacatatacacatatcagacacacacacacacacacacacgcacatatctccctaaacaaacaattctgccccttgtatcctgggatgcactaatcccatgtaatatgggatctgtatggtcccatccctgctgatctccatccactcaactgacttcatgacccaccaacgggctatagcgtacagtgtgaaaagcacagcgactctgaaaccatgttattaatgataacagtttccacacttccacttttctttgtcatcgtaagcaatgggggaaagtccttgtgcggttgtgcaggtggactcctacactgcaggcccatataggaatgcgtttggggtcaacagataaggctctggatgctgtgaaatgttctcagcacctctaactagggtgcaggagcacaggagcacagctgtgcctgttgttgggtgagtgatttttctgacagagtaaaaccttatttcgttggatttcactaatttgaagttcatgttcattgggtcaaaggttataggcaacataaacaagatagtagaaagaatattaaaatcaaaagaccctcaatctacaaataattgatacgttcattacaagtaatcctcctttgtgctttcagtcacatctcctctacgaggaattcacctggcacctctggaatagacaagcatgtgccatggcttgatcatgaaagtaccaccatatttctttgtatttaataatctggatttttaaaaagcacatctgactaccattcactataattaacacaaatagctgaagttctactgtatgaggtatgcattataaatgtttttaggtttgctattcaggacgtgtacatgcattcctataaaaacccaggtgagttactggggaaagaagatgaataaaagtccgactatgcgatgctgcagccgtggagctcacacagtgtgactactgcatggtgtggtgtgccagacccaaacgcaggacactcccagagtaacgaggtaggtaagggagcccagtacatcaatcccaccactggggagagcttggaaaggattttcaattccaacctcattgcttgggtgtgttcaaaacatcccactgcactgcccagagggttgcctcgtggtcagatgggtttggcaaatggttaaacagggctgtgtggctttctccgaggcatggtctccaggccaggtcacaagctaaggtgcataatgaatttccaggagagaatcctagaggctgcttgcctctgaccacatgacaggaagccaaggagcaggcttggaactctgctgcacagcagggctcccaccctccacaagggcattgaaaatgcgggcaatggaccagaggctgacagttacccacctggaacatgtcccagggaatacccccaaagggaagagtgctgggcactgcagcccttcttgtattctttagggcaatgatgtcctgggacccagggcatcggtatggattcacctgggactggtcagaatgcacatttctatatactacataagccttcctcaaacacagaggcccagcgatctgtgtgtaaccagccccaggtgatgctggcgctgctcgaggctgattgccaggctctgtgatgagggagaagtgcccacataaaggggctgcctgggagtttccgtcacctccaccttcagaaacaaaacagggaaaaatcacttcctcagcaaacgacccctccccttccctcggctacaaaacaatccagccccgaagcctcagggagaggtggctagggcccttctgagggcctgcttttggccaggggccataaggaagccttcacagcctcaatcacaccaaatcccctgaaaagtcctgtaaacggatatcacaggcccatctccaagatgagaagctgaggctcagggagttgcagttatctgacccaagccacagaatggccctggcagaggcaggtttagctcctgttctctgtgttcaccccactgcactgagaggcctcctgggaaacgtgtccacagccccaatacggacagaaccatgagggggccacagaagcctttcatggggcttagaggccacagagcgctctgagtgaggtcaggaggcctctggcatcgggcctggaagtgtggtgggatgatgggtgtgctctggagggtgcagaggaaggcacgagggtccacaccaatggacgggctggtgggaagcacagagcctgggagggtggctggagaaggtgccctgaaggcaggacgtgccttgacttctgcgggtgacagggcaagcaggctgggagtgtccttcagccctgcacctgtgcctgagtcccaatcaccgggtgttaagggacactgtggagtcagtgagaagcaggtatgaaagggaggggcaaatggaattgtctgggacaactgaaggtatctcaggcatctgcatcaagctgcccagttagcaataccaagctgagccaggggaagtggtgagggctgaggggttgtccgcagaggcacggtgtgagaaactgtggctgaaatgaatttaccctggagtgtgttgtgtgaggacagaagagacaaagagaaaaggcagtgcagctaataaataacaactgaggtctttaattaaacatcagtgaatctaagacttgaactcttgaaacatctgaagttgtcaacgtgaaataaatatggccatggggtccacactcccatgttttgaaatgaggggagagaaaagggttttgctctgctgtacacagcaaggggaaggtaggtgtgagcagacctcgggatcagcagggccaagagcagcgcatggctcccagttggtggctgaagtccgctcacccggggtggcctggggcttttaccttcatcagaatttcatttgaactttgccctgatgccaggcgatccatgtctgcatccaccctctatgaaggccagcctcagacagggtgggactggagacaaaggtggtctcaccggggcgtaactgccctggtttgaggaaggagcagtgtttacaggattctcctaatgactgcccccacactggtcctctgaggacacacgtgcacctacctccagcgtttatgctctgtgagagccataacttctacgctctcttactctatcggcattaaaaatcctctgaactctgacagcgcttcctgtgtttcctggagtcggtgcttctcaccaccctgccctccaactgtctatccccatcttcctgatgagacctcagccaccttactctgggtgggacgtctgtttactctttctcacacagtgctctgaatagagcctcaagaactgctgattcactggcttcattaaacccaagtttgggactcaagagcaagttagtttttcattgaaaaatgacatgtgtctagcatttgcaagcactgcgtgggtacaaagtaatatactacataatccttcctcaaacgcaggaccaggcagggcaggaaggacttgaggcaggcaaccactgtgtgccaagtgagaggctgttctggctgaatttcacccccgtccttcccagcaacacattcctatgttgaagtcctaactcccagaatctctgagtgtgactctacttggggacagggcctttaaagaggtgattaagttaaaacaacatcattagggtggaccctcacccaatatgattggtgtccctataaggggagagcaggacacagacaggcagagagagaagactgtttgaggacacagggagaagacggccatctacaagccaatgagaaaggcctcagaaggaaccaaccctgctgacaccttggtctttcaacctccagaactgtgagacagcaaacttatgctgtttcatccacccagtctgtggcactttgttaaggcaaccctagcaaactaacacagcaacacacacagcatgtgcagaaagaattcggatgggggaagctcctgtgggctggggtcataaggtaaggctttgaaaaagccgcttcagtggggcctggaaggaccggcacaattcagggtatggagggactgggagacccctccacataggaagggcaggagaggtgcagaggaggactgagcacggtgtattctgccgagtagattctggcctctcaggtcctgattcatggaaaaggtagacattgatgtctgtgaggagggctggatggggtgggggagactgggcagggccttaaatgaccggttacaaagggcaggaacccacaggaccaacatggcacaggggagagagttctagactagggcaagggaagccctgtgggtctacacattagccttgaagctggcgggaatgcccttagcttctcagggcttctgttattcagttgcagaatgactacattgaactctttcagtggttatcaacttctctgtctgtagcagtagatcctgttttaaaacatcaaatctgaatggaacctcaagatatcaaatggatctaggtggggctcctattgaagtgggggagggagaagcctgaggtggaccccaaggcatctactcattagtgcaggcctccatacgacacatgtacccatgaactaggctgagggaaaaccaaccaaccagccgaccaaccagccaaccaaccagccaaccaatctgccttacatctttatctctgttgacatctgactgatatttaacatgccctctcaggatgaactccacaggcaaccttcccaagccaaaggctccataatcgattcctaggaagcaaaggttacagggtggggaaactggaatctcagcaagacaacctaacattggaatcgaaggtcaactgactagggcaagactgagacaaggtgaccagtaagaggttctgtggctaaccaagtctaggatctgtggcagtcagagcagttccttgtgggagttacgttccaggcacgacagcaggactgggctgggcagcagaggaggagatcacaatgactgattttcaagcccaggaggagcagggaatgagggaggcagaagagtgaaacagagaaccaccaccaacagccattcataacgtgctttatcttgctcaaggctggcatcttctcatctgacaggggttactgttttacccccactttccagctaagaagcccccctgagagctgaagtgttttccacaatcacacaggcaacaggtcccaaagctggtactcaaacccaagtctcctgccccaagccctgtgcactccgtccactagaggctgaggtaaagctggaccagcaaggagccgtccctccagccagcaggcacgcctggtgtgctctggcggggaagcggggctgggcaagtgctgctgtgtttattcctcattcgggtgatgacaaaggcgggaacatgcaagttctctaatggacggtaaacagaagaaagcagaggtctgagaactgaacgtcagggagcagtcaagatcccatcaggctgcccatgtatttcctcttaatatttgacaatgaaaagggtaattaggactcgcagcaaagcagccttgcaatggaatcacttaaactaggccgtgggttctttccacatggaaagggcatatggggtgtagaaccgtgagagtcacgctgagatccacacctttggaaagttgtctgatgtaataaaaaatgagagtagacatatatgttttgacgtaacacagatctaggaggtataaggtaaagattcttaatctaatgggcccagaaataaaattcaggacacccatgaactaggctgggggaaaaccaaccaacaaaccagccaaccccacatctttatctccactgacatctgactgatatttagccggccttctcagggtgaactcagcagcatcagcagtgcctgtaattttttcatcaatagaaatcacagatattaatagttttatatcacattcctgttgttgcacatacctagaattaccgttgacattcatcactactctaaagtgatggcagtgatcagacctatcaggagaccttgttattaaatcttaaaaaaaattacaatttaaagtaatattttgataactgtacctcatacttcttacggcaagaaaacaggtaatacaaataaaaacaaagtcaggaaaaatatacagaaaaaaattcaaaaggatttgaaaagtgaggaagcatagatatgcagatacatggtgatatggggatctgtgtcccaccaattctcatggtggaatcataatccctaatgttggaggctgggcctggtgggaggcgactgcatcatgggggtggatttctcatgaacggtttagtaccacccccctggtactgtcctcacagttgtgagtgagctctcgtgagacctggttgtttaaaagtgtgtaatacttcccctcttgctctcttgctcctgctcccaccatgtgagacgcctgctccccctttgccttctgcctgattggaagctccctgaggcctccccagaagcacaagttgccatgtttcctgttcggcctgcagaaccatgagccagttcaacctcttttcttataaattacccagtctcaggtattcccaggtatttgcactgctatagggcaaaaatggactaacacatacgaatatacagatatgcacgccataagggtctctgtgtcttccagagttgtgccacaaatgtgacttaaatttgcttgtgtccaaagtgcagggagttatatggacagttgctgagttcctgtttttggaggagaggaggaggccccaaatgtaaaatgttggagaggttaaagacacagtagcctgatgtcccttgggtttggtccttggaaggatgctgctgtacttgcactagggagtatttgtgaagtaataggaatggcagccagattacagggcccaggacagcaacaggagcaacttccaacccatcaggctgatgccccacccacctccaggtgccactcactccagttctaaacagtgcctggccacaccttgcaccactccacccttggggacatggagtagaagcctgagctgccgggggcttcctacagcaaaatcttctgagcttgagaaacgcaggcaaactggcaatgtcttgtgggtcaattaccaggcagttcctgaagacccagcaaaggtacttttgaagaagctgctgggtcatttctaggtacatagcacctctcagaagcaaaagaaaaatgctaagaagaattaacgcagttgttaggaagtgagtgagttaactaaggtctcaaggaaaacaggggtgagtcttccgatgccacggagagaaagggcaggctgctgtaggcagggaggctgttagcctcatttatcattcatgccccctggccctgggaactcaccatggaattccaacaaggagctggcactgaggtatttattgctttctttgcatgtcagcttgtcacacgtaacaattaatttgatgatcccaaattggacctgacaggaaacctctcgataatacaccatgcctagatttagcagagataaacactgctgttaatttctccagcagaggatgtgagtatcaacccagggctgctttcattaatttccatctcacacaatgtgggcccacctcatattggcattgctccctttagctgatagctgtggccagttttagaagtgtggtgtcctagggttgcctgccaatcatttcccattttcaaagtgatgagaacgtgacaggggacacagacattgagctccatcggtgaagaaacagcgggcagaatgaagctggataagccctgaaactgctggtaagaagataaaatgcgactaagagaaattgtgctttcaatgaacttttcaggaacacatctatcgtgcagagtaaactccttcgaagtctagatatctgtgggtagtaagaaaaaataatattttttctctccctccacccctatactaactgtgatggttagtactgagtgtcaacttgattggattgaaggatgcaatattgatcctggtgtgtctgtctgtgagggtgttgccaaaggagattaacatttgagtcagtgggctggagaaggcagactcacccttaattgggtgggcaccatctaatcagccatcagcaaatataaagcaggcagaaaaacatgaagcaagagactagcctagcctcccagcctacatctttctcccatgctggacgcttcctgccctcaaacattggactccaggactccaagttcttcagttttgagactcggacctggctctcctggctcctcaagcttgcagacagcctattctgggaacttgtgatcgtgtaagttaatacttaataaactcccctttatatgtatgtatctacctattagttctgtccctctagggaactctgaggaatacagattttggtaccaggagtggttgtagaggaacagaatattaaggatggagttctttcattggttttggggtttctggagttggttgcttaatatgattagaccccaaaatgctaaggactctgcttctaatagtatggagaatactgataagtcctaggcggaaactgtttagacttatgcaaaataaatgcatttggcactcctgattcaccgcttgtgagaagcaaggagttcactcactctatacataatacctttgaccatatgtggagaaccaaggaacataatgcagcttgttggttgctcccaagttcagtggacaaactgatgaaagaaaatgatgaactcagggattctgtctccgggcttcagaagcagatactgaacctcaaatctgctaagattgccctgagtgagagtcttacctcctgtagagaaagagctgaaattgtggaaaaacagacacaagcccttatgatgtgagtggctgacctgaaacaaaaggttcgtgcacagcctcgccaggtgtctactgttaaagtgagggcattgattggaaaagaatgggaccctgcaacttggaatggggacatttgggaggaccctgatgaagctgggcacactgagtttgtaaactctgatgaaccatttttgccagaaggaatttccctattcccagtagtggcaacatccccttcccgacccatgctgccaccagcctttgcacctctgtctgaggagataaaccctgcgctgcctgagggaacagtgatgacctcttctgaggcagttgccaggcaagataatgttgattctcctcagaatccaccccaatacctctgtttgctaattagataccaaggtggcaggggccaagtggcagcactcgaccatcaaaggcaaggtgggtgcagctacgacaatgaacggcagaggcaatgaggcaatcagaatagtctgactagtgtagagctatggcattggctaattaatcacagtgttcctagaagtgaaattgataggaagcttactgcattcctacttaatttatacaagcggaaagcttctaggtgaaatggataaaagactaatttgaattagaaaaacagaatcacggctcctcaatcaatttccagacttgagtcagtttacacacccagaaccccttgaatgaaggggaggctgggtccccttgaggaaggaccctactacattaccaacaatttatgcaacaaatctttctcccatctttccccaaggtgacctctggctttttaccagagtaactgtggattggggaaagggaaatgatcagacatttcagggactactggacactggctctgagctgacgttgattccaggggactcaaaacatcattgtggtcctcagttaaagtaggggcttatgaaggtcatgtcattaacggagctttagctcagatctgacttacagtgggtccagcgggtccctggactcatcctgtggtcaatcccccagtgccaggctgcataattggcataaacatacttagcaggtggcagaaccccaacattgactccctgactaatgaggtgagggctattatggtgggaaaggccaaatggaagccattagagttgtctctatctaggaaaatagtaaatcaaaaacaatattgcattcctggagggactgcggagtcagtgccaccatcaaggacttgaaagacgcaggggtggtgactcccatgacatccctgttcaactctcccatttggcctgtgcagaagacaggtggatcttggggaataacagtggattatcataagcttaacctagtggtgactctaagtgcagctgctgtgccagatgtagtttcattgcttgagcaaattaacacatctcctggtacctggtatgcagccattgacttggcaaatgcctttttctccatttctgtccataaggcccaccagaagcaatttgccttcatctggcaagaccagcaatacacatttactgtcctacctcaggggtatatcaactctctggctttgtgtcataatcttattcggagagaccttgattgctttttgcttctgcaagatatcacactggtccattacattgatgaccttatgctgattggatccagtgagcaggaagtagcaaacatattggacttactggtgaaaacatttgcacgccagagaatgaaaaatcaatccgactaaaattcagataccttctacctcagtaaaatttctaagggtccagtggtgtacagcctgtcaagatattccttctaaggtaaaggacaagttgctgcatttggcccctcctgcaaccaagaaagaggcacaatgcctagggggcctatttggattttggaggcaacacattcctcattttgatgtgttactctggtccatttatcaagtgacccgaaaggctgtcagctttgagtggggtccagaacaggagagggctctgcaacaggtccaggctgctatgcaagctgctctgtcacttgggccatatgacccagcagatccaacggtgctggagttgtcagtggcagataggggtgctgtttggagcctacagcagggccccataggctaatcacagcagaggccactaggattttggagcaaggccctgccatcttctgcagataactactctccttttgagagacagctcttggcctgttactgggctttggtggaaactgaacatttgactatgggtcatgaagtcaccatgtgacctgaactgcctaccatgaactgggtgctttctgacccatctatccataaagtgggtcatgcacagcagcattccatcatcgaatggaagtgatataaatgtgattgggcttgagcacgtcctgaaggcataagtaagttacatgaggaagtggctcaaatgcccatggtctccactcctgccaccctgccttctctcccacagcctgcactgatggcctcatgaggagttccctatgatcagttggcagaggaagagaagactagagcctggttcacagatggttctgcacaatatgcaggcaccacccaaaagtagacagctgcagcactacagcccctttctaggacatccctgaaggatgcagtgaagggaaatcttcccagtgggcagaacttccagcagtgcacctggttgtgtactttgcatggaaggagaaataatcaaatgtgtgattacatactgattcatgggctgcagccaatggtttggctggatggtcagggaggtcattccaagcggtctgattcaccgtttgtgagaagcaagtttattgactttatacataatacctttgaccatatggtctgaccaaggagaccatgggcatttgagccacttcctcatgtaacttacttgtgccttcaggacttcctcaagcccagtcatacttacatcacttccatttgatgatggaatgctgctgtgcatgacccactttatggcttgatgggtcagaaagcaccctggatggctagggacttcaaagaagcatgattggaaaattggtgacaaagaaatttggggaagaggtatgtggatggacttctctcagtggtcaaaaactgtgaagatatttgtatcccctgtgagtgctcaccaatgggtgacctcagcagaggaggattttaataatcaagtggatgcgatgacccgttctgtggacaccactcagcctctttccccagccacatgtcatcgcccaatgggcccatgaacaaagtggccatggtggcagggatggaggttacgcatgggctcagcaacatggacttccattcaccaaggctgacttggctacagccactgctgagtgcccaatttgccagcagcagagaccaacactgagccctcaatacggcaccattcctcggggtgatcagccagctacctagtgactagttgattataatggaccttttccatcatggaagatggcatcatggcagaaatttatcctcactggaatagacacttactctggatataggtttgcctatcctgcatgcaatgcttctgccaagactaccagccgtggactcgcggaatgccttatccactgtcatggtattccaaacagtattgcctctgaccaaggcacgcactttatgactaaagaagtctgacactgggctcatgctcatggaattcactggtcttaccatgttctccatcatcctgaagcagctggattgatagaacagtggagtggccttttgaagtcacaattacaacactaactaggtgacaatactttgtagggctggggcaaagttctccaaaaggctgtgtatgctctcagtcagcctccaatatatgttactgtttctcccacagccaggattcacgggtccaggaactaagaggtggaagtggaagtggcactactcaccatcacccctaatgatccactggcaaaatttttgcttcctgttcccacaacattatgttctgctggcctagaggtcttagttccaaagggaggaacgcggctaccaggagacacaacaatgattccattaaacttgaagttaagattgcctggacactttgggctcttattaccttaagtcaacagggtaagaagggagttacagtgttggctggggtgattgacccagactctctagatgaaatcagtctacaactccacaacagagataaggaagagtatgcatggaatacaggagatccattagggtgtctcttagtcttaccattgcctgtgattaaggtcgacgggaaactacaacagcccaacccaggcaggactacaaatggctcagacccctcaagaatgaagcagggaaaaaaccacaacctgctgaggtgcttgctgaaggcaaagggaatacagattgggtagaagaaggtagtcatcaataccagctacgaccatgtgaccagttccggctccagaaatggggactgtaattgtcatgagtatttcctctttcttttgctaaaaacatgtttgtgcatgtatacacttgtactaagaaaatatctttattgtatttccttttcctttattgtgtgacataagatttactgacttcatatcagcatttaagtattgctaatcttatgtaatagtatttgggttggggatcagtgcgtttctggtagtacaaaggatagttgtattatgttaggtgtaattatgatcttattgtatttgaagattatgtatgatctcaggaaatgtgtatgggttcaagttgacaagggatggacttgtggtggttaataatgagtgtcgacttgattggattgaaggatgcaatattgatcctgggtgcatctgtgagggtgttgtcaaaggagattaacatttgagtcagtgggctggagaaggcagatccacccttaatctggtgggcaccatctaatcagccatcaacaaatataaagcaggcagaaaaacatgaagcgagagactggcctcacctcccagcctacatctttctcccatgctggacgcttcctgccctcgaacatcggactccaagttcttcagttttgaggctcggacctagctcttcttgctcctcaagcttgcagacagcctactgtgggaccttgtaattgtgtaagttaatacttaataaactctctctctatatatatacacatacatatgcatacatatacatatacatgcatatatatacatatatacatatacatgcatatatatacatacatacatatatatacatatatacatatatatacatatatacacatatatacacacatatatatacatatatatatatgttcacgactgcaagtggtcagatgctggctgctataccctgcctggacccagatgccacagcaatgtcaccttaatgaaaactatatgggggaaaatgacaacatctaagtgacaacacttcacccaccaatagcaacgcccttctcacacccaccacccaacgactgatactcatgccaaatctttcttgaaattactattccccaccatcctttacagactgcacttaagaaggaaggagcccacagaaccgaatatcaatcacagaagctgcatagccagacattcagtgttcgatgtaccgaaaaatcctctttacacgtctttatgcttctggccactacagccgcaaagtccagccattagaagggacagccatctttcagagtcatgtcccttgatgaaatgtcaatgccaaagaaatatagacagatatgccttatgtattttgccatgtctcctccctcttgccatcacagtctcctctaaaagagtaagcaactaaaaaagaaaagctaaatgttcagtccctgtaaaacaccatttacaataacaaactcacactgatagaaaagggaagatactgtattaatagcacatcaggtcaaaaaattagaacataagaatgataaaaaccatggcaattaattcaacgccctatatatagtctatcctgtaaatataatttgatttgcacagagctcctcagctggctattagtacagcgatcagctcaggtcttctaggccagtccttgctttgcagcacgatgccttgtaagaacaattcagtggctacaaaaccttggaaatagtacttaactcctttgggtcatccaagcaaaactactctcgtgaagctcatttcattgggatattggggaaagaaatagcagagaagggatggaggcacataagaaacaatcattaagaagacccaggcaagaaacaaaacaattcttgagcattttaagtaaagaaaaaggcagcatgttacagtcactaattaacacatagccctttctgaggagagattctatcacaggctccaggccagatactaaagcaaaagaatgtgtgaaaccaaactcctacctcattaaagatctctggtctgagttggccctacatgttattatatgccattatcttcatcttcattacaatgctgagttgtgacaccttctatgttgacagagctcctaaggatacagaaggagagtcgcacatcttgctctgtatcttaggggactgtctgctatccaagtgtacttgcgggtgtctatttggaagattattgaagtaaatgccaaaatacaaacggtgcattgtttgggtgcagaaaaaaacatatagcaaaaaagtaaacctgtgggatgtgttcaaggcaccatacagcaaaggcaatccatttccttgtgctaccctcaaaatgttatacaataatttctggtaaaaactctaaattaaaacaatttaaaagcacagcacctctaatcctgtttaagcctgaaatgatttataaatacctacccaggaactactctgccaccaaaggaatgcagatggcctcagtgaggattaatccatctctggaaggttcttgaggactaacttatcctttcttattttctccagagtctagcaaggttccacctctataacagaaaccccatgaatatgggactgctgttaattcacgctgtgcttttagttcttttcaaagcttacagatattcatatttttccctcattttcttttctctataaaagtcccataagagaaagagacacatgcacaaatcttgcactacagatgaggaaacaggcaccaaaggttcatgatttaccaggggccacccaggagcaataggccagcaccccagggcccatcagcttagggctttcctagattaaatgctttacacacatttcaggtagaccaggggaggctggctcttgtggactatgtgtacctaaattgcttaagagtcataaatgtggtccaagattttcaaaaagtcataaccagcacatgaactaacagaccaaagactcagcctaggtggggtcaaactaaagctgcagaggaaacattcctcctttctggttctgtgtccctaatggatgagggctccagtgacttggagggaagagtgctggtgctccccagggcctctcaacccgggtgcgcagccatctggacagagtcaagctctgacaaacccaacagccgccagggggtgtagctctctactccccccaggaggagaaggtgggggttctgcagctgtgtgctgacttgagcttcttcctcccccctctccccttcaggctcccctctgacccaacaccccatgggcttggcctcgctaaggctgggaaagggctgcatttgtttctatctctgatcacatttggaatccctggcaaagtgaaaacaaaccttccattcttcagccgtgtttgttttgggcccatttggcaccacccttcccatttcaggcttattttttttccacttatcgtcatcatgaatttggtagaggtgagtcattggttttaaccctggctccagcttcctctcgtttgtacttttccagtctaatttcctttatttgcagcgccttgaaagtctccaatcgctagcctctgacatggttatgccgggtcctgagctcgggctgtctccagtcctgaggcgtgtgggctcctgcacgctgggccaggggtttctgagtggttgttgtgttcctggttctgaggctcctgcccacaagatccgaagactcaccagggcagctgctgaccttcaggtggaggcagggagcctctgcagaagccggtgccgctgcagagctgctccaacactgccgtggtgtcttataaagccacaaagcttgagttgacaattggggtagaaggaaaatcactgaaactcctctgtcttaaatgagcttgatggaaagcagtccctaataatacaatcctagtgctgaaaagatgtctctcaacttaaacatttgaagtaggattttaggctttcttctcaataatttccccacaactctttgggaaaaggtgactagttaacagagcagaaacggtgggcaggagactggaagtctttggagtcacacatttggattcacatcttatttgtcagttactttggtaatgaccttaggcatgccattagtctttctcagtagatatacctgaccacaaaagagagtcccaccacttaccttgtaggatgtgaagactaataagactaagtatgtaaagcacctggtctaaaggtagctgtatttgctgttatttggctattagacttcctgaatactgctgaattgcttaagtcatactggggacaatcttctaaacttctcattccccaaggaccgattaagttgagacataatcataaagtcaacaggacacatgacagatgctttcaaaatagattcaagtcccatggaaaaaaatgttcaattctgcctgttggacagttgtcatttatactctcttccgcctcccctctggagtccttataaatatggtggccaattaggaagttatcattactcacccacagtgaaagaataaactgttcatgaaccattttctccctttaacacagtgttcatacatttctgaaatgtgtaggcttcacttgcattgcagagactgggatggtgtgtgtgtctcagataagtgctgctcacagcgtggtggggaacaagcagcaccactaactctgggagctcatgagaaatagtctcaggcccaccccagccctgctgaggcagaatctgcattctgaccagattctcaggtgatctgcaagtgcattcaagtttgggaggctccttggtcacacagaggaggcagaggtgtgacggtgaaggtgccggccccggcccaggaggcggggttctgactgctcttcagcccctgccacttcagcttagctgagggacaacaggcgagtcatatcaccctccaagcttaccctcgttacatccaaaattgtgaagggcctgaggttttatgtcacttgtcagctaatacgtcagcctgccactgtgtgtgcatgtgtgtggaaaagtgtgtgtgtgtgtgagtatgagtgttcacaacagaaggtgcaagacctctgagtcagagagagcagaaagaacgacatcttagcactagtttgctaagtgccagtccccacagtgatgtgacatggtgagggccaagtgtcacttatgcatgtagtggaatcatcacagaagagaagccccagaattagggaacgctgaccttgtacagggctgctggtgaccttccctctccactgtcgagagggagagacagagacttagcttgatcctggaatgtaagcaactgttttagggaagtggaagggaaacttctgtaagctgtattgtcctaaaatgtctccttatacgaacattattaacttggctgtaaatgtctttgctcagaggacctggactgtgcagaaacatgacatgtccataggaactgtctctcaatgtgcccatgtgtcaggagaatgggtggctggcacacagcaggcaacagtacctggccactgccccgggggagcttgtagtctgagaaccacccacaatggaaccacagtgtcatgagaggggaagtcccaggtgcctgtgggaacgcacaggggtcagcacaccctgatgaaggcagggctgtcaggaaagggttcctggggctggcttccaagctgagacttgacgtttggattggctggttctgagtgccaggcaggaagccctgacagtcggccgtgagagggtggtggggatggggcctgctgccttgctcctgatgctcaagggcccgacttcattctgagggtttagatgggggggactggggagagggagaaatacatgttgattccctggttctggcttggacaactcaatatccaagttatgagagcctagtaacaagatggaaaggggagcagagtttgagggacgaaaatggtgtgctgtatgtaggcaatctgctatgtttctgggagtataaattgagatatccaatctatgcagtcatcccttggcatccatgggagagtggttccagcacccctgtggataccacaatcccacagatgctcacatccctgatataaaatagtgtagtatgtgcatataaccttcacacatcctcccatatactttaaatcatctccagttacttacaattcctgatacgatgtaaatgctatgtaaatagctgttatcctgtattgtttggggaacagtgacaagaaaaaaaagtctgtacctgttcagtacagatgcaatcatccatttttttcctgaatattttcagttcacagttgggtgactctgccgtgggttgaacccttggatgcagaacccacagatacagaaggctgactgtctatgattaacaggcaaagaaaagaacatgaaggcggttgtaacttacttttttttcctggatatcagaaagtgaaatgctatttttttgtatttatttactaatatttgtttacaaatatttattcttttgagaattatttgttcatcttcttttgaattcactgggaatttgatgtgtttatgactgatttatatgaacttcccattcattttcagtctgtattaggttttcagctatcactgctactttttagaaaccttaagtgtggagttacttaaaatcctgggggaaagatttagactgagcccaaaggataggccaaaaagacaaaaaagaagacctctgatggaccaagactatgttcttttgccctattttcagagcttcagggaaattaaatataaacggatgtatggacaagtcaattctgagtttaagaaattaaagcagtgctactaattgataattttactgatttgttaatgttcttgagaaaacttgaccttccagtaagtccaagtaaacagatacaatcaccaaactcctgggttcaaattaatcacacactaggaaaaacatgtcttgccttagatacaactttcgatcacgaccacagcactggacagggggctgaggggctaacccacgaagaaggtctggagagatacccctacgtggcacccttgtgtcaaagtgtgaatgaattggggggagagatgcggagaggaagaggcagggggagagggccagtcagccccatccccagaatcaatgacatcatttattctgcttttttcaaaatgaacattgatgctgttcccccaaccagtacagattcaccatatttccacctatcgaaattctatgtgctcttttaggttcaaagagtatcaactttctcatgttaattaaacagcatgttaattgacaacatccatgttgttaattgtcctagtttttttctcaacccacggaacttatttaatattgcagggtatcaacaacccttttcccacaaagagtgtaggtttcaaaaatgtcaaaacaattccctcatgcccactttccactgaagccaggtatagctgaaagttaaccttagctacagaggtcatgctctgctgttctgtaggtaggaatgttagataaatgcaatgaattcatgctcttataatcaaacaaactttataccccaccaccatctttgaaaataggcacccatatcagaacatgtgtatttctactccatcatcttagcttccctccccttcatttcctacctcccacgatgctcccccaaaaagtaaacagcaattacttctcttaatttagattggccaagattgccctaaatttcattatcactctgaaactgctacaaaggaatgctcaacagatgtcatttataatcttctttattcctgacttagataaattcaaagtgatctagttagaggttttgtcaaattcttggaataccaaagatgtcccctattttccagtgttctttcttcggttgtccctacctagaatgccagagcaactacagccaaccacattctgactagcacaccaaacactcttgatcgtgcctagtttgcaggatccttagcctcaggcttgcccatacatcctgaagccatgtccacagagatgctactccagttccccttaacagaaaattcatccttacggcgaccccaagttaacagtgaagcagaagtgctcagacatccaggaactgccagagcctgcctggcgagctccagcatgcacttgtgggcccacgaggaccctgcctgcacagctgtgtcctgggacagctaccctagcatctgtcttcatttcctctttccacatgcattctgcagaaggccttggctaccattaatggtggttacgaaaattcaatcaggctgtcctcacaggcggttttctcaggagataaagacccttcactgccccttgccttctgtgctttctttgcagcattgctaagtctacttgccacagctcatcttcagctgtccatgtgcttatcatctgttgttcccagtggcatggctgccctgtgagaagagggattttgttttgctcactaatgtgtccccactgtgtagagtacctggcacagacgaggcacttacagacatcaggggaataagcaaatgcccacgtgcagcgagtggatgctcagatgtgcgtgccagggaaaacagctaagggctgctgctgaaaaaattatgaggacacgaaaccctgtcctatacaaatctactacaagagtgggggactgagagccccggtgggggggaatctttctctactgagagccctggtcgagaagaatttttctctactgagaaccctggttggggcaatctttctgtactgagagaccgggtcggggggaatctttctctattgagagccctggtagggggaatctttctgtactgagagcccgggtcagggggaatctttctgtactgagagcccgggtcggggggaatctttctctattgagagccctggtaggggggaatctttctctactgagagccctggtgggggggaatctttctctattgagagccctagtgagggggaatctttctgtactgagagccctggtggggggaatctttctctactgagagccctggtagggggaatccttctctattgagagccctggtggggggaatccttctctattgagagccctggtgggggggaaatctttctctactgagagccctggtggggggaatctttctctactgagagccctagtgagggggaatctttctctactgagagccctagtgagggggaatctttctgtactgagagccatggtggggggaatctttctctattgagagccctggtgggggggaatctttctgtactgagagccctggtggagggaatctttctctattgagagccctagtgggggggaatctttctggactgagagccctggtggggggaatctttctctactgagagccctagtgagggggaatctttctctactgagagccctagtgagggggaatctttctgtactgagagccctggtggggggaatctttctctattgagagccctagtgggggggaatctttctgtactgagagccctggtggggggaatctttctctattgagagccctggtggggagaatctttctctactgagagccctgcgggtggaggaaagggaggaatctctccatggctttggctggtgccagttttacctcagaccctggacctggattctgatctcttgctaccagctgcattggctttggatcccgagccctgtgtgagggttcctgaacctcactgcccaggctccaggtcctaacatctggctcagcagtgctccctgcacttcattccttttctgtaaagacctgggccacctgctcatccccactactccaggagacctccctagcctggcttctgcccggccacactgcctgtggtgctggtctttgtgcctgacttcccaacctccatgccactgtaaaccacatatctaaggcaatcttagcaatgtctgacttagggataggcaggtcacctgattctggccaatgagtttgctagggggcttctggcgaagctttacttgctcctaaaaagagatgaaagagaagatgcctgtttcttcctctcaatgccacttgtctgggtgtgaagcatggatctactatggccaaccctctgccagcctgtggaggcagctgctctaggaggagggcagagaggtggccctggaaaagccccaggcacccacctctcctgtggtcaaccccatcctgagacttcttcaaggagtcaatgtgtccttgctgcctgggcctgcagcctggctgcatgagatgcctctctccccaaccctgaagagtcctgatgtccctgaggagttcagccatggacctccagaaagtcctgtcaccacagtgagcttccgctttctcagtgatgacaatgtgcaggctgaacctagccatggttcccaattttcatgcctaaggacttcctttttattgaggtaacattcatagaacataaaatccattttaaccaccttaaattatacaatttagtggcttttaatacattcactatgttatgcaacccaccaccaccatctaattccagaactttcatcatcctcaaaagcaatcgatacccattaagctgtcactcaccattcccctttttctcctcagcccctggcaatcagtcatctgctgcctgtgtctatgcatttgcttattctggatatttcatataaatggccttgttgaatatgtggcctggtgtctggtttcttttatgtagcacaatgtttttaaagttcctccatgactgtatcattaatcagcacttcattctttgtatgacttaccatgttttgtttctccactcattggctgatgagcatttgggctgtttcaattttttggctattgtgaataatgatgggatgaacattcatgtacaagtttctgcttgagcacttgttttcagttctcttgagtgtatacctaggaagggaattgccaggtcacatggaaatgctgtttagctttttgagggtccatcaaactgcttaccacagcagcaagggccttgttttttgttttaaaaatatttttattatggttaaaacacttatcacaaaacttaccatcttaaccattttaagtgtacagcttagtagtgttaagtatatttacattgttgagaaacagatctccagatctttgtcatcttgcaaatctgatactctgtacacattaaacactaatccacatttccctttcccccagtccctggtaagcaccattctaactttctatgagtctgactactttagatactgcatatacatagaatcatgcagtacttttcctttggtagctggtttctttcactaggcataatgacctccaggttcccccatgacgtggcatatgacaggatttcccctttttaaggttgaataatattcctgcgtgtgtgtgtgtgtgtgtgtgtgtgtgtgtgtgtgtgtgtgtgtgtgtgtgtataccctacattttgtttctccattcatctgttgatgggcacgtgagttgcttccacctcctggctactgtgaacagtgctgctatgaacacaggagtacagatatctcttggtgaccctgctgctttcaattcttttgggtatatgcccagaagaggacgagggctaatttttaacacaaaaaactttgtggattgctacccaatatatgtttcacttttggtatctagatccttctggatctttagcaaaatctgacatctcacctctcaaggcctccatttaggagcacctggattaagtgatcctcaggttgtgtccaactctaaatctgctgattctatgagaatcccttgggtagaacaccacccttgatactccagcccgtattaattccacagtaatgactacagtcctgccttaggggatatgcactataaaaaatcaaagtaaacacctgccgagagagaagggaaggcccaacagaacatgtgaggataaagaattttcttccccaacatggctactactgcattcaccttttttcaccaactggaaaataagaagtaatcaagttaattgactattttatctttagagaatcaaagtccaagataattattactgattcagcaagtgttttctgagtgctatgccttctgagacaattgaagtcaacagggcttatctagataaaaagtacttaaaaacttcaggcctagtcattttaatgtaataaactcaataagggctcttactttcatgtggttattattacatatttcattctataaaatccaagcactggagagttgatttaaattcagttcatatgtttatgtagtaagaaaacactcctgataaatagtgcaacctttcaagtcacaccataaaaacaaaggagcctccgttccaagaggatgactgcagtgcagacacacagagcagagcctggaagggagaactgatagccccatttcctttcttccctccttccatcagatcaaaacagtcctgccggtgtagataggagtgtggcaatcttagaaggaggctgggacctgtggagggagagagagcaggaaggggccattcggaagctcataaatcacacctggtttccacatccgttatgtagccagagttgtacaaatactgtctcaaagcctattaccagaagccactggccctagaggaaagcctggccgcccgcactttctttcttatccccaaatctaaggagttcagccaggatctcggacatatgggtacccatatgctgtgccgctctgtggcgaggctttgattcactgcctgccagcctcaagcctttctctggcatccacctccaggacaggaggaatcaggctagattcactgggaatcctgacagtgctattaccctgtgttcctagggcgactctgagcaaaactccttaaaatactcacagcgtcatttctactgatcatgctaaaatacacatatccacaggtgttgggagaaatgtttaatttctattatatacaacaacaaaagtggtattgggccatgatgaattaatccatgattaaggcagtcccatgtgcttaagaaggcaattatttagctgggaaaatgagctaaacatgaagatatattctatttacatttattttttatctaaagaaacaaaatgaattaagctttgccactatttactatgtggcccccaggcagactgtccctcaccggcctcctggtcctgagagctcccagggaagccgtggggccgccacccaaaggcctccatgcccttcatctgctttcagtgtcttgcaacatacccatgactccatctggttaacggggtaatgagttcaattctctagtatcatcctcaatatatcccaagtgcctcaaactgtgctcagatgatgaatttagagtgaatttaagctaacttttacaaaatggacaagtagcttaaaaaaaattcctgaaaaaataacctctggaggccgaagttaatctcaatacaagcacaagtgaacataagcaaagggaagcgctcctgcctgtcgtcattggtctccatgttacaaataccaacaacctagtcacatgtgacaagaagcagctctccccaacaaaacctgaaattgcctggaagcccattagaaatttagatttacatcctgaatcattaacgagaaatcccatctcaagggtatctggaccttgagatgagctaatgatagtaccaagtcactagaaatagcaagacatttaaaatactgctgatttcatctttatcaaatatcttaccattcattttgtatatgtttcataacttatatagtggtaatgcagtgcacatgtatacttttaaaatgaatactcatatgctggggatgcatgcagaaaacatttttcttaattgatggagtgtgtgatcaaatttggggccacaccactgtacacagcatgcccttggtcaggaaaatgggctgctgcagtgctcagcctgagcaacagtaaacactggcataggggaagagagaatcatttgccatgtaagcatcatagttaataaattatcgtgctgtcattgctgttggaatgccaacagagccaggtactgccagctgacgcctagtagcacaaggtgctgcttgcttgttgtgggttgaatttacgtttcccccagaaacagaggttgagatcctaggctccagtacttaagggcatgaccttatctacaaacagggttgttgcagatgtaattagttaagaagaggtcatactggagaagggtaggcccctaatgcaataggacaggtgtctttataaaaaggggaagtttggtcacagacaggcacacagggagaacgtcaggcaaaggcagcagagtgaggctgccaccagccaagcactatcagaagctgcgagacaggcctgcgacagaccttccccagcgcctgcagagggagtgtggtcctgccaacaccttgatctcaagcttctggcctccacaactgtgagacgaaacatttctgtttttaaaccacccagtttgtgcaactgtgttatgggagcactaggaaaactaatgtgctgcttcttggtggagaggcagccagcctgcctggaagttctgcccactctaacctgggtggagatgagaatggctttgtcctaatggcagatctcgaagctgccattaggacagcctgcagcctctggagaggctgccagacgccaaccctccctgggcagcctcgcttgcacagatgtcatcctgcatggggcttcacacgcagcggatgctgccagcagactcggctgccgtcagggggtttgagggcttgtgcttgttctgtcaactttctgccgcccaagttgccacaggcaaaacgcttccttttaccactcccttgctggcacataaacggtgacacttcagcaatgccccattttgcctacaaacttggtctctgagtctcagtctgacaaacctgacaggaagaactgcccaacagcaacgggaatcttcctgattctccttcccagggcagatgggctatttgttactattttatgctgccatgaaatcaggcctgctttttattctgagggtcttgctgtaccttccttacagcttctccctggaagaggcctctcagtccataagcagtgacaaccagttaccccctcaaacagacactacatgtcactcagtgcctgggccatgttgcggctctgcctttggccagtgcagggctctgtggcccgtggcactccagcacctgggtcagctgctgctggcaagtggtgggccctgtctgccagcacagggcactcacaatattggagctgagccaggtacggtggctcacgcctgtaatcccaacactttgggaggctgaggcaggcgatcacctgaggtcaggagtttgagagcagcctggccaacatagtgatatcctgtctctactaaaaatacaataattagctgggcatggtggcatgtagcctgtaatcccagctactcgggaggctgaggcaggagaatcacttgaacctgggaggtagagcttgcagtgagctgagatcacgccactgcactccagcctgggcgacagagcaagactctgtctcaaaaaaaaaacaaaaacaaaaacaaaacaacaacaacaacaaaaaaaactggagctgagagctggccggtgctcagcatccctggtctactgaaatctccacacacatggtagagaacagggacacgcccctcttaaaaggcagctggcaactagcctggatataaaaggtgacattagaacttaagggtaatgttgaaattggttcaccaaacggcttaaagttcaaacatgcagatcatggctaaagataaaaattcccaggcatacatgcctgagatttaagctggcacattgctgggccatcttttaactgaagttttaaattttctatttattatcttaacaatgaacttgactgagagaaccattaaaaattgctatagatcaccatttggcatctgctacgggttgacttgtgtcctccaaaaaaggcatgctgaaatcctaactcccagtacttcagaatgtgagcttatttggaagtgggatctttattaatccagttaaaatgaagtcatcaggatgggtcctaatccaatatgaccagtgtccttatgaaaaggggaaatttggacacaaagacacacaaagaggaaagatgatgtagagacacagggagaaaccatgtaaaggcacaggactggagtgatgcatctacaagccaggggatgccagagattgcagaaaccaccagaagctaggggagcagcatggaacacatgcttcccacagctctcagaagcaaccaacctgccaacaccttgctttcagcattctggcctccagaactgagatgacaaatgtgttatttaaagccacccaggttgtggcattttgttaaggcagccctgggaaacaaatacagtatatctgcagtagttactgtttcaggcaagcatcatcagtgaatgctgaaagtagcaggcaaaagtttgatgagaaacacaatactcatagagttgcaaagtattcccccatgagatatgtatgaattacaaagggtaaaatagtaaattgatagtggagaaacttggcagatgccatcttaactgaacaatcaaagctggcatcaccggccatgagatggggagtgtcgtgtacctcctgatccaatgcatcaagaaggacaagacctcgcttctgtgcagcccctgccctgaaagcaggacctgaatccaatcatgaaggcacatcagaaaaattgaactgaggaaaatcctacaaaataaatgacctatactcttcaaacatgtcaaggtcatgaaagattttaaaaagctggataactgttctagattaaaggcgactaaagatatatcactaaatgaaggtataatcctggactgaaatttgtggcagtagtgggaaaatgggccaagtctgaagagtctgtagattagataacactactgtttcaatgttagtttcctgattttgataattatacagtacttgcttttagtaaacacacactaaagcattccagagtaaaagagctcttcagaagaaagttcgtataaacagacagatgtagatttagatatatgtgagcgttaagaaatgggaggagcagggctgggtgcagtggctcatgcctgtaatcccagcactttgggaggctgaggagggtggatcacaaggtcaggagatcgagaccatcctggctaacacgctgaaactctgtcactactaaaaatacaaaaaattagccgaacgtggtggcatgtgcctgtagtcccagctgctggggaggctgaggcaggagaatggcgtgaacctgggaggtggagcttgcagagagccgagatcgcactactgcattccagcctgggtgacagagcaagactctgaatcaaaaaaaaaaaaaaaaaaaaaaaaagaaagaaagaaatgggaggagcagcaagtgtggtgaaattttaccatatgaggaatatggtgaggggtagatgggatttttttagtactttttttttttggcaatttttctgtatgtctgaaattatttcaaaacaaaaagttttaaaaaatcaccacagatgtaataacagctatcacttaatacgtgactgagatggttgaggtgtttttatatgttgtctaattgaccagtgaattataatcacatgaggcaaatattatgattcccactggcactctaggcctcacccaggaccaagaagaggtccatcttggttggaaagggatgagggaactgaaaggctctcgcccacaaggctcagcacacacacagagcctgctgaagtccaatggcagggcaggaaaatagacacaccttccaggcattcatatcctaagccactacaagtgggaaggttataatcctaccttcaattaatttgatatttgtgaggtcttgaatctaacttaagcagcaatacagcccaggcccggttcaactataaatactaaattaactcacacacacacacacacacacacacacacacacgaatgggtttgaacagaaaaggcatgctgttttctggactgatgtaaatattatttacttcagcttctagtgttatttctgtctctgtcattcttttacacaccaggttttactttacttaaaaattaaaagaccctcgaagaagtgatgtgacccactgtaaagaaacaaacagttaacagaatgagggaccaagcctggatgttggactcatcagatgaagatttaaaataactgtgataaatatctgtgaaaagacaggaaatttcagcagagaaatggaagctatacatttttaaaagccaaatggaagtggaaatgaaaaacaggatatcaaagatgaattctttcactggacttattgccacactgggcacaagagaaaggagtcaggttcaaaagaaaccatctacactgaaataggagaggaaaaaagagtcggcggcagagaggagaaaaacagagcatccgaggcctgtgaacatatcaaatgttcactatgggtacaactagagtctcaaaaaaagaagagaaaaatgaagcaaggatatttttgaaaagacaatggccaacaatttttccaagctgatgacaccaaaccatagataaaaaatgctcagtgaatcccaagtaagatacatacaaagacaaccaaacttggtgcatcacaaacacactgttgaaaaacagaaataaagagaaaatcttgaaagtaaccataggtaaacagaaacattacatacagagaaaaatgacaagaattatggctgacttctcgctgtacacaatggaagccagaaaaaaatggaatgccgtgtttaacacattgaaagaaaaaatttttaactaggaattcaatatatagtgaaaacatctttcaaaagtaaaagcaaaacaaagacattttcagaaagacaaaacctggaagaattcatctccagcagacatttactatcacaaatattttcagaaagagaataaaacagacagaaacccagtgggaagaaataaaggacaccagacagaatgaacattagatgtgcataatgaatctttaaaagatatttcatatctatctttctttaaacatctttaaaaggctactattaaaaacaataacaatgtaagtggaagttgtagccagtggtgtgttggagctgacttacactggcatgtagagctgactgttcacatgtcttcacaagtctatgtttagtgatgtcatgttgttagtttaaaattggctgtagctgggtgtggtggttcacgcctgtaatcccagcactatgggaggctgaggtaggaggattgcttgagctcaagagtttgagaccagcctgggcaatgtggtgagacctggtctctacaaaaaaaatttaaaaatttgctgagcgtggtggtgtacacctctagtcctagctacttgcgaggcagaggtgggaggactgcttgagcccaggaggctgaggctgcagtaagccaggattatgctactgcaatccagcctgggtggcagagtgagaccctgtctcaaaaaaaagcaggtgcggtggggggctgtggtaggagtattcacaccataaaattagcaaatgctacaaatcgggcttttaaaattttttcttggagggccaggagataagtaatcaccagcacattattttttatagtattggtagaagtaaagtatatgacaaaacacaaagtgggtagagtggtaattagaagtatactgttgtaagtttcttaagttgtttatgaagtagtagactagtttctgaaggcagactaagttaaaatgagggttggcaaagcttttctataaagggcgagataataagttcagtccatcattactatttatttattccatttttgtaaacgtgcctacttgctaaaatttatttgtaaccccaaaatcaaacacacgtagcaccttcgtggtcattcacagacacaggcagagcagcgaaggctttttgtagtattttttgtgacaatcaacctgcattttcccagctgaggctgaaggtggtgctctgccttcttcccgttttcatactgtacacaatgtgcttctcatggcttccacggtaaagacactcttttcattttgttttgtaattaatagatatattggggaagatactttgagactacgcaaatatcctgttgactacgtaaatatcgtgtttttcctcaaacttttacccattaattctgacatccatcagtggatcttgtctataacaattactgtgctgtttgcctcctggtgatattctagttacctcctttcttatacattaagtaactggagttcttctacaaaaaagagctatccgttctcctggcttgttaattcaattatttatgtcagtatggactcatggatatttattttaccgtatgggttaaaatctaacactatcggccgggtgcggtggctcatgcctgtaatcccagcactttggcaggctaagacgggccaatcacaaggtcaggagttcaagaccagcctagccaacatggtgaaaccccgtctctactaaaaaaattagccagacgtggtggcaggtgcctgtaatcccagctactcgggaggctgaggcaggagaatcacttgaaaccggaagacagaggttgcagtgagctgagatcataccactgcactccagcatgggcaacaagagtgaaactccatctcaaaaacaaaaacaaaaaaatctaatactatcactttgttgcaaattattccagctaaggccataaggagattcttcaggtgggcttctataacattctgccctgccccaaacctttctggagaacttccttatgttctggcactacagtatattccaggctcatctagtatttttcctgtcctggcctggaatcaactacttctccaaggaaccgtggttcctctgactggggaatggtgtttagacaccacagtctgggccctagggatgcttatggctgcatgggcgtcagttctttaggccctctcagtgaacaaagctaggaaatacaggtatgacactaaccctctcatccatattcatttctgtatatctgtataggtatgtttgtatctaccatccatccatccatccatccatccatctatccattcagaaccatatgttcatacagatacttctagttcccatccaacagcaccaagttcatttcagtcttctccctttcctatttgtaacctctttctctgacagtgaggaactcggctctttgtttgttgaatcctagtattcacataaggcaatttcagaattgctaaaccatgccccttaagaagcctgtttactaactgaagtacaccatttatgcatagttttttattgtctttagccttatagtatccacttaaaaatgttgttttccaaagttaattaggtaactccctactcccttaaatatggttatatcaagcaattgcatttcccactcccttcaatccgtcagtgcttgtacgccattctgggtccctcccacctcttggttgatgtgaattgttggcttacttgtcaggtgtgtgaaacagtgccatggttctaggtcagaaccatgcaaaaagtcaagctcagggaagaattgttccttattccccatttctgtttcttccttctttccaccccttttccatccaccacttgtcagtgaccaaacccgttcttttctggtttacccctcctgttatccattcctttttaatatcttgtaccaagcccagatcatggcagaatgtcagcaaatgtttgacattaaactgttttctctagtgaaccctgactcctaaagtccattctatgtctgcagtctctcctttacataatgaaactggctactttatcttatgacactcgacaaaaggcttggaaaccaccagtttccttaattgggtcggctcgagatggaatcaagcagccacgcaggaaagtattagctaataataatgaagactattactcttcctggacatgaagaaccaccagtaactagaactcaggttgacggaaattctttggcagcattttcacattttggctatattttttttaacacagcatctcaaaacaacttggtagcataagaaattacgtttaagtctgtggaaagctacaagattaaagggaataagagttgcataaacaattgcaagaaaaataactagtaaaagttgcagggctttttttttcctgtcaacacagtaacatctttaatcttccacttgtcccttttctctgtaatcagtacttgattttccaattaatggggaaggaagccaccagagatgagtcagtaaatttaaaactagtcttgaatgtctggcaaggaaaagaaagttttgcaaatgtacatctatagctaagaaggaaactggcatttggtgttaggtactcattttcatatctgaacaacactgggatcaaaattaaagaatataaaactttaggatcagggtaatgtggataggaaagtcacatgctataagacatttccaagaggataattaagtgttttatacattctgcaagtaagtaggcttttccatacctgaagtaaaaccagcctagtcccctgaaaccttattgtaaagtgataattagaccacctactgacggtgaggctgcaaaagggtaggattatgggtttgaggagcgcagacaaggttatgggcaaccccagaatcagtaagtttcatttacagagagatcaggattgcaatctatgtggatccagggacttacgtgacatatcaggggcaagggcttccaaaccaagacagactcaaggctgaatcctggccaggccaatgaccgactacatatcattgggttggaaacctccctaagctttgctttcttcgtctctataatggacacagtaataccaacttataggtgcggtgagcactaaattcaacgtgaagcacttagcaggtgcccagcacaaaacaagagcccaatggctaagcaaagcctcgtggagcagcgtaaggaatccagaagctgccaccagcactggaatgctggcactgccacttacccaccgtgtgccctcggaaaagtcacttcactctcagagctcttgaagagggagtagtaattcagaatgggagtaatagccaataataaacagctctgagatagggatgataacaaactgagcagtagcacagatcaaatgaattaatatgaacagagcagttagaacagagccgagctcattgcactctgtaagaatgagtgatgatgatgattgattatgattattcaatcagtccaccagagaaatggggagtgggagtgcatggtggtaaaagtaaactattacacagagtaccaggcctcgtggagtgtgttagaaaaagctgttttggcaacttacatcaatagctaaagagtgtacacaggcttaccccgttctgtaaatgctgtgtcgagttgtttaacccacagcagtaaacagccaagccaaagtcaagaggacaagtgctaacacactcatcaggaatgtatcctagcaatttggctgcagggaacaacaacaacaaaagccttgctcatgtgctttgcaaaccataccctgcagtcggcctgcttcaaaatatctggttctctagagatagagaacaaatctttaaggtaaataagatgctacaatctacagcgctggggtgctcgatctttcctcttcaactgttcatcctctggcatatttatttaaattgatcatcttctagaaaagctgcatgtcaactcatgaaaaaaatcaacagaaagaaaactagtgggctgttctgtccttatttctaaacttgctaataaattactatctctcattgtattgacactgtgttaggtagggaactagctatctgtaccttattccacttaaactcaccaagaaaagcagtgtttcattaactttccaggaactttttttccaggcaaggcgatatctcttgccctctttcttccttggggaaacagatggttatgaagaagggcaatgacaccccaggtttcctagagggaaattactacaggcttacacactcttagcctcgattcccaactcaagaatgctcagaaaatggaaggcttcctcataacttgtacggaggcaaaacttaacctgaagtgacactagtccctaaatttaaaaaaattatctaattcggtttgaacatcacatatagattacaatatactgcctgagaccccactgggggtactatgtggtatatgcaaggttttattctcctagggggtactatgtggtatatgcaaggttttattctcctaaaagcagtaatatcctcctagactcccaaatttctccattctaaaatacgtcgggccgcaagtcctacagatatacaattgtgaacttacaggagagttgctgatgctgttacgttccaaacatagctttgtgaatacagtaagtgagaaaaataattctagcgttttttttttgtttttttttttttgagacaagagttttgttctgttgcccaggctggagtgcagtggcatgatcttggctcaatgcaacctccgcctcctgagttcagggggttctcctgcctcagcctcctgagtagctgggattacaggcacatgccaccacacctgactgatttttgtgtttttagtagagacggggtttccccatgttggccaggctggtctcgcacccctgacctcaagtgatccacccacctcggcctcccaaagtgctgggattactggcgtgagacaccgtgcccggacaattctagcattttctttaaactgccttcttttaaaccagaactgggactgaatctttacactgctaatctcatgatttaaaatggacaataatcactaataatcactcagaaatgtcacccaaaatgctgttcttccctcacgtggccgctccgtaactcatactgtatcaggttttatagacaatactcaatggggaaggccacttagaagcagacaggcagggttaccaagaacatgcaccacttcctcatgtgggtgcctactcttggcaactatccatttggaagcctagcccgctgagcactccatgagaactgggttgaacttcctgctacgttacctagcacggtgcatgatatgggcaagctgatatcctctttggggttctgtttccttgtacataaactggggagaataccacctactattcaggactgctggaatgaaatgaaataaaagcatgggcctaatccacaggaatcaaggttagcttctttccacagcctctttccccttccacaccctctcctcttctgactgagacatcatctggagacaggctgtataagtagagagcttagtgctttcttctacgtggacgagctcccgcagaggtgtgttagtggtgcctgtttgcgtattgcaaagtcgagagaaatggattcctttcaaggtccctgaacccaactggaaatctgaacctttaaggaaaataggtgttgagcaggggaggaggggtctgcaaggagacccctgtgcaggccccaggagggttggcagcagaggtatcatataaggacacccagtcactcataagggcatggccttgtaattctagatctggctgatgatccgagggaggaaatgcttcaaccattctgaaatcagaagttcttgccccagctacacagacagccaggtccacccctgaggttcaactagtgcggcaattctcaagggtctccatgtgatttcagtatggaagcctaagttgcaaactactgcccagaaattgttagtatttgtttctctggaatgacaacagaaacctggagtacaaaagactcacaggtgcaagaatttgcctacttcgtccactctggtggtccagccttgggaagagggtggctggcagctgtgtccaccatcagaaaaccaatgagccacaggaagctgctcctgcttggcttggcttgccctggcttccaggaagggaggcacactggctaaacccaggcacctgggcaggtggaggtaggtctctaactgtgcagacagacggggcaccagcccctgggtgtggggtggggaacagggtgggcgcgtggcaactgctcaggaaagaggacctctaggggctctattttctcccctgactgaaaacaaagccccctcctccctgattaggaagggaaaaatacacagaacagggccccacatagcccaggagttatcagaatcatagaacagagaacaaatgttaatgcttaaccgaatagggtttttggaaaacatgctcaagagtcgctagcatcatcccacctggggctttcccattcctggtcatccttgtctttctcttctttggtgtctcctgtatgtgggtgtttctgcacaattcgcattccaccagctttcactgaaatgaaaacagagagtgtgggattaatgtggaaatggggctgcctgtggatcagggggaccagctggaaaggttctggttgctcagtggccacaagtcagtctggagaatctggcaatgaaaatgattaactagggaaggtcagggttgtcggggtaaattcaaaatgatacagcactcaacataatctcttactacagatccactcagaaactttccaaggctcttgtttttctatctggtcacctttcaagtattttgtcagagcagcagtgtaacgagggcacaaactacacaaagagagtggctgctgctttcagttctccacagtctcaacacaagagctcacctcaaccctcccctgtgaaatttactttctcaaatatcgaagatgtttttgatggggtgatatggtgatgggtgacatgggacagctactgtgccttcacagagcccaggcaagtggcaacaaaacttctactgcagctttgcccaaactgtgctgtgaaaccctaccgctggcagatgttaacttagttttaaaaaacagctttatagatatgtaattcatgtagaatacaattcattcatttaaactgtataattcgatggttttgagtgcattcagaattgtacaaccattgccataatcaattttaggagattttcatcaccccaaacagaaaccccacagccatgaacagttaccctccattccacccctcccagctcctggaagccagtcacctggacttgcttatttcggacatgtgatataagtggaattataaactatgtggcctttggtgactggctccttgcacttagcgtgttttcaaggttcatccatgttacagcacgtgtaagtatctcattcctcttcttgtcaaatattctattgcatggatgtatcacattgtatctctccactcatcaattagacatttgcgttgtttctacttttttggctattatgaacaatgcagctgtgaagaacttacacgtaagtttttgtatggacatatgttttcatttccttgagtatataccgagaaatggaactgccaggccacatggtgcctctgaatttatccttctgaaaaccaccaagctgtcttccaaagcctccacactatttcacattcccaccagtgtgtgggttccaattctccacatgttcccgacacttactattgtgtgtctttttaattatagccatcctagtgggtgtgaagtggtctcttattgtggtttgatgtgcaattcctttatggctaatatgttaatactgtgttgtaaggggtcgggtaatctagcatctattaagagtgggaaatgccaggttgaacaaaattaaataggtttccccaagagagaccttcttggcccttagtgtgctacctgcatgaggaagacttacaggaggcatacagcttgccagctctccccagcctatctgaccacacaactttttttttttttttttttttggctataataccagttatcctccatcagggctacagtgttccatgaacagaatttggaaatgctggctggccctaaatccaaaaagccagcctcgcatggtagccaccagcatgtgtttggggtcggcacgttcctccacgccctcagctatgtggtctcagactagtgtctcagattctcaaagattccctgcttcatctgcagaaaggagataaacctcctcagactattaagaagagagaggcgttcgggagagtggggtgctggctagaaagcagggtcattttccttgtagtcattggccccccaggctctggatgtgggccttactgagctttacccttcaagtctctgagtctctgccacaagacggctaacatcacgatacagtcaacttgccacaccatgtcctctggcattttaaactgagtggaccctgccgagtcacgaaaacccaggccaactttctttatgctgctgatgaacgggaaggagaatgggagaggcagcctggggcttacatgcttcaggtgtactggtcttcaatttccctgggagacttggccagcccgactggagggagatggtgacgtttgctcccaggaccagcactgccccagcagctggctgttagaaaagggcaaaagagagcaaggaaaatgacgactatttcctctggcttgggtttagaactaaaatctccctgctgcccgcacctcttctcaacggagaggacattctacttggggcagaaggaaacagaatcctgttcagtaatcctctcaaaaatctgctctatatcccatcaattgatttttaatcactctatttttcattcctacagcttttgtctcaaattcaccaggtatttgatggggtcttattcttttcttgtgcgttcaattcctttatatatttaatcattttagttgtatatccaattatttgattttctgaagtcctctggagtctaatcctgctgtctgtttttgcctgtggattcttgctcttgtcctgggagacttggaggaggaatctgtcttcactgggctttaccagtaaggatctcatggggcctgtgatgcagacagcaaccctctggggagatgctacacgtgtttttgtcaggccaggagtataggtgtctgaaaatccttttcaaggcagatttctcagaagacaaattgccaaacagtacaaatacgaactgaactcatgtaaaagcaagcctttgtttacaaattctcaaggagacctctgtccccatgtggagcccagcctgacacagtccggcttcctggccctcctagggccactgggcaggtttccctcttccacctttccccaggggtgtggcctctgagcatccaaccttggctactccctgcctcctgtgggcccacctctcatgctaaaggtctgaatttcagttccttcttcgttttgggtttccaggaattcctttcacttcaaggtcaaattcttttaaaaaagcaaaaagccaaagacaaaacagaaaagacctaccatttgcaggcagctttttaatctaagattaaaaagatttcccagcctacgtagttggcctcccaatcagaaatggagactgaaaatacaattatctacctacaccttagggtcattttccactctcttgaaacacaggatctcagagttatgaatgtttcgggctcaaggaagagcttagaagaactgtcccactaaatattttttaaaaattcatttccctccctgctctatcccacctctttcccatgctcatcagaaattgatgaaagatgctattacgggctgaatagtgtccccccaaaattcataggttgaagtcctaactgacatacccttaaattgtaattgtatttggagagagggtcttaaaagacaattaagttaaaatgaggaattgaggtagggctctaatataatagaaatggtgtctctataagagaaagagacaccgggtcgtgcacacacaaagaaatggcctgcaaggaaacagcaagaaagtgccatctgcaagcccaggagagaggtctcaggagaaagcagagctgccaacaccttgatcttggacttcagcctcccaagctgggagaaataaatgtctatggtttaagccacccagtctgtggtattttgttaaggcaggccaaaccaacaatacagatgcccatttaaaaatgatctctgaatctttccaacttggcacacataaaacttttaaactgtaactcacagatgtgttcataaagtaaaaataaaaagagctgtgcaactaactataaagaaaactaatgatgaatgttaaggtgacatttgaaatgatcaagtcttctgaagctcctgcagggcagcctgtccgctcctctgctgaaataagcacacagtgtcaaggctcagtcacccagcattagcacttgcatttaatttagtttctaaaaacaattaacttcattaatccctctcagttatgtttggtgattaatgtagcaataaaaagtggcaataataacaataataactcaaagctgagacagattcattttaacttacaatactgccaaaaaatatgacagcacatatttattgtgattgttgtatcactgtctctagaactcttcatttgtaaaactacaaaagaagaattacttttgcagaaatctttgcagaattatttgcaaatcagtatttttaggagaaacagaaaaaccttagatttttgtcgtggtggttgttattcaaatgagagcttcaaatgtaaaaaataagcttcctcttagcagaagtgctgtgcagaggataagaacacagatgctggagccagaaccttgggatcaaatcccagttctgcctgtgtgtgtgtgtgtgtgcatgtgcctgtgcataagtgtgtgcacatgtgtgcatacgtatgtgcttgtgtgtgtggctgtgtgtgggcaagttgctgaagctctctgtgcctcagggtctgccacctatgaagaaagagtgaaaatgttcccctctcccagggccagctgaggattacatgagttaggacacatgaaatgcctccaacaggacctggcacacaggatgtgctcaactgttagctagtcttattaaatgggtttttaagttagcatttagtactcaagagaggcctctggagtcctcaaatcgttggtgcttttccagctcttcaccctctcttcacagcagttccttaaagagcgctgccctacgggttgctggggaatgaaggccatgccctgtaaagcacctgcccatcgtggtgctgaccaccaccaggacctccgtcattacatcaccacctgaggaagctttgggagaatcacagatccaacttctgctcctcatcaccactctgtggcaggcaccgctctaaccacttggagtccacgcatctttcactgcacagcagccccacggagtagatcctgaggcagggagaaggggaagccagcggccccaaatcgcacagctggcaagcggcaaactgggttccacccttaatcgtaggtaagcctttccttgatcagattccttccaggaagcagagcaccatggcttctgagagtaactcaaaggaacggcctacagacagggccaggttattacactacctagataagggaaggtgagtttgaaatgaaaagctctccacagagcagctgcctgcccaagtgggaaggggagtggaggaagctttacctacggtcacatctgggaggtaagcaaacaccaaggaggcaaatgactatgtgggaccctgggccaagcatccgtcctcaggtgtcaggatgcctggctgtaagatgcagtcactggtggcttgctatctgctagtgccaaatagcaaactagaaaatgctactgcgggaagaagaaaggggaaatactggaagagttccatgaaccagggagcaatttccagcagggagctaggaagggctgttaactcacacaaatgtcccaaaagcatccactgcaggtactggagtatgactcacaagtatatgctacctttgttcttgcctgagaagagctatggaaatgttattcaaagggaagctcttctacctaaaagaagtgacgaaaggttctgaggactgttccagtggaaggaacaaaacaaaacagaaaacaaccagtgctgcaggttatgattaaaccaaaggatctcaggtagagcaatgtagtggcaggtaagcaaaggggctggtgagattaggtgggtagaacttcccaatgcgaacagggcaagggactatggcctatcttagttaagaaaaatgactccaccaggagagaggagaatcactggcaagtggagactcacatctatggaagcccatgcacctgaaggtgggaaccctaaaaagtggagaggataaaggggtgagaggcggtaagaacgtatgcagagagtgggtactgacagtctggcccaataacagacataagttatagaagaccccaatgagaaccttgcccccagaccaagtggagcccttacaggagctttcaggtgtgcatagataaggtagaagtaatggtttgtgctaaaaaatgagctggagccccagatactttcctgaatttgcactctcgttggcttcatactgctattctgtgctcagaatcatagactgtgaaggtgagaaggctcttaaattacacggagcaaccctgttaaagaatgaagttcagagacatagtgggacccccctgggccaaacactccatcttccacagcagtgtgtgttccatccttgacatagtttctgacccaaaggacaaaatgagtactgactgggccaggatgggcaccttgccggacatctgactgggcccctttcaagctgggaggtacatggagcagctacatgtatatccttgagtgcagggaggctgattcaaaaagtttaggggaaagtaggatcggctgcctggaagtgctttggaaaagctgtcattgggaattggttgaggctaggactagtcaggtgtttgccagtctcactcccagcttccccgtagttggattgggggcatcaaactgggtcctgcccaatagtatggggaaaagtgactttggtgggcagcatcatgtcatcacgtccccccactctggaacctgtgagtgtgctgggctacacggccaggggaaatgagggttgtagatggaattaaggttgctcatcagctgactgtaagctgaggaagaagaagggaaactgctattctgtgcttagaatcatagactgaaggtgaggagattattctggattacccaggtgggcccatgtaatctcaagggtctctgaatgtgaaagagggaggcggaagagtcagggctctgagtgtgtgatgtgaggatgtgactggtcattgctgcctttgaagaagctttccttggcttgtggaggaaggcgccacgagccaaggaaagtgggcagcctctagaagctggaaaaggcaagaaaatgggattctccccgatcctccagaaggaaccagttgccctgtggatactttgattttagcccagtgagacccatcttggacttctcacctctagaactgtaacataataaaactgtgttgtttagaaccactaagtttattgtgatttggtacagcagccataggaaactgatgtgatgatgcataccacttgtgggccacaccatacggaccccagcacggcgacctacacttgtcccctcagcagcagccacacaatgaaaagctagtgttatacagcaaggggtgtctgggcctctgaattgctctttgttaagaagaccccacccaggagagaaataaacctggattagtttggccactgagaatttaggttgtttgttacaacaggaagtaccattctctatacctaatatagtactttatacaaaagtgaacattctctatagaaacaaaaaaaacttctgaagctgggaagggaaaagcagtcacaaaaccaagtaagaatgcacagggcactggccgaaatgaaaaggacactcacaaagacgttagaagtcacagataaccaaaaatggctagggaaggctgggtgcggtggctcatgcctggagtcccaacactttgggaggccaaggtgggcaggtcgcttgagcccaggagtttgagacctgactggacaacatagtaaaaccttgtgtctacacaaaatacacaaattagctggttgtggtggtgcacacctgtagtcccagctactcagcacactgaggcgagaagatctcttgagcccaggaggccaaggttgcagtgagccaagatcacgccactgcactcaagcctgagagagaccctgtctagacaagaacaacaaaaaaaggctagggaagaggtgaaatgccatgggccaccttgacagaaggcttctgaaaaaagatagtaactaaagggtcttgttttccttggcatgttgggaacaagggcagacctcttacctggaccattcaatttctggtcctgactggttgacactgggactatgcttagcaaatctgtgaccacagggttaatagaagacaaattagtcttctgtttctagcaatggataatctgaaagtctttctgcagggagataattcagggagaattacactagacttttgaaaggcatccttaactcatgtctgacgtatcaattagtgtaagagagaactaagttactctgaagttactaaaaaaagtaacatggcttgaaataaatataatcgtgcttatatttccatttaattcactttgagaggggatgtagagtctgcttttcaaagaaaaccacatgtaagattagtaacattcaaagctatcatgtagcagatttatgagaactctactgacacatggttttggctccactgggaaatggaggggaacagggccagcaaaatgtatttaacaaagagattttacacatctcactgccacagactcacaaagactggcagaaatgagtaatagcgaggcttataattaggtcctcttttctgctgtggaatgctatgactgctgttagatgaaacagaaagaatctcgctaattctaactctgctaatctgcatttgcaataactcatcaaacaagcactcaccccatttctctgcaaatattttgtagtcaagagcagtggtaaggtctcaaatcattaaggctggattacttctacagaggactgcagacgacagcacatttgccaggacatgatgcagtgccatccatcacttgtaaataacaatacctgtatttgcacagcacctttctctaacactcttcagaagcctttacaaactgcctcattcgtctcccaccttgggaggaggcacctggccagtgatggagtcgtctgtcgggctgctgaagttccaaaaggcaacagcctttccggccgctcccactaggtcactagctcaggggagttggcaacagacactccaaacaattgggtcaggttttttttttttagacgaaatattcgctcttcttgcccaggctggagtccagtggtgtgatcctggctcaccacaacctctgcctcccaggttcaagcgattttcctgcctcagcctacagagtagctgagattacaggcacccaccagcacacccgactaattttgtatttttggtagagacggggtttcaccatgttggccaggctagtcttgaactcctgagctcaggtgctctccccacctgggtctcccaaagtgctgggattataggcgtgagccacgacacccggctctgggtcaggtttttaaacggcactgtcctcggtatctcaatgttaagatgactggtgatttcatgagttaaacgtgccaagcgcttagaagtgtgtcagcacattgtgacactcaacaaacttcattagtgtttccaccagtctgctgcctgaaccggccaagaggaccacctgcatccctgcgcacagtacagagagctcagagttgaggaaggtgtgggcccggtttgctatgggggcagtgaggggtgagaagaggccctggggaaactctggagtgcttattgagtattttgtgccaccccgggaataaagagatcaagaagacccagccctggaagcaagaagacaggcagagaggcgaaggttagtgcacgaaggaaaacaaggggattgcggggaatgtacaggagatatgggccagacagcaacaaagagaagacacaaaagaacattaagatagtcactgtaagagaattttattatttctgattgagcattgaggcacaagtctgttatccaatttaagcacttaatgaaagcattctcaacatttttaaggcagtgattttgatttatgaactgtgctcttggctatccttgatgattatcctttagtgtagtgggccgccttttttttttttttttaaaaactatctacccttcagagctgcctactctctggcaatgccagactaaacaagaacaccagagcttcctgccagaaaaggttcacacatggtcctctgtaacatctaggaaagcgcatttgaggggtgctgttggcatctgaggggtgctgttggcatttgaggggtgctgttggcatttgaggggtgctgttggcatttgagggatgctgctggcatttgaggggtgctgctattgggcccctcctctaactatggtcttggagacagatgacagatggtgacagccacccgcaagagctcaccccgtaagtctaaaggggttgccctgaagttactagaggagtttacctgggggatgaacagtgctggtaccctgatgctgaagcgggacgtgagactcactgcagcaaacacagccccaccctgtgacttgccccgaggcccaaacctcgaatttcataaaggagaaaaactgagccccagtgaagcgtgaagtgatgtcttcaaacttagaacccaagctcactgctacactagcacaaataagctgcctcttccctcctcaggggtaaataaactacttactctgtaattcacaaagcctagctgtttactctgcaattcaaagaaaaccagagtccagcaaggaatttctcccagggagtgagtatgtacagtttatacctctgaccttaaaaatctccatatgggcactttggaaggctgaggtgggtggatcacctgaagtcaggagttcaagaccagcctggccaacatggcaaaatccggtctctactaaaaatacaaaaatcagccaggtgtggtggcaggcacctgtaaacccagctactcgggaggctgaggcaggagaatctcttgaacctagaaggcggaggttgcagtgagccaagatcgtgccactgcactcccaggtgacagagtgagactctgtttcaaaaaacaaaacaaaaaacttctttatgggtgtgtctctgtatgcaatttaattactgtactttggttctgtatcattccaacagatacgctttaatgtaacccatgtcctggggagtggagggccagagcaggtggctgctgcagttcctggaggcagccctgcccggggtggaaatcaaggcgctcctccccacagtggacagggacccgctgtggtggaatggaagtcagttatccttaaaagaaatcccatcaaaaaaaaaactccctttgaagtactttttttcttaaaaccaatgcaacacaaattcccccaaaaccattttccatcacagtggaatgattttctaaaaccccatgcctcttaagttctctggcatcagttagacatttttctttcccagtgccagttagttttgttgtagagagcctccgtcaccactgaaaaatattgcctactctggactgcaacatatttaaagaacggctcctattcattgtgctggtgcagagaattcccgccctatagcggaggacagcagagaaggataatgggaatcttttttttttttttttttttttttgagatggagtctcgctcgctttgtcgccaaggctggagtgctttggctcaatcttggctcactacaacttctgcctcccgggttcaagccattctcctgcctcggcctcctgaatagctgggattacaggcgcccgccaccatgcccagctaatttttctacttttagtagagatggggtttcaccatgttatccaggctagtcttgaactcctgacctcaagtgatccaccctccttggcctcccaaactgctggggttacaggcatgagccaccgcgcctggccaggaatctttattgtcaagaaaatggcgcaaatgtgccaccaaaagaagccatgtttctcaaagacttctgttcctacaagactgagtttatgacactaaggcgtgctattaagacctaaaagaacctcacgcatccatacattgaagtgacttggcttctgagacccaaggcctttgatcttctcaccagtgtccctccatatgggccgactgccactggaaaggagagtagaaacggaaacagacccgtctggacagaatccaaagtgcaaacaggaactgtgcccagagagaggaggaggtggcagaagcatgaaggctgcttagatccctatgttctaagaaagaccgctctttcctggctttaacttccttggctcagaagtttaggatttgctcaaaatcagaaaaagcaactttgggggaaaaaaaaaatctggatgtggaagaaactggcggtgaaagtcatattgagtgattaatgataaaaattatttccgctccttggttcttgagtcggtatgaaacgctggcagcctctaattaatcatcaccatgatattaacaccactgacttttcattgcttctgctactttctttctagacatctgtatcctctaagtaaatattatccgccaaaactttgttataagttgtgcaactgggttcgcccaaggcaccggagcctgcgcgcaatcgcacaggtacgcggccgcccgcggtcctcaggaagaaacgcttcgccgccgccggcaagcggggccgaagctccggcgggctcctcccgggcctgggcgcccgacctctccgcggcccgcgcccctcgggcgggcatcaaggcccggaacccgtctcagcgctcgccggggccctccccgcggagcccccgcccggcgcccccgggttcgagcccgcccccggcacccgcgcgtggagagagaggaaaagagtcagtaccggcgggcgggtgtccagctttagtctctagtttcccttcgggaggcgaagacatgacgcggcggggcttccgcggggccgaggcggcggcgcggttctcgggccgggcgggcgtgcgcgagtgagctcaggtgtgagcgccggggagcgagcgggcgggagaacgacgcgcgcgcgtggggcgccggggccgcgcgagccgggtgagtgccactgccgttaagggggcgcggccgccgcgcgccgacgtggcgcagccgagcccaccgacggcatgcgcactgacgtcaccgcggcccgcccgccctgctgggccgcgagccaagcatacggtgcgtgcgcagccggccgcgccacgtcggatgctgtggccgggggcgggggcgggggcgggggcgggggcggaggagggaggggagagaaggggtgaagaagtgagagggagaaggaaggagagggaggcggggtccccgactggctgcggggactggagttgcggaaagttaagtagggcccagctgaggatggctcctgcagcgaacgcgctcagccgggctcctggctacgcggcgacggctgggtgactgcgccccacagtgcgggccagggccggggcgtcccggcagggaggcgaccgtcccctgaggccctcagcccctgccgcggcagcgcctaatgaagcgcggaaaggagagcccagatggcagcgacgggggccgagagagcaggaatttgttaaaagacgatgcgaggggagagcctgctttccgagtgagggccagcgctggggagcagagacggtggcttctgtccctgccctcctcgttatgaaccaaaaataaaattctaagccctgcagccaacggatggaccctcccctccgcctgtggccttctaagttatcttgaaaaactagttcaggccttgatgggaagcggaagtcaaacatggcctcacaaacatccgcacggagaccctaagactaatagaggactctgataagaaacatttgcagtgtattcccggcttcatctgcatgataacaccttggtctccacaactccttcatgcaacccggacattcccttctactgagtccaggtctttagatgataactctcaaccagttgccaatcagaaaacctttaaatgtacctatgacccggacgcctccacttcacattttacctcctaaagagccaacctacatcttacgtattgattgatgtctcatgtctccctcaaatgtataaaaccaagatgtttcctggccaccctgggcacatgtcatcagaacctcctgaggttgtgtcaatgcacgtccttaaccttggcaaaataaacttcctaaattgagaccactctcagaaacttttggttttcaccatcatcttcctgttgccgtggctgacccctggctctcgtgccttggatcgtgttcttcccgcctgccccagtgttttgcaactgctgttaacttccgcaatgccttgctggattcgcattcagacaggcctaatctctttagcgaaggaaacaccacccctcgcttggctgtacttttccctttgacaacaaaactgttcagggaggctgagctcctcatctcttgtcactccctccagtccagtttgtctggttttcatcaagttctgctgcactgccctcaaccatgggaggtccttttgtggaagtcacttataacctatgtgctgccagatccaatggtcattttctactttcattctatttgagctcttagcagcacttgatgcagctggccgtccccctcctcctttgctccggaggtgccacatcactgccttaccctccagttctctggccaccctggctgctcactctgtcagcttggcagttcgccctcttctagatttataaacatttgagtatcgcaaggctcagcattggccttcttctctatctagacttcccatagatagtcacatgcagcctgtggacgactatcatgcagatgcttacaggtgccaaatctgcaacctcatttctctatttctgctcctcccctgaactccagactcaccaccaccaccacctgcagacgcttatgggtgccacatctgcaacttaatttctctctttctgcccctccactgaactccaaactcaccaccgccaccttggcttctctatttgttgtctaactcagtgctgcgcaactctgtgcatcagggcacacatggagatgcacatagcatacattggtcttgcattccccactccatacacacatttcaacaccggtaataggataattgttggccaggctgcagtcatgatatgcttgccattgtcttgcattcacatccaaacttccaagtgggtgccagcagtttagaagagaatcctgaaattaatactgggttactctttaaagagatagcacatcactcacgttcttaaaggtttaaggatacctaactgattaatttcatgagtaacttcctttttatgtatgtgcaaaagtgctatatagttaaaaacttatgtcgtatgtcttaagcctaaagaattatttcttggaagtataaaatgaaaattttaagttgaaagagcacattgtggtatcatttaattggtagtgtttttacccttagtggtacctaaaacaaagttgcatgttacgagccacagcatcttagactcaataacaaatgctattggtaaggaaccctggggggtgggggagaaagccttcacaggaaggagcagagctccagaggggccctggtggcccctggactgccctgaggtctgacaggttgtgtctctttgcctgtgacctgttctccaggtttgtactgattgggaaactctggttgtcttacagtaggtagctagtcggcctgagcagggcaggagaggactcttcccccacaacccacaccaccagaaatgttgtgtgaccatcaggtgatggtcaggaagttgttacactgtttctctaaaataataattggttgcagtcagtgccagggaaaggcagtctcccagtagatagaaaaaacctgaaagtggtggtcagcagcttcctggtaagatctctttgccacacatcgagaggcaaaatggcaacgtttgactggtatatgaccttctaggaacatgaggctggtaagggaagattgcctcaagtgagcatgtgtacacttccaataaacacactgcccctgctcactttccaagcgctggcaagtcactgtgcatgtggacagcctaccccaagggaagaatcaggggataagactgatccctgaagaatcaagggatgcaagactccagaagtatgccaatgtataaaaccctaagtcaaaggtcaaaccgtgcacttgatctctaaagttacctgcttggccatcttccaagtgtactttccttttgttccagatctaaagctttttaataaactttcactcctcctttaaagttgcctcagtctctctttctgctttatacccctcagttgaattcttccttctgaagaggcaagaattgaggttgctgcagacctgtacagattcactgccactaacgtattatatttgggtgctacgtgattcaggtacattctgctcctgacagtgtgacagccaagttaattttacatcttcaaagaactcttgatttcccacctatcggcaaatagcttctcctctagaatacaatccaagctactcattacagtgtggaataatctgtctactcaatagcatttctaatgaaggaaatactgttaagaaggtagtgaacttcgcaaaaaaaagacatttatttttcagcttcccttgtagctaggggtagccaagtgacacagttttgaccatggaaatctgctggggtgttttggggaaaatttacattcttaatatggggacaccccttcctcctggtgacatcatttgtaccaccttgaattcagacagaaggccaaaggtagaacaatcatatcgcaactgtgaggcaatcaaaggcatgaaaatcacaagctaaaggtgacagagcaggaaggtcaaaggcatgtgggaatctgagggtccatggaggcgcttcagagctgtggactcctcgtccagacttttttgttgtgtgggaaacaaatttctattaaataaagtccttgtggttggtgtcttcatgggcagccaaatgcaacccctagcacacatggcctaccagaccctgcatgatgggggtcctgcccagttgtgagctcctccctcttggctcctctggccacactggcctttctgaggttcctctagcaggacaagccaattcttccccttgggactttgtgttagccactcccactgagacagccaagcataaaggggtccgcagagaaactctgactacctgcacaccggaagatggggtggagccacagaagttcacgccctttacaggggagaggagcctgacctcttcccgggtggaatctgggattcaatctgtgacgcgggaaaccggctagcaggactcttgctttgctgaaagtccctgtttcctttttttcctttttgcctaataaattccattttccccacccttcaaagtgtctgtgagcctaatctttcgtggttatgtgacaaggacgctctttttagctaggctaacaagaaagtcctacaacaccactgccgagaactgtctcttccagatcctcgcgtagttaacttcttcttattctggaatcagcttttcaaggggcctgctctgtcttactgtctttatagcactctatcctcatctgaaattcctcatttatctgtctgctggcttattgtttttctccactgactagaatgtcagctccatgaggggagaaacctaatccatcttgcccactaggtattcccagcacctaaaaccatggtgggcacagaagaagcattcaacagttattttctccccataattctagaacatagatacatttaatttctcacaactgctacctaaatgaagagtagccaatgatgactaaacagagaatgaaaaatgtatatagcatatagatggcacatggccagtgatcttttctgacatttgctttatcttgtaaatactttgtgtgtgcatatgtgtgtgcacacgtgtgtgcatgcatgcatgggagtgtccagcccctccagccctagatgctgaggataaatgtcaggcatcacccactggtgatatagatgtactatgtagatgttctatgtagatgtacatactcagtagataggatgagaattgttgaatgaataatcttatttgcatctcacaataacagtaggagtaagatgtaccaaggaaaacaaaaacaaacaaacaaaatggagaagagaaggattgttggacttatgtgggatgcaactctggtgagtgtgacctgggacccaggctggattttctaagccccagttccattcccccaagtgagggctgacttctaaacagagttttgggaaccattttcttttcttctctaaataggctgttttctctcttttttttttttttttttaagatggggtctctttagatggggtctcactctgtcacccctgctggagtgcagtggcacgatctcagttcactgcaacctctgcctcccaggctcaggtgtttgtcccaccgcagcctcccaagtagctgggactacaggcccatgccaccacgcccagctaattcttcgtatttctggtagcggcggggatttgccatgttacccaggctggtcttgaattcttgagctcagatgatccacccataaataggctgttttctaatcccaaatggtggtaaattcacttagtgtgaatgctgtaagccctggaaaaagtatttgaagaagaaacggaaaatgcagattctcttctccagatgtgtattttgtgtccgtggctacatcactaaacctttctgagtctcagtgtcctcatctgcaagtcagagatgtgaacactaatgcctctcccaggaaggttgtgagaattaagggctttgactaaacatgattatgcccgtacagctccgtgtcaccccacttaccccctacaggatcctgagacacagggggttctctgcccttttttgatggagaaattggatctgtagctggattttctaagcttggtgcaaggattggtagctagtgtggggagacccaagagaacccagctcttgctatcttatccattgtaaatttaaaagtgttttgtaagccataatatactagagaatgtactgttattactgcaaagggagtttctttttatcagcattcatgaaatatacgaatagtcccagtgtgtattaaaataatcccacataacaatcacttcgatgaatattgctttctttattccaggctggtttctgtttcctgtcttcttgtgctgttgtctgatagatgagaattttgtattcttatttactacttctatggcttgaatgtgtctcccaaaattcatgtgttggaaacttaatccccaatgcaatggtgttgagaagtgggatctttaataagtgactggctcatgagggctctgttctcatgaatggatttatgctgttatcacaggagtgggctcccgataagaggatgaattcagccctccttcctcttctttcacgtgttctcttgcccttccaccctccaccatgggatgacacaccaagaaggccttcaccagatgtgggcccttgaccttggacttcccagcctccagaactgtgagaaataaatatttgttttttataaattacacagtctcaggtattctgttatagtagcataaaatggaccaagacaatgacccaggatttctctgatttctcctccattgttaattttgctcataaggggagagcgtcagtcattcttgactttgctttgtaacatctaggatatttcttattatactatgtagtgtaggctttaaattaattttaatgtaatttttgacatacacacatacacataaaacacttgaagaggatatacatatctcaaaatcaaataaaaatgatagaatatattttacacacacatatacacacatgtgcgtgtgcacacacacacacacacacaagtgagggatctttgggatttcactgggcctcaacttatcactcagtgacagtttcaggcatttttcaaaagtaattcaacagctaataaagagcatggaggtccattttagtcacatatgaggttatactttagttaacagtatttgaagaaaaaaataaccaggctgaaccttggcaaaatattcctcttatctttatttaaaagttagaaaatagaaactgcaaaaaagttgagagtaacacaaccatgaatattgattttctagggaatttcgaatgctttgtaagttatttataaaaaatgtgttttagcagagaaatgggaagtggtaaggaaaattttatgtctagctcttgcattgagtcattatttgaccttgtgcaagctacttatgcattctgtaattacatttccatattggaggccataatacctatcttacttgaagattcaaatagttattcaatattatgtcttagcatttacagccctcgtgctgtactatgtgcctcctagaggtagttttggcaatctcagagttttgatagcattagtgacaccatttttcagaagggctgttttcacaggctttgaagtgaagaaggtctcaaagaagaggctgttggcctgggttattttttcctccaaaggagcatgttgtatcttctcttactggccatatggacgttttgactacattcaagaaagaattaatttttatgaataagttttttaaaaaatacaaaaaaatacactttggaaaacctaaataacagattaatgtccaaaggaaaaagcaagtcaccacttctcaacaatcctaccagcaggtaaagttgaccacttgtaacattctgttgtacgtccctccaggcttccagacaaaaatagacaaggattctttttagctatcttattttgtaaattgtcccttaatttgtgtttgatgtttttctcatagttaaaaacaggagttacaggtttttggaaggaagatcatagtgacctttttttatcacattatgttaatgtgattattaacataatgttattaatatgactaatcactgaagatgtcaacctgatcacctcatgatagaaagcgtttttaagtatggccattttattagatttaagttaatttattggtgagttcagctctataataggactcaatatgaacatgggctaaattctttgtatcacaaccttgaagttccccaagaattgctaagagtctatattaacaagcctatgcctggtcatgagtctggaagatacctctgggctcttgccatctcagctttatttgctctcactattctagggttagagatggcaagtaatttccttaaaaaaatttagagctttttttttcctgctgaaattacttggttttttttttagaccatctttcttctcaacaaatgatttcctataattgattaattattccattcagggtgaagtatctgtgtgtgactttgcaggctagagagggttgtaaataatgacttctgtcggatcctagtcctcagtgtgtttgcagaaaagccagctctgttcttgctcaattttagaaaaggtccgagcttgggaagtacaattgctgttaatccagataagaacaaatcccaaagccatccttcaggtttggagggaccctctggggcaccattcacaagcttttcactgacacaagttaataaaatgcttttggccatggaaaaaataaaagaaaatatacaatttcagtagctcactggagacttacaacatgactattcacggccttaacaaagaaccacagggcatttgggtaaagaaaagctacacttagcattccaggcaaggttgtggcaaaggtataacttgacatgacatcacttagcacaaatattggggaataacatgctgggtctggcttagtttgggtttggcttatttactgttcctctgtcccttaagaatgttgttattctccttttcttttcccttctcttttcatttcagaaggagaaaccaactccaagttcttattggaatatttacagggtactggaggggctcacagtattaaggagaagactccggcagcctctgaaagaaagaaaactagggaagctctggaaacaccaataaacgacctctgtctaggacgctgctggtggatgactcaatgtgatggttcatttcatgtgtcagcttggatgggctatagggtgcaggtattgggtcaaacattattctagatgtatctgtgaagctctattttagatgagatagacactgaaatgggtgaactttgagtaaagaagagcactcgctataatgtgggtgagcctcttccaatcaggtgaagaccttagcagaaaaaaaactgactgtaggcgtcccaatctcatgagccaactccttaaaataaatctctctctgtgtgtgtctctctgtctctctctctctgtctctctctctctctctcacacacacacacacacacacacacacacacacacacaccctgttggttctgtttctctggagcaccctgactgacatgctcagttatgactttcctctctcctggatctccattccagacctgatgcagtgagcatgcaacattcttggacctgaacctactttgattcaggtgctatgctgtacatgaccttcctgggtgtaagctgaagtggagagaacatttacaacttagtgagctaatcaagcagccctgtcaactgacaaccaggatggatgtcctcataccatatcacatttggctatattctgttatctatcataagttactgatcctcctgccacgtttttctgaaatttgatttcaagagatgagggcactcctattatccagtgttttaccccagagcctatctttacccattaggaatgtaaccccttaacctcataccttgtgtaactccaagttgtaaaacacatttaacataattgcatctgctcctaaacctctcccttgtagggaatagtgttcataaattgtgcctattgttaaagacttaagctgcaaaatgacctcgtactaatttagttcatcatcgcagattatatc

SEQ ID NO: 184 - DNA, 232992 bp, Homo sapiens
tctcgggggttgacacacttccagatcagtcctgccctagtggaggggagtatctgtacatcacagcagcctatccactccctgagtctagcttcctattcttcacgtgatggcacaataactaaaactgttttttagctgaataaataaatctgcagacatggtgttctattgttttacctgttcaaaataatattgtgcccaaccactctgtaactactaatgctttaaacagctttttatttcagaattaagaacttgcatttttcaggtgaatttcttcttctttctttcttttttttttttgagacggagttttactctcaggctggagtgcagtggcacgatctcggctcactgcaacctccgcctcccgggttcaagggattctccggcctcagcctcctgagtagctgggattacaggcacgcaccaccacgcccggctaatttttttgtgttttttcagtagagatggggtttcaccatattgggccaggttggtctcgaactcctgacctcaagtgatctgcctgccttggcctcccaaagtgctgggattacaggcgtgagccaccgctcccggactttcaggtgaatttctgactcctccaactgttttgcatttttctgtctggcatcattagtgcttataacactttccgatttagtgtcttttgagaatttagttcatgggctgtttgctttcctgtttccagaagaatcagaaatgtttcaaatacagctaagaccgtctttggttccacccaacactttctcctcatgagtgatggtaatgtcctgatgaatttctgcttggaaacaactggactcagtcagttgagaaatgacagagctcatatgcacaacaccttgaagccttccttcagcaatgcggacgatacacacaaccttcaacacttcagagagaatcctccgtgatgatgtatgctcaagtattttggtgtgagatgtcatgatacctataacttacttattaaaaattcaggccaggcacagtggctcatgcctgtaatcccagcactttgggaggctgaggcgggcagatcacgaggtcaggagatcgagatcatcctggcttacacggtgaaaccccgtctctactaaaaatacaaaaaattagctgggcgtggtggtgggtgcctgtagtcccagctactcgggaggctgaggcaggagaatggcgtaaacctgggaggcggagcttgcagtgattcccagatcgctctactgcactccagcctgggcgacagagcaacactccatctcaaaaaaaaaaaaaaaaaaagaaaaaaaattcagtcagaaaaagatgaaacagggcaaaatgttaacaactgttaaatcgaagtgatgggtacacggttgctcactatactcatggctgcacttttttgtatgtttgagcattttcatcctaaaaagaatttattcccagatgttctaatttcaggaggcatatttaacctgtgggggcttcaggaggctgacagggagcagacgggaggcaggaattgcttagttctcctaggtctattatcattaccttaatgtctggtagtagcagagtacaacaatagcaaaccccaaacagcgattccgtgacaccctctgttattaacaccttccatgcaagtatggttctctgagttaaaagatctagttctcaatccctttacctcaaggatgttggggagagaggaaatgttcaccaggaaaacttttttttcttgaagatcatgccattttctggtaaccaattggtaccagttttcttaaaaaaataaaaaagacaaaagaagttcattaattactttgaaagtactgttgtttagtccctcaacagaaaatgcaaactttctggaatcttcttccggattgccaggtatattgtggggttttaaaattcatttcattttctatattctagggtacaaatacattattattattattattattattattattattattttgagacagagtcttgccgtgttgcccaggctggagtgcagtggcacaatcttggctcactgcaagctctgcctcctggattcacgccattctctggcctcagcctcccaagtagctgggactacaggcgcccaccaccacacccggctaattttttgtatttttagtggaaatggggtttcaccatgttagccaggatggtctcgatctcctgacctcatgatccgcccatctcggcctcccaaagtgctgggattacaggcatgagccaccgcgcccggcctattatttttattattcctcaccttgtaattcctcttaagatttcatttttaaaagaattttgctttttgagtcttaaaatgctcaatttttttgcattactctaggcagtaatttttatcccaaattatgattcacccgaaatgtttttaaaaggccactccaaatctccactccacctttagagatgttactaaattctgatatttgactacctgaccttatttcttttgcccctgatctttactatggtctctgcatatcttttagtatgatctttaatactatgtgaatactgtgatctggctgagttcttcactaggtatccaccgttgtccatcctgctcaagtagtgccttaggatatatcccagctggtgcctgggaacaaggacctgggaaggtaggaggaggttgacatggacctcctgctgctcagggctgctgccccacctcagtgtgcccccacttctagacatgtgaatgctatttccactccagctctgttgaaaagggaggagagggacttgggtttccagtttgagaagggagtaagtcccacataggggattagtttcggggtagtaaatccctgtccattcctgaggctcagaggaattgttaatggccctgcaggcagaaacttggactttgaaggcagatactgacagatctgaatcctggatctgtcactgtgagatttgctctgtttctcagttttcctcacttgtcaaagagagaaccatacaggtttttgtgaagttcaaaagtggtcataaaaatagtaagctttggactagataataaatgatagcttttatttaataacaacgtcattaatacctggggatttctattttatcatttactcgactttaggcttaaaaaatattttttgaggatttctcagttcttccttctatttttggactgtagtgttcatgcccacctcccttgcccaaatcaatctgccaaaaaatccagttctctatctcttttcatcttgtgaatctgtatcttattatgctgatctcttactgtgttgtaactctacttctgtgctgcccttttattctttgtcaattctgaccttatctctaagaagtgaattgcaaatatttctgtctttctgtccaagttgaatttcatattttctgaatcatgtagctgccctccatgtgacctagaaagccctttgatgatccatatttagctgtatccatcactcaacagatgtctgggtagttaaaggcccccatgagctccctctacatcctgtggtttcaagttcctgagttgttagttaaaaagctttcatccccctgccccccacccattccagagtagaagtacagatacccactttagctattcattcatttattcacttgacaaatgtttactcattacctactgcatgcttgatactgggttagatgttaccctctttgttccaaattgcattttcttaatctgacccatttagagtagtcctccaggttttctgatgatttctctggaatcagcattgagcatccaattaaaccgtctcttctacctgcagggtttcctgacccctgggagacttggaggcttaatcgtaaactctgatgtcttgctataatgtacctgctattccatgcacagatttcagacttacaaaggttcaccacagctctatctaggggagtttagttcgcagatgaggttgcaaggctctgcttgtcgtcctgcaccttggacatgaagaatgaagtggcagcaagggtagaacacctagcaagttaagtagctaatttccaaaaccccttggttttctgtgtccctggtttcccacagagatgcctatgaggaaagatgcttctctgctttttgagctctctggatcttcccattagatagcatctcttggcatctgaaaggcagcttgccattctgttctcctgtggaacacagatggcccagcccacgcctatcactaatgaggattgcatacagagcctccttgctggaggctcccttcagcaaccccagtgctccttccctttgctggccagtcactgttgaccatggcatttaaatctgagaaggctgtttgctgctctcccactcacagagctgaacaaaaaaacctattaggtgtaggtcctgggaaatgagttgcattcagctagaacatgaagacattgaggattaaggaagggatggctactgattcgattgccagggttttgggatccagctgtccgtggaggctgttgagtttaaatatgaacaagcactggaagttcttcagtaggaacatgattagatggctatacagaggttgaacagatgggatatcaatttgtcaatgccatattatttcaagtagcatactagtatggttggaaactattagaatagaatgttaaaggcactaaaatgtagtggaaaaagcatagattttctttctcttttcttttttttttttgagatgagagtttcattctgtcacccaggctggagtgtagtggcatgatcttggctcactgcaaacctctgcctcccaggttcaagtgattttcctgcctcagcctcccaagtagctgggattacaggcgtgcaccaccacacctggcaaattttgtatttttggtagagacggggtttcaccatgttggccaggctggtcttgaactcctgaactgaggtgatccacccacctcgacctcccaaagtgctgggattgaaggcgtgaaccaccgcgcctggctgagcatagattttcatatgagacagacccgtgtcaagtcctagttctatcacttgctgtctgttggacaaagtacttcacctttctatgtatgaatttctatatctgtaaaaagtacaatgccaatatcttaggctgttctgaagatcaaaagggaaagcacatgaaaagaccttgacactgtgcctggcactagtaagcaatgaatgggaatttcctttcttttttttttttttgagacagagtctcgctctgacacccaggttggagtgcagtggcatgatctcggctcactgcaatctctcactcccgagtccaggcgattctcctgcctcagcctcctgagtagctgagattacaggcatgcaccaccaagcccagctaatttttgtatttttagtagagacggggtttcaccatgttggtcaggctggtctcgaactcctgacctcgtgacctgcctgcctcggcctcccaaagtgctgggattacaagcgtgagccaccgtgcccagctgggagtttcctttcttatctccctttcctgttctctctttatagcagaaagttgaaacatgcactctaatatggtagaacatcaagttgagctaaaatcaatggctccatatgaaagtttgtacaattctgctctcctgttatatttaaaacttgttggaatttgagatgtaggatagtttctttttccttgctattgcaagtctgatacaggtctgatatttatgattagaagttccaaactgttaatatggatctcggtagaaaggcaaaatctgtttgactttaatactacaatccattttttaagttctcagggctaccaaggagcaatcacaaccaccatcagcgacccttgagggtgccagtgagtcaggtcaatcctgccatgtccaagactggtctaaatggtcagtactcccaatccagaaattgctcttggagtcatttttcattctttcagaaaataagggacacaccaagaaatgctgttcaaagggaattaatagatttactgatttaacgttaatgcctatgaaaacagtttaaatagcttttggggcaaggtagattagttactgtttgtttcccatccaaccaggtcaaagctttttcctataagagcaggtgcatgttcattcccatacatggcagccctttccatattagagcagctccaggagtagttattaaattgaatagaagttaacctgtctacaactgtgtttttcagacctgattctggtctctggagttacacagatgaagtctgatctctacctgctatcatgcctaccctttcattttttcttctctttaatcccctttccagtcccttcccaactcaggaaacaaagggcctagatcattgattcttgcttgaagatgtgtagaggggaacaataaaaataggcaaacaatctcataaagaaacaagaaaaagggtcttaagaatggagacttggccgggcgtggtggctcatgcctgtaatcccagcactttgggaagctgaggcaggtgggtcacctgaggtcaggaattcgagaccagcctggccaaggtggtgaaaccccgtctctactaaaaatacaaaaattagctgggcacagtggcgcatgcctgtaatccaagctactcaggagaggcaggagaatcgcttgaacctaggaggcagagcttgcagttaaccgagactgtgccattgcactccagcctggacaacaacagcaaaactctgtccccagcccctggccaaaaaaaaaaaaaaaaaaaaaaaaaaaaaaaagaatggagacttcttgtcttagaaaaagcactttttgagatattattgtggaggatggtcacttgtgtgtttccacctccactgagaacaacaaaataaatggtggtcttaaggcagtgttttctaatctatagatgttgacaaataaaggactctatggttctttactaggagttctcagagactctctatgtacttcccagaagagatttagcacttgaccacagaactcttttttcacggaacatttgatggatgctagtgttttgggagacacattttaggaaattatggtttcagatatgctgtggggactcagactggacatttgaaataatttcctgattgattactgttagagcccggagctggcggccaaggaagactgtgaagtttccttccttggaaggttggtagactcttcctccttcccccaactcccgctcttttaatattagcattagacatgcacctgcctgggagtgttgaggtgtaggcctgacatataggggatctgagcatctagatccttcccatccccatgattctatttttatggatcccaattgtggtagtgttgcacggaaggcacagactagctgggacaggaggtaactgagagttttggccaagagaagagggggctagagatgggaaaagttgatgcaattatttttggcaggagttggaaccaaagcagcagaagagagtaagttttaagactctctggcaaagtaacttcctaatctgtcactgagtatgtgtaaaaaagtgattagtgggtctctatatttatcatgattactcacaaatatgtaatttacataatatatacagcacattaagtactatgtcaccttatataatgtgcatatgtataatgtatatgcatgttatgtaacgccagtctggaggctcttccaggttctgccaagtatttcctaatttatttggcaattttaacgtatcttttccatctgtggaaagaactctcttgagaggagctggtctctgacctgaatataatcatcctactaggtctatctccactctcaactcactggggaaaacccacaaagactaagccataatgagacacaattcctagcccatcagtttagggacaacacaatgtactagagagttcctgctttacagtttttattgctgttggggtagaagcatggggggcaggtgagaacatgtttgtagcatggccagaatcagaataagataagaaataagggattaggttctcccctgactaaccatgtggctttgagaagtcactaaacctcattaagccttgttctcctcattgagatcgagataataataccttctctgctaacctcagaggttgctatgagggtcactatgatgagggactccaccacaagaaaccacagtcatagtgtttaaaggatgatttgcaaggcacgattaaacaacaacacaagatttactaaggttaccaaactggaagtgcaattccactgaagttgttatactccatgcctctaagaaggacttgggatatgtctctcaagcaacattgcaagtcctgtgcactagggtgcagcaggtaagggccattttctgcactgccccttcatgagacctgtgagtctctgagaatcaatttcacctgttgatagtgccatgtctcaatagcctcaatcttggggatcatggctgaaacacatgcacgaacttctgtaaatgtcttagaatcagtgaccccaaacctgaacctgcctcagtttcagaaacaagtggcttccaagatagtacctgtagtaattctggagcttgttggtcccatcaccaagaataccatcattaaagatattcttcaggtggcctggttttccccttacttagcattctgcactgttaggttgagcagaatggtccaagatcttgctcctaggtggtccttcacagttaagtgccatttgtacacacaatcttaatattcccttctttgtccaaagctcctgtccaatgcaagattagaggcagctcagtggaacgatatcaagtgggtccaagtttccactgataaatctcagagagggatggaggcccaatgaagctctgcatggccttgcccttgggaaaggatggtaatgctggcacttgctgaatgaagcccactgagctctgctgagacccctctgtcctggctggcagtatcttgcagaagacgcctcagtccttcttgtgactctccactgaggtcatccctgcagccaaggttgtttccaaactaagagactatgatgaccatgatgaggtgacatgtggagagttcagtctgatgatctgtttagtaccttcgatctcagaccaacttcttttccattcaggtcagagagaacctctgggaagcagcatgaggcgctcgttttcttgtgtggggatatcccatccacgcatgtgctgtacgtttgttcctccctggcaacctggatccaagtggactcacttttcagtgaccagaaatgaccctactctgagatgtgtgggttcttttctccattaaatatctttgtaacggcacctactctcaagctgcattagccaagacaccatggaaaagtctctgaacttttctgagactcaattttcttatctgacaaatgggagagtaaatccagcccagcaggtctttcatgcttgttttgaggatccagaataggagttctcggtctcttcgttcataatagggagctactttcattccccttaacccttgtgatcaccacagggagatgcgtcctgacaatgaaacggtggagtgggggagtgagaaccttctttttccttaccactttctgtctcatactacctatgttttttttttccaatgaggaaaagtccatcagtaaataaatatttatatatatatatatataaatatataggctaaatatatatatatacacgcacacacacacacacacgcgcgcacacacgttaagaccatcagaaggtccttcaggtcatactctgggagtggtgagtgcaaagaagcaggagggaaccgtctcctggtttccccagcaaagttccttccttcccatcttttctgccttcaggaatagtctgccaccagggcttggaactcaaacaggaaacacgctttggcttgaaaaagaaagaagctgggggtggttttttttttccttccctttttacacaatattatgacaccaatttgaaaaataaatcccagtttctccgctctccctcccaggtgttcacagaactaagaaaataaataccacatctaaggtgtgctatgcaggcagctctgggggctcttggagccgcctctaagcaaacatgtagacaccaggagaaggttcctggaaaataacaagtgcccaccgacggcgcagaaacccaagaatggaaatacagctttccacagcctttctgcctcttcagcaggttcacggagaagttgtcactcaaaggacgaccaagaaaccaacgtgcgcctgctgagccctgccaaggattatgctctgagagccggaggccgttttgtctctgtacagagggaactttgtgcaaattctctggaaccagagctccttcccttggccacatctgatctcaccataggcaggaaacctgcagcctgctcctcgcgagcgtccatgaggaaacttgcagggctggtagaaagaaagggggatttcccttcagtctcagaaaattctgctcaaggcctgtgggaatgtggaggttgctgcctaagccagccacaacctcatgggccctaagtccattcaaaatgttttgttggcactggctctgttaggggtgtacccactgttgaaacagaatgtatggcaaggtgacgttttcttcccgaagggtggctttgcttccactggttagagaagagtgtgtatgtgtgtgtgtgtgtgcatgtgtgagtgtgcacataaattgtgtgtgagtgtgcattatagtttcttgctttctctcttggtttagctggtgtttggcacactgtttagtcttttgaacggctcttccttctcaacgagaagaagctgctcttctggggaggccccatcatcatgggcgcttggttcttgtgagtaattttaatctaaaagcaaagaggcagaaatgaattagtggcatgcaaatctcagtagcctaagggagagtgagtcgcagagaaaggaaaggccagcttcaggatggaaggagccccatgcagaaggacaactgtccttgaacggcttcaaaattggcaacttgaccctgactgggcctggagtttggcacggctggaagtgaggggcggaagcactggggagagacaggtgtgagcttcccacgtggtgatcagctcacacctgtcttgtgttcttggtattcacagactctcagaatgtcacagccagaggagacctcagggactcaatcgacccctctgcaggagcccattagagtagcctaagttcacaaacagagcagcagcacaattagagcccagttcttcagattcccagcctccattgctcctggtcattcctgccaaggcagtgctgagatgtcaatcaagtgaccgaggctttggtctgacctctgaccaagcaccattatgtggagagttcccaattgagtgccttatgtatttcctcttttcttggccttcgagggaagaccccaaattctttttaaaacttttttttctttaaattttagggtttataagtgtttcctcctgtaaactttaagtcaatcagaagtgaaagacactgatgtattctcatttttgcctttattcccaaccttatcctcaggtcatggctttgaaatagttaattcctacctgagtgtggccttgccaccttaataatctacattatccatccacaatatttattaagtatgataatgctcagagtaggacgatgaagtgggaacaggaagcaattagaattcaaagacctgggtttgagtccagacacttccacttctttgctgtgaacatttagatgaatcattgactcttcagagccagtgcttactgaactgtaaatgaggaggataacatttgtcttattttcctcacaaagatcaaagaatagattgtcaatgaaagcccactgtaaactgtaaaatggaaagtaacagttagtaaaatccttgtcttatggagaaagagaaggagaaagatggatgtcaaaagaaacagaacctatgaactcattcttgtggtttttaccacattataggaaatgacagtgtgaccgcagggaacaacagaactcttgaacacagaaccatcaacgagtttaaatcaatgtcggctaaaccaagtggtgtccaaaacaaggtgggcatggaatgagaaaagtctgatgggaacaaggaggaaagaattttaaaatctgaaggaaggaaaggaaatgtgttgatgaaaagggagtgggtagagaagtcacagatgagcaggttgagttcagggcaaactatgagaaatgtggtcatggacacaggtggggcagctggtgtggggttttaaagggaggcagaaagactgggttcacatgaagaaatgaggaagcatgagagatggcattctgtgctggagaataacatgacacaaaagaaaagagtttgagggaaattatttaacagctgttgtcaaggtgagctggggtagtgagtgcctggctaagagggcactactgtaagccaggtttacattgaaagggctccaggaactgtaatcccagcacttcgggaggctgagatgggcggatcacttgagcccaggagtttgagaccagcctggccaacatggtgaaaccccgtttgtactaaaaatacagaaattagttggaggtggtggcaggcacctgtaatcccagctacgtgggaggctgaggtaggagaatcacttgaacccgggaggcggaggttgtggtgagccaagattgcaccactgcactccagcctgtgcgacagagagagactccatctcaaaaaaataaaataaaaataaagggctccaggaaatggaagggaaggatagaaccagaagacactgtggacaattagcataacctggtgctaaaagctgaaaatgatccttatgttggcttccaccagcccagagacctaaaaggggagagagtctctgttttttgatagtcaccagaggagaaaaccgagaatgcatcaacatcattttgtgctgtgtgtcttattgtgggcattatgtttatcccaggacgcacggaagcgaggcataggctggagactggagactcggacagcacttatctgtggcatgcaatgtagcattctttgttcccctgtggaacacgtttgtggcatgttcccctgtggtcagccttctctcactcctgatctcccatgcccatgaggggaaggacttcagcttattcaccacggcactctctgagccagtgcagtgcctgttcagggtacaacacactgtggaagtactgactgataagccctacgtgctggcagtggagatggctctgttggaagcagaggatggtagctggtgcctacatttcccgctggtagagcccctcccccacatttttttatttttgagacagagtctcgctctatcacccaggctggagtgcagtgatgcaatctcggctcactgcaacctccacctcccaggttcaagcgattcttctgcctcagcctcctgagtagctgggactacaggtgcttatcaccatgcctggctaatttttttatttttagtagagacggggtttcaccatgttggccaggatggtctcgatctcctgacctcatgatccgcccgtgtcggcctcccaaagtgctgggattacaggcaccagctgccgcgcccggccttttttttttttttttttttatttagatgacacaagacccttgcttctcttttttatccctttagctgagctatttatttgctagttagtacctccagggcacggaagaggaagtaaaactcaaatctctcctgcttgtttttcagcggttctgacaaaggtcttgacagggtaggagtctggggctcctgggtaacataatattttggtcagctttgtggattctattactatagaaccgaaagaagtatgaaatcatatcctcatttccagtcaaagagatatcagtcccttaccctcaaattaggggctagcaggtaaaatagttatgatcctattttaggaggtagttggatgtggctaagcctgccttttcaaaccctgatagaaagaggtcatcccacgtttctgtagttagcacccaagcttctttggtaattgggcgagtcaggccattaactaaagtctccatgattttcttaaaaactattcacatcactgacagcacctggccaagtgctaagatcagcagcttagtgcatagttttctgtttgatcacagagagaattgatacactagactcttgcatgatagttcgaagttcacaaaactattacagcatgtaatttcccctttaaaatagaataaaaatgtgaacttcactagtgctggggattgactttgttgggggctgttttctgcaaaccaacacattcttattacttcaagagaagcaagagattgagggacttcttcctgaatgttgccttctcagggtgtgtaattcagataatgcctagtaaaatggccaataacctgaagtgtgaacccttcccaaaccatttgaaaggtgtctgaggggccaggcgcggtggctcacgcctgtaatcccagcactttgagaagcccagaggggcagatcgcatgagcgcaggagttcaagaccagcctggggaacatggtgaaacttcgtctctacaaaaaatacaaaaattagctagacgtggaggcgcgcccttagctacttggaaggctgaggtgagaggatcgcttgagcctgggaggtcgaggcggcagtgagccgtgttctcgccactgtactccagcctgggtgacaaagtgagaccttgtctcaacaacaacaaaacaacaaaaaagaaaagtgtctgaggtctgctgtaatttgaactggagatgcatagaaaggcacaaatctggaaggtctcaaatagtctctgcgatattttaaaagttaaagaaatatggtgagcctaagggaggaggaaggtttgcatggctttccggtcttagttgtttccgggctctccaagatcctagaatgtgctgcttcctgacagtgtttcctgccatcagaggccttcgaatgtaaatggacaaggccaggcgcagtggctcacacctgtaatcctggcactttgggaggccgaggtggggcagatcacctgaggtcaggagtttgagaccagcctcgccaacatggtgaaatcccgtctctactaaaaaatacaaaaattagccaggtgtggtagtgggcgcctggaattccagctacttgggaggccaaggcaggagaatcacttgaacctgggaggcacaggttgcagtgagccgagatcgtgccattgcactccagcctagacaacagagcgagactctgtctcaaaaaaaaaaaaaaaaaaagaaaagaaaaagaaaaaaaaaagaatgtaactggacaatcaggttttgcagagggtggggaagaagtgtgggatttattgatgagttgggaagttcaactacgtcattagttctcaaagtgtggctcataggccagcagcatcagcatcaccttggaacttgttagaaatgaaaactctctggcatccagacttactgaaccagaaaatctgggatgtggcccagcaatctgtgtttcagaacccctgtaggttatgtagatgcatactcaagtctgagaatcaccagactagataagtaggatcatctttgactttgagattctgctatcgtctaactctgggagaagattctgaattttgaggctcagattatgccacctaactgtgatggtgaagcacgagagatcatcttacagtgtaataataatgagacaagtttcccgaataaatatatatatatgtttgtatatacatatataaacaaatatgggcttctgtttttgttttattttggttttgttttgtttttgtttttgtttggttttgagatggagtctcgcactgtcgcctgggctggagtgcaacggcgtgatctcggctcactgcaacctccgcctcccgggttcaagtgattctcccgcctcagtctcctgaatagctgggattacaggcacccaccaccatgctcggctaattttttatattttcagtacagacgaggtttcactatgttggccaggctggtcttgaactcctgacctcgtgatctgcctgcctcagcctcccaaagtgctgggattacaggcatgagccactgtgcccagctgaaacctttccctaaatgttgggcattttaaggaaatttttaggaaatttccaactttttgcaatgataagtaatgtagacgtgacattcttatatatcaatctctctgtatttctggtaatctgtattttacttagaataaattcctagaagtatatgaacaatttttaaaagtgaaagtaaatgaactagatcaacgtatattaatatttataacagttcttgacacatgggtctacatgcttttcagaatggctgtaactgttgatactcttgcctcactgtatgagtgtcctggtctccccatacccttgacagcaatgaatataaagacaaaacagctgtgctaattggtcagtgaaacatggcatgcctttctcactgttttaatttgaaaatcttttcttccttttttaaaaacttgtgatattaaatattatttcatagatttattagcccatgacacttcttctatgaattctctgttcactattgcattgttagtattttttttttccgctggattctaatagctggtttctttataccttgtgagaattaacctgatctttgggatagcgattgcaaacatcttgtccttagtctttcgaagattctatattgatttttgacttgtagaaattaaaattggttaacagtcaaatatgtccctttttccttagaaaatccctgcccccagtgtaattatgatcatctattttttttctggtagctaagaacatttaatactgtaattgaactggggggcttttttttgctttggttttgtttttggaatatagtttgaggtgagaggttctatataaagacattttctgaaacgcaatttcttggatatcatatgctaaacagttcatgcctacctaattagtttataatctttctctttccttcattagtttttatgtatactagggtttctcaaggcttgcttctgtactattgatttatctatccattatcatgccaatagcatgttattcaaattattgtggctttataattattttaatatcttgcgagaagttatttctcagcgttcttttataaaacatcctagaaattgcattgtttgtagagttaaagaaacaattgcattgggattttgggatccctgttcaggaacatgggatgttctgtgttcaaatcctttttttttttctttattggttaaatcttatagtcatcttcatgcattttacacagttcagtttagtattttatgtcttttattgcttatataatgatattttaagctttaattatatcctttgaattgattattgctggtatactattaatattaatgccggaaaacttaatatttgtccattttttctatagggttttattgaagtaatttatcctttgaggttttcagtttattctattagctttttatgttcataatcataccacctacaaataatgacagttttgactcttttccaaataattatatttctttttctaattatattttctaattacatttcttttctgcttcaagtatatattgcattggctaaaatttccaatgttaaaaatacatgtcttgttcatgattttagtgagaattcctctagtgttttactattaagtaaaatattggttatggtttaacatatatttaacaaaggtattcattagtaggggagaagctttctgatcttagttttcaggagtttttatctttaaaaatcagaaatgttgaatgtaattgaatacttttgggtcatctattttatcatgtagtttttctatttaaactaatagtagaagactttcctttgttcctttaatatgctcataggggtgaatgattcttttaatacattgttcaattctacctaccaatacttttaactagaattcttatgtcatatttatatatagtctatagtctatagtcttctatttttaaatgtaatttttgttaggttattgcatgtcttcatttcataaaatggattgagtagccttccatctttgtctgtactatgaaacagttcacctaaatacgtatttcctagtagtatggaagatctcaccaataaggccatctgttttaagatcatttagtatgtaattctttgaaataatttagtttcattaatggttaccaggattttcattcatcttcttaagatgttcaagttcattagaatcaagatgattgtatattttgttttacaattttttttcttttgagacagagtctcactccatcgcccaggctggagtgcagtagtgtgatcttggctcactgcaacctctgcctctgagttcaagcgattctcatgcctcagcctcccgaggagctggaattacaggcatgggccaccatgcctggctaatttttgtatttttggtacagatggggtttagccatgctggtcaggctggtctcaaactcctgacctcaagtaatcctcgtgcctcagcctcccaaagtgctgggattataagcatgagccaccacgcccggccttgttttatatttaaataaagccacggacacagttatatttatatttttatattacatttatattttttaccttttaatatgtttgattcctttctcttttaaaaattaggttttcaaacatttgacatattttaagaactagttctagagtttcctgtttttagttattttcttcttttatctttattattttcttccttctgcttctcctaagattgttttattattgctcttctaattttagtattattcattacattttacttcttttttatatgatggaagattatgaggcttttaatttacttccaaatatagtttaggctatattctataatttttaaactggagccttcttatttttgtaattttttgagtaatctaccatggtggctttgatctcctcataaatctcttgttgtttaggagaatttttaagtctccaagtgactaaattttgtttattcacttaatcttctattagtaatttctagctttattactttgtggtcaaagaaaatgacctttataatttctgcaactggattttatggagctttttgccttgtaaactagtttatgatctagtttaataaatatgaatgcctgaacaaatatgatatttaatttctttatgagttatagagttatttcatccaagcatttatttttttgctacttaacctcaaagatggaaacaaatattttcaagcttctcaatatctgtctgtcaattctatatcaaccttttctcagaatatgtattgatagttttttatatattttgattctgttattaaatatctaacattttatgaccactatatctcataattgaatgtactttttatcaaataaaaaatgtgtttacttattctgctttatgctttaggcacatggaaaggttagtttgcctaaaattagcataattaacattactatgtcttccttttaatttctttatacctgataaaggataaaataagatatatattatatatacgtatgtataacctttcattttagatgtatcttttgtaagaagcatatatttggattttcatttttaactcaatatgagagtattgatcttttaatagggaattttaactcatctatttttcttttatatatatattatatatatacagtcttaacatcattcaacttgcttcaaaaaatttttaaatgttggcttattttttgctttctatcctgtgctacattaatagggtttatatattttaaattcttccagatttgaaaggtgtgcaccctatttttagtttcgctagtgattgtctacctattaaaattatcttctgatttatacgttttgtcatcaaagtgaagagagacaatgagaaacttcacatatctttactattccttcagcagtgtctcctgcatgtttttggcctttgttaatataatctcaggtttgggatacaggttattaatatttacatgatatgtcttctctttcaaagaatgattttttgccatttgcatttattgcataaacatatttagcaggtttttggaaacttcattctaatttcactggtttccatttttaccaaaagttcttttgggctgtgatagtccattcttaaggctttaattttgaatcacttcttagttggtgtataccttcaagaagatgtttcaacaaggggtacatgggttttaacccttgcaagtttaagaatgattttctgttaccttctgttatggaataaattgtgtcccccccaaattcatatgttgaattcctaacccccagtgtgactatatttgtaggtagggcctttaaggaggtaataacggataaatgaggtcacaaggggcgggggggccataatcccttagaactggtgtccttataagaagagaaaagagtgtacaaacacagaggaaaagccatgtgaggatacaacaagaaggcagccgttggaagttaggaagagaggcctccccagaaaccagcccttccggcaccttggtcttgtgttgtcagcctccagaactgtgagaaaataaatttctgttgtttaagctgtcagtctgtggtattctattatggcactcaaagcagacgaatatacctttacatacggatttctgggcctcacactatgaaatcattggttcacaaattttttcatagtgagttgtaatctctaaagggtggtatggaggaagggtgggtgtgggcatagggagaagcatttggctatttcaaaatccagtgcttgaatttataggaatagcaatccagttttcagctaggactgaaccaggtaggagagggtttgatttcttccacctttttttttgtaggggggttggagataaaaggaacttggatagattcttctcaactcagttccatcaaatgataaatagtagaaattccctctatgcgtcctaactccagcaaggtggaaagctattatttgatatagtgtgttttcatttttttcttggtcttcataagattgaggtaagatttttgcagagaaatttctgtttttgataacctttatagaagatgctaccttttctcagcaggttcatggaaaccttcctttagtagaagacaatttgatgttctggagggctcaaaatagcaggtgatcaaagtatctgaatactccactagagtgaggaagcttagaaactccacttttgtcttttgaaatttgcatagctgcaatcttattgagggtattacgcatgtagtatcccagcagaggccctgaaaaccaggacgacgattgctcttcaccacgagattctagctgcatttctaactgaggacaaactaagaaggaaggatgcatggctcctgtcctagtgctaaagggagagctaacggatatggtaagtctgggaatggagatagtctatttttgttagttcatttgttcagtcttttattcatcatttgacatgtattattgtgcaactattacaaaccaggcactgttctacgttctgggtgacagtgccataaacaaaatagataacctgcgtggtgactcattcagtggaattttcaagtaggttatcagggctttgggtgcaccgactgggaggcatgtctgtgctctgcgaggaattttctcccgggagctccagcagtcaaaggcgctaccctaccaaattctaggtaaggtaagtgtgtagatttggcttccacgtaaggaagcaatttgacttgttcatcagcagaacagtcttccttttgaggtagtaaattccttgccattgacatgattcaagctgaggctgtccaggatacagtagatgaagtctcagaattcactgactagaactgtgaactcctcgaagttggttctatgtctcattcaattttgtgaccggcgcttcacagtgtctggcatatagcaggttttcattaagagttgccaggtaaatgagtggatggataataaagtggaagaggggttgcactagataatcttccacagtccctgtgactctgagattcagtgatttcatattaagtcagtgcccaaaagggctcaaaaataaggcttctcatccccatctcaaagattggcaagactcaccgtgcaacatggctgcatccagggttctccatccacttgcattggcagcagcttgtttgtcctggaacccagaacaccaagagaacacagtgagctttttcaagtgggagaatcaaggttattcccaccaggaaaacagaagtaggaaaaccttatctgcctacctaagtgtggttctctaagactcttttggagaacttgttaaaaatagatttctgagaccacctcagggagtctaacttggcaggtctgggggccaggcccagtggtctgtgtttctgtgtctgtgtgtgtgtgtgtgtgtgttttgagatggagttccgctcttgttgcccaggctggagtgcaatggcatgatcttggctcactgcaacctctgcctcccggattcaagcaattctccttcctcagcctcccgagtagatgggattacaggcatgtgccaccacacccagttaattttttgtatttttagtagagacggggtttctccatgttggtcaagctggtctcaaactcccgacctcaggtgatccgcctgccttggcctcccaaagtgctgggattacaggcatgagccactgcgctcggccgggtctgtgttttaataagcactacaggggattctactgcctcggtcctcagaccccactttgagaaatactgctgtggatgagcagtgaagtccacagaagtctgggatacagtggccagtgagcgtggcagcgccaccactgagcaggtgctcctcaaacagtcagctagaaggcccagagtacgtgccaaaaactccactctgaaaggggaattggcctggtctctatgttgagtgagaggttgcatcatgtcaatgaggtaatgtctccaatttatacaacatacagctcaggtctgagtgtgtcttgccttgcaatctattctaacctcagtcctggtttttgttttgttttgtttttgagacagagtcttgctctgcgcccaggctggagtgcagtggcaccatctcggctcactgcaagctctgcctcctaggttcacaccattctcctgcctcagcctcccgagtaactgggactataggtgcctgccaccatgtccagctaatttttttttgtatttttagtagagacagggtttcaccatgttggccaggatggtctcgatctcctgacctcgtgatctgcctgccttggcctcccaaagtgctgggattacaggcgtgagccaccgcgcctggcccaacctcaatcctttttaaaaatctcctgaataagcacactctggggttgcatggactgtgggcctggcttacctgggaaagggggtcatctaggaatactctccccagaggagaggtgaaagtgttgccttcttgcttgaggcaaggcttttctgaccttggcatatgaattttttaaaaagagacagggtgtcactctgtttcgcaggctggagtacagtcacatgattatagctcactgcagcctcgacctcctgggctcaagcgatcctcctacctcaacctcctgagtagctaggactacaggtgcacatcaccacacctggctaattttaaaatcttttgtagaagggggtcttgctatgttgcccctactggtcttgaactcctggcctcaagcaattttccctcctcaagcttcccaaagtgttgggattacagacgtgagccaccacagcccgccataggttttaaaaggagagagatgaagtcttctgacttccctctgcagaagagttatgaattcataatacattgcttttggaagaaaaggcaggctcttttggaggcctctggtctgggtgagcagggaacagttatcacccattgacatagaagccctcacctgggtatggcaactgttctgttcttgaaattataaaatgggagggaaaagctatcttctgatgtgatgattctctgattgaccctgagggtatttaataataaaaacaataaatctactaacaaaaacaagagtaaagagtggcattttggctcttgaggctggggatagtattcaggaaatggccaggaggatggggctcctggctcaccccctctgtttctatctggaaatagagctactgaatgtgaagaaaaagtcctcctccttatacatggctttcagattcctcaaggatcaggatgttctgttctctgtggtcttcataagttatggcttagatgtgttaacagactggacctcctcagtattagagtcctggagaatagacaggcctcaagaattaatctggaaaacagggaccccatcatgacaacagctcagaaagaaaggagagcaaagctttggggaatagaaaagacagaaaacaaagaggggaaatgaagaaaaggggtcagtggagcagaccttcagctaagagacctcagggaatccgctctggggacctttctgaggaatgcagtgtggtgccaagggcagagtttcttccaatgtgctctgatgacacttgcccaggaggttctgggagaaaagagttctgtggtcaaatacctttgggaaacccagtatcctgtggactcctctcggagatccccaaggcatgttaatagatttggtccatagtaattcagtgaaaaaggaaaggaataaagacttctgaaataatcaggtgggagaagaatctcagacaaaatgtgatgagctgcattgattaatcagaggcaactgaaatcagaggatcctctcgattagacttcatctcttccaggagcctacagtggctaacctgtgtggtccatcccctagagttgtcatcctgtctgtcaattatgccagttttgctgatgttgatggcttagcatacaaaggtgtataggaaatagtgtttctcaggtcactgtctgagaaggagtagagcagagaagagacatcttttttttatcagagtgtgccctctggcatccctctgccatctatctaacattttaatttgcaaatataaaaacaccaaggagttggacctttggttctctggaccatttaatcttatactcctgtttagagaacttcaccagctcagtttaacagaacagcaaactggttgtggtgtgtcctccagttgatgttttagatgggcgcattatatcctgtttgggaaatggtctacaaagacgttctttacaaacattatcaagcttttgtgctgcactctccctgccctaaaatccaaagatggcttctcagttgtctgcatgaatgtgtacgcaggcggggagatgcagaggctgttgggtgacaaagaggcatacctgatggtgacagaggcgcactgggccagcctcctgcctgcactcttcaggccggtgtagatctgccccatctccatggctccttctagccccaccacttcaaggagctggtcactgaggtctgcagagcgagacagcaaaagtagtgcatacacatctctgtgttcctcagacaagttctggccagaaagtctggtccccagatggccaatgtctgtatcccttcatctcccaccaaacacctttttcatattcactctgaatagggtgtttccccaaagatcaataaatgtaccttttcatgaggagatggtcagttttagtgaaaaaagattttgattcagacatcatatatatccaataaataggttaccatatcaagaagtctcttcaaatgtagagtgacataaatgatgaaccagctatttctgattattttcaacccctatgcagctaaagacatattggtttggaactaggataggaaggaatgttaatgagggccattacccaaagctggaccaagtctctcttctctgaatgtctgaataacatttggccccactgacaatgactgatggttaattaacctcaaatttggcctgtggtaagccactggtgagccagcctccttggacgtcctcaggaaaaccaatgacctctttcaggacaccaggtgcctaatccaagccaaggaaaagaacatttcaccaacatcagagtctgtgagcccacagtagaaaaggaggggcaggaagtaggaggctcaggctcagagtcactcaggaccagtggtctcccacagtgggatttgcttctcattcacaacctagatgaggtccttttcttcagcattgctgaggcttggatggtgcttccccagtttcttgtgaaagcagtagcaggattaatgtttgatgttgggctcaaaactcacttttccagcacaactttcatttatttaaaacagaagcaaaataaaacggcagattttaaaaaagctttccattcctttgcctaccaaggcaagagtagctttctcataagttgtggctaatcactaacatcctcttaatatccacaaactagaaaactgtgtctatgttaatgctattgcttatataacaggtggcttctgtcttctaaagtgcctcctggtatagtataacagtgttaagattggcaaggagatatttgagtttgtctttactcttgtttagaaggctaactattgtttaaaaaacaatctcttgacggatgtattcctagtgaagacagttaaacaaaccattgggctgaccacaaatgtgtcaacattgctagtctaaattactgacgatcactaatggacatcactaatggacatcagctgccaacagatacacggcttgcatcagtctttctgtgacaggcacatagctttccccctctacatctactgacaatcacattctgccctagtactcctttcttcatgtttgtgaaaagatactgtctccttaaacactccatctcatttggacttggaaaaagaagccaggaaagggtaatgtttgtttaggagaatgctccaggctctctgaaggagtttggacctaataaacaatgaatgtctaaacctctagtcacttaattagcctccttcttaccaaagagggttgaataacgttggatggtctagctcactgtgtcattccaatagtgtctgtgaaaacaacatgggctataaatgtgtgtgtgtgtgtgtgtgtgtgtaagataaagacagagagaaggaggagggagaggaaaagggtgaggaggaggagagaaaggtatagagtatgtctaggggtgagggggtttgagggttgatgttgggataggagagagggggagaaaagagaagcagaactttgcagaagtctcttgagtggcagagacagatgtcttggaaactgttgttctttgtaccaggctttggtgtctgatggtgctgtgatagtccaatgttttccctccttaaaacattccctggtaacaaaatgttctaagaagcaggggacttaatagactcaagtgtttcagctttacaatgtcttggtcttttaacaaattttcccgttgaatggctttaactccgaagttgttatcacttcccacacattaccttgcagctatcacttcccacacattaccttgcttcctggctctagaagagaagtaatgaaggctgatctcatcagcatggtgggtgggtgggggcaggggcttacacagatgtgggactgaggagatttgtagggaaaggggctaggatcttggcatactgtttgccatcctgcctttgagttttccctggtgtagagaggctgagatgactaccactgaggcaggacctggttgctcttttacttctctaccattgccgaactcatctttccttctacttcctagaatgcctacagaggtcttgaggtaaagaaatctatgtaacattgtttcccaaagttataagaccacaagacccttttcttgtgtgtgatgcctataaacaacccaccgcttccattttttaggaacgcattttgggaaattctggcatcacttaatcccctttacttcctctatcacagagatactcaggtacaacttaaatttggagttaaaatgaaaaagaacagaatgcaagtcagtgtctaggcacacagaggaattaatgtttagattgagacatctggtataccaggtgtctgttttaccttaagcatcaatgattcagggtgtgattttggcaattcatgtcatctccatattgtctttacactcttcaactgactagtatttaagatggaatgtgtatgcaccttagtaaaacaggaattcactcactcactcactcactcactcactcactcactcactcattcaacagttactgagtaacaactcagtgccagacactgtcttgtaagagttgggatgcaaaatgttctattcttgaagggctcttagccaagagggagaaaccaagttaggtgtagaaaatgctgcaattgaactgcaggatcaaggaagcctgagtgactgattctgctggggcaaagtacagaaggcaggtgtcccagacctctaaaagaggtcttcaaggatgaatgagcgccaaggtaatttttgggttgaaaagaggaaggaagaaggacattccaggcacagggatgatcatgtgtggggctggaaagtcacaggatgaagaaaaaaataattaagcaataaacctacttggcaatttcattggaaaatataaaaagtattttttcctaaggagaattactgtccagagactctttttggccagagctagaggaagagggtctctgggccagcatgagcttgtcacatccatagagctaggactttcaatactgctcttatttattccttggtagcaaagccttgtacagtgttttgtgtgtagtgaacatataatataagcactccaagaaaagaggatgataacaaatgggaaaatagaaaaaggagaatgtggaggcaagggaggaaaagcaaggacaacagtgggggttccaatctggcccatccagttcagcctccaggaaatgcaaatctgattatgtcatccccatatgaaaaatcctcagtggcactcatcataataccaagtgctggccaggcatggtggctcacgcctgtaatcccagcactttgggaggctgaggcaggcggatcatctgagatcaggagttcaagaccagcctggccaacacggtgaaaccccctctctaccaaaaatacaaaaaacattagccaggtgtggtggtgggtgcctgtaatcccagctatttgggaggctgagacaggacaattgcttgaacccgggaggcagaaattgcagtgagccaagattgtgccactgcactccagcctgggtgacagagtgagactctgtcttaaaacaaacaaacaaacaaaacaccaagtgctggggaacggaatatgcagtgtgcatactttcacactgaaaacgtaaactgataggaaggaaacaatttggccaattttactaagtataaaacttccttgctgcttgatccattaatttctttcttggtattgatcatgaaaatcactgatagaaactaagttcatacaaatatgtacattgtggcatcatttgcaacaggaaatctccctacccccatttcttcctgtatgggaatagttaaataagtgaaataagtgatatggtatctatatgatgaaatttttttgctgacattaaaatatttacaaagtttcaataacattaaatattgtttatgttaaaatgttaagtgtgaaggcaggatataaacttacttgtatagcattctctcaactaggtaagaatatgcataaaagaaaaggacaaatcccaacaaaatcttaacagtggtgagttctaggtaattaaattaaaggtaattgttattttcttctttacgctttttggtatttcttattttttataagtgtgcattaatgttataacaaaagtcatgtataaaaacatatcaactgctcttcacagttataaaaataatgctcacattccctggtttgatgcccaaggtccaattcccatctggcaaggggctgcctctgcagttttacttcctgtctttgtggggctagatgcctgccgcagacatacacaacatgtcattccccaggcaaaccctactgtttcctcctctgtgcttttacatgtactctacatatactttctcccactttcacttgtctatcaaaactcaggtcaagtgtcatcaacttccacaagttcaaaatgaacttcaaacttctgtgcctgcagtttgacttagatgctcctcctcaaaccctcccaggtagatatagtcaaagaaagaacaaggaagataagggcattgatgatattggctgtgggcaggagatggctgcagtaattactgtgccacagggtctgggttgaataggaaaggagatggactgaatgaaaagggagaaggtgagtaagagacttaaggagttctagaaaaagctgttctgagacagtgaaagagagggttggggagaggtgctgtgaaaagcactagccgatgcacaaattccacctgtagtcccagtggtgggcagctgaagtggatgttggagggtgggattagagtctaggagaaatgaggctaggccagtggttcctaaactttgctgagcgttagaatgacctggggagcttttaaaaacaacaatgccaggttgcaccctataccaattaaatcagaatgtgtgagcataggagctaggcatcggtctttgtttttaaagatttccagatgatgaaaaaatgagcacagtttgggaaccactgggctaagttattgggtggatcattcccattggtcagtggttctcaaagtctggtcctggaccggcagcctcagcatcacctgggaacttgttagaaatgcaaattcttaggccacaccccagacctacccaatcagacagtctggagtttgggcccagcagtctgtgttctgacaagccctctggaagattctgaggcgtacttaagtttgagaacttgggccttaggcaagaaaactgcccaaaatatatacagaagttggagtgaagaagaatgtcaacaagttatttcatgactgctttgatctattgctatttcaatggaaaatttgaaataataatattgacctcaaagtggggttatgagatttaaatggcagacctgaatgtgaaagtggctggcacagagtgggcacccaaaatacattagtttcactttcctttttctccacattcacccggacaactcccaatggtcagtctatctaccttcttagagctgtgtacaagagtccctaggccgtaatattaaggctaaaaccattttcttaaatcttcaatattcctcatagttttacacttcctgtaaaagtcagaactccagatgagcttgacactgatgagtaaatgctagcagaacactctgggaaacatctgacatgtccagtctttctttgggaacatctggaagccaaaacaaacaaacaataaaaacaaaaaacaaaaacaatgttcaagttccttagctaggtgtgcaaacatccctctgcttggacaactcctgtttagcctcctgggatgccccaagcaccatgctagttccttcttctgtgcttagatagtggatctcacccaacaactgtctctgtacatatcactctctcaactccattgcgagttgaaggcaggactgtgttcttgttttgtttatctttgtatctctagcaactagaccagcctttggcatataaaaggttcttgatatatgtttgttgaataaactgaataatatagatgctttagagccaaagactttgacaggtttggccagaagaaggaaagagataataatcaataataataataataactatagttgtctgcagttatcaatgggggattggttttaggacccctgcaaataccaaaacagatgctcaagtccctgatataaaatagtgtggaatttgcatataaccagtgcacatgctcctgttactttaaatcatctctagcttacttataatacctaacacaatgcaaatgctctgtaaacagctgttatgctgtattgtttaaagaatagagacaagaaaaaatgtctacatgtgttcagtacaggcataaccatccatttagaaaaaaatctttgatctgctcttggttgaagctacaaatgcagaacccatgaatatagaaacctgactgtacttgcccagattgtactgggtaacaggctttccatgaattcactcatgtaatctgcatatgacagtcaatttctacccagcctggtttttgcctctctcctttattgcataatttttctgtccattctcatcccagttgctttttttttttcccccgatatttggagtcttgctttgtctcccaggctggagtgcaatcgcatgatcttggctcactgcaacctctgcctcccaggttcaagagattctcccacctcagcctcccaattttctgggattacaggcacccaccatcatgcccagttaatttttgtagagatggggtttcaccatgttggccaggctggtcttgaactcctgatctcaggtgatctgccagccttggcttcccaaagtgctgggattacaggtgtgagccaccgcgcccagtgcccgcttgcttttttgcattagtgaaaattcaatcaatcatttaagaggcaggggaatctctgggtgtcctgatttggactcgccttttgcaatgcctttgggaagtgtgggatatccttagcttaagaggatgctttgctaccctcaatcccacccccactccacttccccttccatcagcacaccagggttcaggtcttggggctgccatggagcagcccagggaatcaaacaaccctgaatggaggggcagggcccctgactatgtatggagccaacagaatttctaaaccacaccaccatggtggcaaggaagcctgccccataccttagagcatctgtgtcatgtgataaaacctgtgggccctgtctgtttacctgggttacagcagcactggcgtgctgagatgttaggtgctattgtttgggctggaatcctgtcagttcagtgggtaatgctagttagccaatgctcatgttgagctcttaccgggaggggtatgcatctgattcattagaaatgcaaacaggaatttgtcactacttaataaatagccactgatagaaaaactgtagtcacagaggtaaagaaaaaagctgggaaactctacactaagttcttgaggatgggactaatatcttaattgctgtgtcatttagggtaggtcatttgttctctctgagcctgttttcacatcttgaaaataggggctgtattagtcagaccaggcttccacaaacaagcagccacaggctgggggccttaaacaacagaaatgtattttctcacggttctggaggctggaagtccaaggtcaaagtgccagcagggtgggtttcctctgagacccctccctttggctggcagctggctgccctctggctgcctcttcacagggccattcctccatgcatatggaccttggtgtttctctgtgtttccaaatctcttcttataaggacaccagttggactggattagggcccacccaaataacctcattttaacttgatcacctcattaaggctctgtctccaaatacagtcacagtctgaggtgctgggggttagggcttctttgacgcacgaatttttgggggacacaattcggcccatacagggataatcataaaccctacttcactgtgttattttgagaacaaaagagataaagaatatgaaagtgatctgtaaaaagccatgtcccttatcattgtgctactgagaagctgacaagcgctgggtgtgtgtgggaacctcttaacctcctcagaaagaaaagacacaagcccagctctgcttacagtggggccagattcagtccccacagtctagacaggtgagtgggagctgtcaggcctctttgcagacttagcccactaaggcgccggcaggcatgtcctcgggctcctctcctgcctccaaatttccatggagatgggcatgtgtccttggtggcttgggcactcaaagcccaacaaggctgggcactgctcagctcctctgagcctcccagttggactggtctgcacagatgaaacactgctcctggcgaaagagcttcaaagtgcagctcaaaggcaatgtagcctgaaaaaagcctaggggtggggaaacggaaagaatccctaaagactgtttcctgatcttccacagggcaaggggactggggttccccaggaacaaacgagtaaagaaggaaagctctaactggtccatcttcatcccccatgttcctgcctggcctctcaaagcaccaggccttcaggcatcccaaccataactaagctgaagaatactctgtgattaatgctttccccagagaaactgaccctgtcatgaggagagaggcagagggcttattccttggtcttccatgaacccagcacagagaatgtacccctgtgacaggttgtgaaacagcacgagcttcggacagagttgggtctgatcctgtcacttgggagaagactcttaacttttccgagtctgccttttatctggaaaatgtattaatagatacaataagtcactggcagggttgtctcgaagtttagaagggatgccctcaagtaccttgtatgaataggatgggatcagagcagcacacagagggccctcaagaaacacttgctcttactgcgattttatgtttctttaaaaagggatgtactcaagaagttccgactttgctacacagtaagtgcatggccttctgtagatggtaattaatgtaacttagagaaggttatggaggaagaggaaggcaatgaaagggagggaggggaaggataagtgaaaaaaaggagaaggttgggggaggattctgaaaaagagaaaggcagagagacggtaaagagcagagagattatgaccttgagaatttagggtgacttgcccctctggcaagtgaagcatctttattccttttttttctttttactccaaaacagggaggagctcacccttttatctgaaaatgaactcccctcctttccctgcggctgtgtgtgtgtgtgtgtgtgtgtgtgtgtgtgtgtgtgtgtgtgtgttgcaatcccacaaccatccaggttgccttctcttgttcctgggctgagcaaggtgggagcagagcaggttctagacatctttaaggcatgggttggatactcttaggccagttgggtaccccgctcctttgtgccatgcccttgccacactggcttgtgggtttctgctactctcagggctctgtaaagccccatcaaagcatgtaagtggccagagggcattgagtggcctttgagtctggataatcccattgggaagagttaggaaggagaagcagggagaaccactgcttttggaggaggagaggcctgcagagcctgagggagaagcgacatgtgggcccagcgggcaggactggaattgtggtgtctgttctggctctgtctaattgtgtgacctggaaaaatcatttccctcctcagggcctcagtttcctccagttgaggatggaggcatcctatccctaaggtctatttatgcttttccagccaagatggaggctggatttcctaatgggctgagtcaagggcagatgggtaggagacctcacctgttctcacactgtgcagaagacagaacattcagtacagccctacactgaggcaagagaaagtgtgaggccctgcacacaatggccattgttgttggttcctgaaaacctgctcgtgtggtgggtgggacgggaaaaatgtgtcctccattctgtgtggctttatcttctgggattctccagggctccgatgaaggcgctgtatgttgtgggaggtggactttgaaagctctgtgcatgagggtcaggtgcttcagagggggaggcagtgccccggcagagctgtgtggtggggaatgtcccagtggctctgaagcaagggtctgacaggagcctgcctctaagagaagccaagggtggggatgtcctttaaggcctgggagccagcagagctatggaatcttgatctggtggtcccggtgaggtccagtgctgggcacagactccgcagcctagagctttacaaaggacagaagcaagaatcgacacatgggatctaattaaactaaagagcttctgcacagcaaaagaaatgatcaagagagttaaccgacagcttacagaatgggagaaaaatgttggaaactatgcatccaacaaaggtttttctttcaatccttgtggcaactccattaaaaactactatcccaacttaacaacaacaacaaacccttcaggctcagaggctaagaaacttgcctaatatcagatagctggcataccctaaagctggaattcaaaccaaggcccgattcaaaaaataagctcatttgaaaggacgcaaggcagagacaaagtaccttgcagtgacagggtacccgaaggcagggaggtgagcttgggtgggggtgagcctcttctcatctcctctcagggaagccttggctacatgatcttattaaatggaatgctgaattctttggctcgaaggtaaaatactagttggtatattatctggcattactttacccactgagctcaggaatcttattctgggtacactgtatgtaataaaataaatcaattagtggtaagattttccaccttaactcaatcctgattctcaggcgtggcatatacaaggtacattccagagatctgcactggccaaacttatcacagctcaacaggctgcctacagcacctactattgagagatcatctcagaaagatcttataagggaactaatcacattcactaatatcatctcagattctccagaaagacaaagttggaggagagtcacgacagggagggccttattctggtggttgggtcagggttggccagaatgggggaggtgtgggagggtgttgggtgtgtgtggaaagaatcctatgtttggaatactaggatttgggctctagtcccagatccaccagctaacgcagtcttggataggtcaattaaccctccctgggccttgtttttctaatctataaaatattcctcgggggtgctgtagaggattaaaatgagacgatgaatgtaaaatatttctggcatctagtgctagatccaagtaagtgattaacacatgctggataaatagacctgaggatgaaaagagatgggcgctggcctcatgctggaggtgcaaaggggcaaaggtccctgctgatgcctctgctctgctaacagaagcccctggtgatggggagaggtttgggcgtggaggcaggcaggaagaggctgagcttgttgggagaaggagcaggggtcctgctgggtggtttttggggagggaggaatcacctgtgtggcagtgtcctctgtccatcccttgcttactgttggctttgtccattcttcccctttgggttgttgactctcaatttgaggccttggagccataagcccgcattctgcattagtctcctcactggccttgttactgccaggttcttccccttccttctcatccaaactgcacatgactctcagatcctattgctcccggctgaaaaagcttcatctcttcttattattcaaaggatcatgttcaaactccatgaacagtctccatcttccggtctttgctttgctacttctgggtttcagtgcccagcccatgttgcctttcttttactccctgtcttttcaaatctttttgagctcccaggactaacacacatgcatttcatcttgttcattcatttgttcgtcaaacatttgttgatcacctactagctgcattgcatggtgctgggcagctggggcacatgtgctgaagggaagacctccttgcctcccacactcttataaactcatctcttccactccatggtgcttgctcattatgccaatattaacacgattgttctaaagatatttcttacatgtagatagtagattgccaactacttgaggcctggaccatattgttttcttgtctcctcctctgcagacttggagcaccttagatacttgaagacaggtttgagtccaggctctatcgtgtgttatctgtgtgattttggcccagtcacttaatcctactgagcttcagtgtcctgagacataaagtggattaaataattatgcaatggttttgtcccataagtaggtattcaataaataatagcccaacacatatttgctgattaagaagattaaaccctgctatggactgaatgtttgtgttcccctccccccatattcatatgttgaagccctaatttccaatatgatggtatttggaggtaggcccttaggaacataatcatattatgagggtggagtccttgtgaatgtgattagttcctttataagaagagaccaagagagatgatctctccacatgaggatacagcaagaagcatccatccgcaaaccaggaagaagactctcaccaggaaccaagagtgcttgtggcttgatcttggacttcccagcctccagaactgtgagagatcgatttctgttgtttacgccacacagtccatggtattctgttacggaagcccaactcactaagaaaaacacttcttgcaccaaatagaaacagatcacagagaataccaacattcaggctgtgcagagcatgtggccaggacggagttttgctgtgggatggagcttaggtggtgcccaatatgaaatggtctatgaattctgcaggggaacagagactagtttgggggtcaagatgggcaagtgcaagagggaaaaactaaggtgtctagtcctgccaaagagcctagcctagaattttcttctgtatgtgaaaagtgaaaggttccttggctctgtggttctattttgagcagcaaacctcctgaggcaggaattaagttggagttcaactccagctcaaacctgtgtgagcaagtttttcctctgcagatgctgagcagcctcctgaggcacatttccacctcgccaggccctcccaggtcttgcagaagggagtgggagaggggaggagacacagctggagtcagagtcttcttcattcagacgtcagctgagaaagagtgaatgattgcttcacttgaatttccagtgaatttgagttgggtcaggaccagccagaaactgcgaagctggggtcgggttggggtggttactctggggtttgtagaaagaattgtacgtttggaatactaggacttgggtccagtaccagatgcaccaattagtgtgacctttgataggtcaattaacctcccttggcttcctttttctaatttataaaatttattcttgatattctttggaggagaaaccagacctaccagtgcagttcttctcaaaaacttcagcgtatgtgcgatcaccagcagatcttgttgaaatacagactctgcttcagtaggcctgcagtgggacttgagagtctgcacttctgacacacacccatgcaaggccaaggctcctggttcatggaccacacggcgttctagtgcagggattgactaaccatggtttgaggatcaaatccagcctgctgtttgcttttgtaaataaagttttatcagaacacagccgtgcccgttcatttaaatattgcctatggtggttttcatgctaagtggacagagctgagtcgttgcatcagagactgtataatgcacctagcctaattattttaatagttactacatggccctttgcagagaaggtttgccagcccctactgtaaaggactgaggattggtctgtgtgagccaaaagatctgcatttctatctgggtttggctaagggcaagccacttcaccttgctggtactcactttccttatccagggaacaaaataatatctacatttccttatccagggaacaaaatcatatctacattcctaggcagcctgtgattctgggatttcagtattatgtagaaaacatcacagtttctatagaaataggcatctgagaaccacgttgaatggcctgcatttggaagctgcaaaaacatacctgccctaacctggcagagtctagcaagtcagatcccgccagatgccatgagaggtctgcggaaacagaccacagctactttctgatgtagagtcagttgggaatagaaaagggcttgagaggagagaagagtgagaattggaggccgacctcctgagctccagtacaggtggatgctggcagaggggccctggcacagcgcacgccagcatcactcacacaaattcactcttgctgagagaccaattcaaaaacaatcccctaactcactgctccatgtgcccctgactgggtgcatttggtcaaccaatattgacaagcccttttgaggcctctgagactctgccaggcacagggatacagaagggattatgacatctggggcctcctgagggcctcacagtctgatgggagaaacaccatgtaaataaataattatatgagagttcctcaagccagtcgtgaagggaaacatgtgactctgggtctccagcttgggcaacaggtgagacatcaataaggcagggaacatgggtacggggaggaggcagtgtttttaggagggggaaggatgtgtaaagatggggaagataatgactagtttggggcatgttgatttcaacgtgggctgcttgaaggactaaatgacaaagctgtgatttcctgtgaaaagcaaaacagcgtctccgtaggcctgcaaatgttgaacgggaatgacatgtatgttgccatggttactccccagagctaagaagagtcccagtgcacacacccatagtacttctggggctccctaggggtcacctgtcttgctctgtctcagcccacaggagagacctgggccagagaggatctctgttaaatgcaaactttttaggaacatttttattttctctcaactcggaagagtggtggctgatcatttctcactatgactgtcaaatctccactgaatgggaaaattgggaatctacagacctggacagctcctgaacccctgaggccacattctggtatggcttcataaaggtgaaaagaaagccatgagaaacagtgaactcgtgctcacaattattttggcgtctcagctgatctctagttcctcacctgggagtatgaatctgagatggctgaatggcatcccattcccttgctttgggattcagggcatagtccatacaattagtgagaatccacatgggcacagtgcacagacagattgaaccatacgtgcttgcaaagtagcagagccaaggtattgcccttcccaggtaaagtgttcacatctaggagggcagatctgatgactacacgtatttgcctgaagagtgcttgtgcctgctctgctcagttggtttgagtgctaggctagtgaggccacgggcatgcctatgagctacacactggcttgctggccttgcctgggctctgggtagctaagcaattcttagtacttagcatagttcctaattatatgcctgtctgtggggttattttattgaggcctggctcccccacacccagtggctataaagactatgtttgtttttggttttgttcaccgttgtaccatggtgcctggcacgtggtgggggctttgtaagtatgtgttaaataaactgacaggaagcctgtccccactgctgggaaaatgactcagagtgaacactaccgagggtatctgtctccctgtctttgtttaccaagaattgcaaaaagtattatctagtgagatcctggggagattttgtgctacccatttataaccttctctagtggctgggtgtggtggctcacacctgtaatcccagcacttttggaggccgaggtgggcgaatcacctgaggtcaggagttcgaagctagtctggccagcatggcgaaacctagtctttactaaaaatacaaaaattagccaggcacagtggcaggcacctgtaatcccagctacctcggaggctgaggcaggagaatcacttgaaccttggaggcagaggttgcagtgagccgagactgcaccattgcactccagcctgggcaaaaagagagaaactacatctcaaaaaaataaaataaaacattttctaggacacaccatttgcagttcaaataggattgaccaagaaatcactgagaggaaagttgctttaatatcagacagccagaggggccaggtgtggataacacaggctcgagaccactgctggcttgagactgaaggctggataggagcaggcatgaggatcagtgaagagtctgaggaaatatgcaggaagcctctgcatttatattttaggctggggccagagagaaacaatggcatagctccccaggactttgctcctcaaccccagggggaccgacccagccttgtgccatgcccttggtgcttcctcaggatccaagactgggcaccctccccctccccttgcttcactggacagccagctcaggtggaactccacatgggcagcaatagccaaacatgtgtaggcacagagccaatacataaccctagaattacaggttgttagagccacaggcaatttaaagataatagatgaaatcctgaagccgtagtcaagagagtgaaattctaaatttggcccctttcttatattataaataccttcccccacacctaacaataattctgattactgctgaccaagggctcaccaggttccaggcactctgctcagtccctacatggatgatctcatttaaccctcaaaacaaggctgagggagggagaccatacttgtttccatcttgtaagtgttgaaatggaggctggagatgtccagggactcatctaatccatgactggtgctgagaagctctgggtcttctgaattctagttcaatggtgagtccctactctaccctctctcaattgcaagtcctctaagctatatttgaattacctatttgaaaatggccagcacatcttacttatcaaatgagtttataatagctccatgaaattaaattctcagcctcacaaatactcacatgtaactctaagatttttttttttctaaagatttttcactaagtacctgttcctgtcctactccagaatctactgcccactggcaaactggaggcaagattctttcccctctctcccctcttccaacaaacgtttctgtagaacacatgtgagccaggcagggtgggaggctttgaaggggacacaaagataaagaacatgtgatcctcattttccaggtaatggcagggaaaacatatgatgagaacacacatgcccgtgacacaggcagacttctgatcagtgtactgatgagatagaaggcaaaattaagtgctcagggaattcacaggctgggctcgcttccagcagccattaggtaggccttgcagagggagcagaatttcaacaaggagttgtggagcctttcctcggactgggtctaaatacttcctatttcctgagtgcgtggctgatgcaagacacacagtagactccctaacgcattttctaaacactagccacttgggctaggctaggagtcatgggcttgaatcttggttctgatgccaccactggacgtaaattatataaatcctaccctttctctgggccttgattttcctcaactatgaaatagggatatggaggaggctgggtataaccttgctcatgggtttcgggttaggattacactaagttaatacatgcaaaattatttgcaagccaaaatgaaatagaaatacaagagactgtttctcactattcttattgttgttacaaaaactaaaaaatagcaaattccatatgcttctcatgtagctaagaacctttcttgggggggggcggggtaactacttgaggccaggcactggggatacaaagattaataacaaccagcctccatccttggaatctgaaaggtctaggaaaggagatagtaggtacaattggtaatataagtttaatgtgctacgacaaaggctgggctagagtttggcaggagctctagtctttctttttttttctttctttctttctttttttttttcttgagatgaagtttcgctcttgttgcccaggctggagtgcagtggtgcaatctcagctcactgcaacctccgccttccaggttcaagcgattgtcctgcctcagcctcctgagtagctgggattactggcatgcgccaccacacccggctaattttgtatttttagtagagatggggtttctccatgttggtcaggctggtctcgaactcccaacttcaggtgatccacctgcctcggcttcccaaagtgctgggattacaggcgtgagccaccatgcccggctgagctctgctctttcttagtggtagtgcaggtggatagtaatgcttaggacaagaacttcaaatgtgaatcaactggcattctccaacacaaaatagaattataggcgtagggactttttttttttttaggtttgagcttattatactatgttccaggcactttcacatccatcatcttcctaataagccatgtattattatgccagttttacagatgaggaagctgagacttagggtggttgggtaatttcccaagatctataaaactagaagcataaaggcaaaatttaaacccagattatctaactgtaagcatggggcttttcccaataccccttattgctttcttatcagccaatgtttctatagaacccattccatgctaatcttgaatgaccttcttactcggattgtttttcccaggagaaagactaatctttgatggagtgcagtggtgtgatctcagctcactgcaacctccgccccttgggttcaagcaattctcctgcctcagcctcccttgtagctgggattacaggcatgtgctaccatgcctggctaatttttgtatttttagtagagatggggtttcatcattttggccaggctggtctcaaactcctgacctcaagtgattcgcctgcctcggcctcccaaagtgctgggattacaggtgtgagccactgcgcccggcctgatgagagatttgagagcaacccctcccatcatcatttcctcttccatttcctatgataagctcattccctcctactgtgtcctgatttctccctctcctccaactccaatgaaactgccaaggagttaagaatcgcaacacatgaagaggctgcagagagagctctctgcctcctcagccagtagcctataaatcccgggacaaaatacactgagagaaggtagaaatttgaatataattctgtccaagaaagagtccacatagaccaaaatctgactatgccttaattttgcggaactgtaaggaatcttaaaatataattgtcagacttgcttattttacagatacagaaaactgagacccaagaaggggaaaggacttgcctcaagtcacacactagcgacaggcagagtctggactggaactccagtcttctgactcccaggcgaatgctttttcactaaaatacgttgcctctttagcttttcccattaacaactcaacttacatgagatcatagccctttcaagaagaaagctcagtgctggcatctctgcaaagcccagaagtcagtgccccactctgatcagctgatgtcctcatctaaagaacaggaagtggtttcacttctagctctgaaagcacattgtaggggtgagaaagggggatttggggaagagagttcctgtacatgatagtcaaaagcaatcagcagacactttggtcttgcttgaagaaggggaagatgtaaggtcagacatgtaagaggaagatgaaggttgtccttgatcagcacatgatctcatcaagagcttcccccagccctagggtggtggagagtcgaagtggggagcagggagggtggtggtggggattcagctctgctcattcccttctctgctctgagggagctagataccagagcgggggttgagataggagcaccagggtaggaaaatttgcaggaacttgatacaaccttcaatgcttcccctaccctctgttagcacccacaacttcccctgccaagggaggaaggaggaacacattattcagctttatacactgaaaagtttactgtgtgaaataaaggggacttaaggggtcaacagaggccgggcatggttcttcacacctgtaatcccagcactttgggaggctgaggcgggtggatcacctgagggcaggagtttgagaccagcctggtcaacatggagaaaccccatctctattaaaaatagaaaaaagtagccgggcgtgatggtgcacgcctgtaatcccagctactcgggaggctgaggcatgagaatcacttgaacctgggaggaggaggttgcagtgagccaacatgtgccactgcactctagcctgggtgacagagtgagactctgcctcaaaaaaaaaaaaaaaaaaaaagaggtcaacaattcctgaatcctctcttaaaggacagaggtgtggagatgatgtttcctgatgacctggcctggaatataacaatctgattgtcaaatagacgggtgtgaaacaagagaataacttccccaacccccgccttgatgtcagcggagttttgttttcttctagtggtgggatcacatcccaccttagcactaacagcctggaacatcaaagcacacagacgcagagccatggaatgccaggcatgggagagactgagggcatttgcctgtagcaatggtgttcaaacctggcagcccatcagagtcatctggggagctcattaaaattgagattcccaggaaccagcacagagattgattaggtagatctaggctggggtccacaaatcttcattttcaacaagcagctggtttaagaaccaaggttctggttcaaccccatccatccacctatcaaaactttgatacaagatattgtttttacagtaaagaaaactggggtgccaaaaataggttagtagcaggtcttggactagaattttgtctcctgcctgctggtatggtgtttctgccagcgcttttacacctggctttctcctccagctcacctgtccattgaggacctgtgaggacccgtgagcccacaggggaatcagctgccaggagctttgattgaatctctccatttggatcactggtggaaaatggctacttttggggctggggtagaggtggttttaaggacattctcagaaagctgtgtttgtattctggtgagttaaaagtggaaggcccagctggtggcctctaaagcatactacccagttgttccagacagaaagaatagttggttcatgggagcagcctgctgtgttggaggaaccagagtggaggaggcagagtgagcgatggagagagtggcagaagaggaggtctgggaggtaatgagaggccaaaacatacggggccctctaggccacgtgatctttggctttttctccaagccactgcaggattttgagaagaggagtgtcataacctgactgctctgatgtggtggtgagaacaggctacctagggcagtgagatagaagcaaggaacccagtgaggaagctttgcagtaatccaggggacagaggatggtggctcagatcaagatggcaggaatgcaggtggtgagacgtggttgaatcctggatgttttttaaaagtagctaacagattttctgatggactggctgtgagccgtgagataaaaaggggagtcaaggatgatgccaagcgttttggctcttgtgatgggaaggctggagttaccaatggagagaaataaggctgtgagtggagaaggtttgggggagggacagcagagctctgcattggacataccaagtttgaggtgtctgctaaacacataagggaagtatgacacaggctgctggacataggagcctggagctcagggaaagctggagacaggctggaggcatcatgagtaagcacatggtatttaaataaagtcttatgactggatggggtgatcaagggcttaagtacagacagtgaagagaagagggtcaaggaccctgcctggggatcctccagcatcaagaggtcagagagaaatgagaccgagaaggagtgacaagtgagcggggaggaaaaccatgagcaaatcaagtcctagaagccaagtggaccaagcgtttccaggaagagggagtgatcagctgggtcacatgccactgacagctgtggcaagatgagggttaggaactgactattggatttagctattggagaaccctggtaaccttgacattggcagcatttgactctgaacctcatggagccccacagcttgacaactgactgtcattgaggacacccttattgtgaatttttgtcttctggattaagttgtaaactttgcaacatcggatgacgagtcagcatatccgcagagcatggagtccttgctgggctgtggggccttacgaggcctgctgacatccacctgagggcacctactactgggcattgacctaaaacaattatcctcattcctggcttaccttgaacgcagaatttcagttctttggggtcagtgacacccttcctgctttcccggatcacagcccggttcttcttgttttctccccagagattggtgcctccgtacatgctgggaatgttgagaatggcaatgccttccaggaagatgttgctcaggtccaccccaaccccatcacactggaggacggagagaaaaggccatctgttagtgtcctcagtgtgtcacaacccaaggtgctctgtgtgtgtgcgtgcgtgtgtgtgtgtgtactctcttaaaggatgtgacaggtcctcagccaccaccctgccactgtcagaagagaaatcatgggcaaagtcgctcagacttaatgctttgactgctgtggtgagatgacagatccagtcctggtcagctccggggaatacagtacaggctccagggtcatctttaggtctagaagtgctttagggctggttcttaagtcaattgtcaaactgttctccagtctaatctcattatcatcaatcttgccccttcctaaccattagaagatttagtggaactgaattcagaacctaacaaatgacagaaaattcagaacataacaaatgacagaaaattttcatatatatatatatttttttgagatggagtcttgctctgtcacccaggctggagtgcagtggcacaatctcggctcactgcaacctccactttccggtttcaagcgattctcctgcctcagcctcccgagtagctgggattacaggcacctgccaccatgcctggctagtttttgtatttttagtagagacggggtttcactacgttggccaggatggtctcgatctcctgacctgttgatccgcccgcctcagcctcccaaagtgctgggattacaggagtgagccaccacgcctggccagaaaattttcattttgccccctcctattttatctctctgtgagaagcacaagactttaagctttggaaggctttcagaatctgcctgtctcctgtatctgtatcataaatgcaattttggcatatgtgtttgctgaaggagcagagtttctttatccaatctccacaacttgcagtccccaccaggtacaaaaagccagaaggcttgaattttcatctcacatgtctataaagtcagcccactttggcatcgtgcttaccaacacagcaagaaatatcagctctgatccttgttcctcaggatagtaggtagtttatttcacttacagaagcaaacactggacccagagacttgagctaagttatccaagcttgcacagctaataaataacagagcagggattcaaagttgggggatttgagtacaaagtacatggtctttatgttgtttattgggagaaagaaaaaatcaaaggcatacaataaaaacccactatctctgaggttacgtacaaacccaaacttccagagacttatcaacagagcaggactagaagacttgttgccattcatagtgactcacctcctgatttctttgcagttcttacattatgttatcttgtttccccaactacaagatggcatacagtgagcaactctggtaactgcgaactcattttttcactgggaagttctgataatttgagaggtctctttatgttgatctggattctctctcactcttgtttccaccagttggtcctgttctcccttctgaacccatacagaatgaccctccttcctcctccataggccaccccctagatagatgatgatgatgatgaagatcaccattgtgcacatgtattcagcactgccatctaccacacacaattttatacacatctcatttattatcttcctaataatcctataagttagttactatgactatcctctttttacactggggaaactgaggcacagaggaggttaagtaacttgcccaaagttcacaacttacaagtggaagtacacagatttaagggcaggtagtcagagcccaagttttttatttctcctccctctcacactactaccaggttgtgccacctctggactgtcaactctcttcatcttctcccatgagacttggttttcagatcttttcccatcccggcttccctgttttgcacacactctagtttgttaccctgctatttggcaagacccccaacattgaaaactacatcaacgacgggatctaatgggggcaggtggctaccacaccagtacttcttgtggctgaaattttatgatactatcatgccccagaaatgagatgacgtgcaaagctcatgtaagagttcagcacgttatccattatcattatccttatccttattatccaattgataaagattgcactggccattttgttagtggctagatgacaacatcacttcagcttaaatgggtggtcatcttcattgcccagatcatctcatgatctatttttcatccagttcttcgccattctgaacctgtgtagattttaaaaaataacatagacataaaactttacatttatgttaattaatttcatctggctctcagcccgtgtttcctctagtctacccagcttacttccaatcttcattctgtgaccttttgtcatcgcgttcccatcatttggggattaagtcattaatatgtgcgcataaaaggaaaaaacagtgaccgagcactctccttggtcagtttaacaccaaacattatgcgttaacatcctttggggtatggctgctctatcggagctgcatcttctggactggactgtcacccagcctactttttgttattagacagatgatggaatttagagatgagaggcacataagggaagatgcctctcatctttcatgcctcatctttcataaatgagccccagtgaggttaagaaacttctctgtggtcatctgacttattagtggtggagctagatatgtatccaggtctccagacctcaatcctgcgttctttccatgaaaacataaaacattgtgccgagatcaaacagcatttcctaagtgaccaccctacaacctctattagaaaagcaataagataactcaactaagtcaccaatatctgtgtgcaaagcctaaatactttgttaataatctattctagaatcttgccagggatcagaataaagtgtatcagtctgtggtttccaaaatgtaccctattcttattttttgaacactggagccatatttgtctgcctcttattggctagaacctactctgttttctggatttgtcaaagtggcccctgaatgacacctacaggcttgtccagcaacttggattcaaatgtgtgtgtgtgtttcaaagccagttagttctccattgatttaccttgggttctagtatccacctttggcatcttttcttccatttttagtttaaggccactctctttggaaaagatgaaaactcttccagaatggcacagtcctgttgagctatgctttctatgttctttttcacttcaaacgttgtctagcattcagctgggccttcagttagcctgaagccaggctcacaggtctgaattgcttttgtgtattcctacctggttgcatgcccaggctctgcctttgcgtgtatgtgtacagtttcctgaaagcataggctcaaccaacactctctgttgctgtcacattgattgaaaaacaaaaactgactcctttttcttttcttttcagtgtgattcatgacttcttagaaacttattttggaatgtcttctaccctcctatccttcatacacatattcctaattagagatttaggctagagtcccattggatcacactttcttttttcttcctttatttattttttgagacagagtttcgctcttgtcgcccaggctggagtgcggtagtgtgatcttggctcactgcaacctctgcctcccgggttcaagtcattctcctgccttggactcctgaagtagctgggattacaggtgcctgtcaccacgcccagctaattttttttctatttttagttgagatggggttttaccatgttggccagccgggtcttgaactgacctcaggtgatccacctgccttgacctccggaagtgctgggatcacaggggtgagccaccgggcctggcccacattttcttttatccttatcaccctctagatgaagcagccacttccccatcttggctgtagttgcttctacatcatctcaatttattcactgttggtcaaaacatccctttcccttctgagcagtaataagaataatattagcaactcatgcttggtgagagctttctagggcactgtgctgggattcacccatagtatctcttgcgatcttcacatgaacatgatgagggaggcagcattgctacccccaactgacagggcctcttaggggttaagatgcttgctcaaggctccacagcttcctactctacaagatggcagagccaggatgcaaacctaggaaggcagatgccagatcctacgctggagatgagtcagtgaggcaaatcgggatttttgctgatgctaggcttatagcaaaattaaacttccagctgtttgaataattgagatctcccactactgctctatcttatagagtgcttagagcaatgcctggcacatcaatgttggatattaatattattatatcttgcctccgcaccaggtttgttttttaaaaaagtacatcaccagcacagtccttgacaaatagtattccacaaagtcacctttcttccgtactacagttttaactgtaccctgtcccctccatctctatccatagccagctaagtgtgtttgctattaacttggtaaacgtttacctcttcctggaagagcaggcaatcctcactctgctttctaggttgtccccttcccctattaccgcagtgggtcccatgtagatagggcaagtagaggagatgggagaagcctggggtctgctggacgctgatgtcctccctccctcttggaatgcacctacttggaaagtgagagccaatgtagtgtcttggaaagaacgtgcctgcctgggcttgaaggcagagagacatgggtttaaatcttggctctgtcacttgccagcggtgtgattccaggttgtttccttacccctctgaggtttaatttgtcatctgtaaaatggaggataggggaataacatctgccttaaggggtgggttgatgggtgtctggaatgcagtagcactgtgtaactgtctgcgttatcatcacaggttccccaacctctgtgccatgaggcatttatcttcctgaattcactccccctacctgaggctttgctggaggcatcttaacggcctcttggcccgacccaggctggtaagagccttggcaagcgcacgcctgcgtgcccattctccagagttcctggcctcgcgatcgtgcactgatttccttcagaaccccaggcccgctctggacgtggaaggcagccgtgccgtctgggaaagtggagccgagcccgggacgctgtcggcctaaatggaacgccggccccggggcccgctccccggcgggttcccgagctaaatcctccaactgttccatgacgtcatcgggccccctccccctgctccggcccgcgcggccccagcgtggcgctaaggagtgtggcggtccccgcgcgcaccgtgggccatccctaacccaggacctggctagcaggctgccctccgagccgaggctgcgctgggcggaaccagggatttatagcccggagtggggctgaaacagagctcctggcccgagcagagagcgtgcacacgcatgaaatcgtgctcctgggtgcgccggcggccaggtgcccgatgtcggtcttggaagcagcgccggagtccgtctgaacccaggcccgggaggccagaggctgccggccacgttcaactgtgtcccccttgggaagacaatccccccagttctggtttcttcctgagccacgggtggttggttggtttggtggaaggcaggtgcacaggtaacagagacaaggttaggaggcaaagcacatttatgtgcaaatgagacgcgctagggaacttgtaatcctctgcacccccgcccttgatgtctcgatccctacaatcacagaattctaggcagaggccgccgacttctccgccctcgccaagagggacccggagcaccgaagcttcccagccggtgccggcgtttccgcgccctccttctctcctgcgccgtgacctcaaaagggcggcgggcgggggcccctccactccagccctgtcgatcctatttctgaagggccttagggaaggagattccacaatttatttgatgacctgtttcagtttttagcaactaggaaattcccccttcttctaacctcgattcaccgtgccacagatttggtttggacgcagacggttctgtttataggcctgccactcggctttgtctgctctcaggaatgacctccaccaggccagatcggaggtggaagccaggactcggtagctccgggaggcatgtgtcccctttctgctgggaattttctctttcttgggtaccctgtcactgagttattgtccctcccatcttccacgactctttcttggtctttctttaaaaaaaaaaaaaaaaaaagccgggcaaggtggctcatgcctgtaatcgcagcattttgggaggccgaggcagttggattacctgaggtcaggagttcgaaaccagcctggccaacatggcgaaaccctgtctctactaaaaatacaaaaaattagccgggcgtggtgggggacgcctgtaatctcagctactctggaggctgaggcaggagaatcgcttgaacccgggaggcggaggttgcagtgagctgagatcgcgccactggactccagcctgggcgatagagcgagactctgtataaaaaaaaaattatgggtattttcaaacatatagggaaagcagagagtataataaacccccgtgtaccccaaaacccagtctgggtaattagcacctctagcaacaggcagctaatcttgttttaactctaccccagttcactttatcaccaccagactgaactagtttatagcaaaacaaaaaaaaacaaaacaaaaaaacaaacaaaaaaaagaattaccttaatactattgttactctttaaaaaattctttaataagtatccagtagttgttcaaatttccttgatagtatcatttttttaaattgttagcttgcctgaaaagtctttacattgcatttgttgatatatatctgttaggtctcttttgatctatagactcctgttcttttttctccttgtcttttatttattgaagaaatgggtcatttgtccttagagcagtgcttctcaaacttgaatgtgcatgcagatcactccagggtcttattaaaatgcagattctgattcaagaggtctgggtgcggcccgagactgcatttctgacccccttcttggtgatgctgatgttgcaggtccgtggaccacactttgagtagtaaggctgtagtgttgcgcagattctggattttgccaactgcatctctggggtgtcttttaaacatagtctatcccttgtattttcactaaattggtatttttagatctacaggcttgactagatttagggttggctttttggcaagattactttattagtggggctgtatatttcctattgcatctcattaggaagcacataatttggttgtctcttttttgtgatttttagactgatcagtggattcaggtgttatcagcctataccttctattatacagttcttgtcttgacccattaatatagtcccctaatggtaggataccctagcaccttccctgtacctttcttctaaatctctacagatgctattttctccataaattatttctcgtatagtctcttaaaaggatctctctctctttttctttcttttttttttttttttttaagactgagtctcactctgttgcccaggctagagtgcagtggcgtgatcttggctcactgcaacctccacctcccaggttcaagtgattctcctgcctcagcctcccaagtagctgggactacaggtgcccaccaccacgcccagctaattttttgtatttttagtacagacagggtttcaccatgttggtcaggctggtctcgaactcctgactgcaggtgttccacctgccttggcctcccaaagttctgggattacaggcatgagccactgcgcccagcctttttctcttctctgcatctgtaatctcatggaatcaaagacctgaagggcttgaaaggtgaaccagtccaaatatctcattttatagaagagaaaactgaggctaaagatgttaagggaatggcccaatgttacttagctaattagagtgagctgatccagaattagacctgtgattgtttggaccgacaaccaagaagccatgagtaactttataaagaggaattttggctattggataagggctgaagcacagaatcttagaatgggaaagcaacatgggacattagagatcattcctaattaccaaaatgagaacagtgaggtctaaagttggtaagttgaccttcctagatgacacagctctctcctgggagagatagggcttaaccagggactctggggtgagtcgggtggtggtagtgagggaacagagtcagagtcaccgtgtggtttggtggcacacaggctggagagggaagatgggatctaaaaggataatgtgattgaggaaaaggtttttttgtggatgtttgaggcagagaagatactcaatacatcttgttggatgaatggatgagaagaggaagttgggatgcctaggatgggaagtagatagagggaaagagaagatgctgaacagagtgctgggacattgatctggggacgataccagggtccttcctttctcagcgagtgagagagttggccggggggtagctcttttgaagatggaagtagtaaatgctgggccatgtctggggaaaatagcacttcagttacagtgagaaggaagagagagggctgaggaagaggcggacaatatcctgacacacttgaataggggttctgatgggctgagaggggcatgggcaggagatgacggtggcctcctttgatgcctgggctccagatcagagccgcagatagaccctaaaaggcagaggggtggctgacctagacctgagtgaaatcccccaccaccccgcacactgcctcttttttgagggaacaggacactggcaggaaatagggaaagagaaagcaccaataagccaccctgtgcagcccccggggcctgtgggacttaggtaagaacgaggcagtggtgctcatttacagcgagagcatttctgataccgtgggcggggagcagcctctctctgtgaattagcttggcaggttggaatgtaagtcagactacggtgaaggctggatgccgtagggtctcatttggtttggacataggagagtagctgagggagagggttagctgagccttagtaaatgtcagttatagtagcctgaattctgcatagaggccacagagttgcggactacttacattgttttctgctgtacacgctgcctaaactgcccatcaactcttttatgcccgttaacatacccttccagctcaaaagctttctcctctatgaggctttcctcaatgctcttgctagaaatgaatcttccccttctctgaattttcactgccttgttttctcctcttaaagggaatgtatattctgccatgcattttgcatagttgtctgtcccctaggagactttaaactcatagaaggcggggaccatatctgacagctctgtgttcttcacagttcctggcatgtcttacccatatcaggtgtccaatataactatttgtgagttgaaagaaataatgtgtgcaaaaatcctaaaatggaaacccaggtgttctttgaagaaacgtgataaggtttctttgcttccgtatgagttcccccaacctctctggatgaatatagtgaacaaataaagtggaccaaatttccaggatagggagagacatggaaggttaatccaagtctccatcaagtggtcctctgatcacagctgaaggaaatccatacctgaacacctgaataggtaacaagagtagggcacatggggcatgttttatatgagagagacattaagaggcagaagacaggagtactcactgatctatcaagaatgatgagaacctacttattctgtgctagactctagggatggagcagaaatgggacacagtccctgtcctcaaggtacttccagtgggtcaatactagaggcagtggtgtgctgtcagtgcttaacagcagactcccttggaggaaaaaaagcctttgttattgtgttccatggtggtgtcaatattcctactatggccaatttcaagtgaccatgatgacatcaccaaaaggcaagttgggaagagatacaccagcaagcaagcttgctctagcacactgctggctggaggcaacggggaagaaaaggaagtagttacctgcatgtctgcagggcctatggccataatagagaaagtactgggagtcaaagaaaaacagggcaaacaacaatatctgttttccgcagagaaaaactagagagaatgtttctagtgtcaataacctgatgtggctcagaaaggaagaaaaggtgatgtattgagtggcgacaacattattggaaagacagtccagtatttttttttttaagacggagttttgctcttgttacccaggctggagtgcaatggtgcgatcttggctcactacaacctctgcctcctgggttcaagggattctcctgcctcagcctcccgagtagctgggactacaggcgcatgccaccaagcccagctaatttatgtattttttttagtagagacagggtttcaccatgttggccaggattatctggatctcttgacctcgtgatctgcccacctcagcctcccaaagtgctgggattacaggcatgagccaccacgcctggctttcaggacagtccagtattatccacatacacaaactggcctggcctgtagcaactcttacagaacagtggcttctcctgcattcagaggtgctggtttatatcattttaggagctgatgtctattgtgggcagttagataatgatattaatccacacgtatgttatatattattaatatatatcatttattgagtaactattgtgaaccagcactttatatattttatgtctaatcttcacaaccctacaatgtcagtatttgtattcccatttatttttttgagacagagtcttgctctgtagcccaggctggagtgcagtggcatgatctcgcctcactgcaacctccgcctcctgggttcaagagattctcccgcctcagcctcctgagtagctgtgattacaggtgcacaccaccacatccggctaatttttgtattcttagtagggatggggtttcaccattttggccaggctggtcttgaacacctgacctcagacaatcggcctgcctcagcctcccacagtgctggaattacagggtgtgagccactgcgcccggccttgtatttccatttttacagatgaggaaacattgactcggtgacactaaggaaggaatgtctttccaaatttgtcaaggttcatgatagtcctcatgaacctgcgggtttcatgcatgagatgcaagtgacgagatcaagaagtcagcccaacttacagagtgcatgctcccgatgcctcttactcttgtgctttgttacctatgagatcgcatttagagtattatagaacaggaatttgatttttcattttaaggcggaccatgaaaaaaatggagtgtatcaagagaagagtggtccaggatatttgtgggtctataaatcaagtcctctaaggaactgaggctgtttagctcagtgaagatgaaaaggagacaccatgaagatacatctccagccctatgaaaggcagccatgtggaggagtgtggaggatgctctgtgtgcccctagagggtgaaaatgggcccagtggatgaagacttcagtcatgcaccccgtaaacacttattgtgcactgattttgttccaagtattgttctaagtgctgtctagggaagaagatgacaaggaatgggacacacaatccttgttcaacatcaggaagaactttctgaagatcagagctgtccagtaacgcagcaggcttcttgaaaagtagtgagcttcctatctttggagtattcaggaggaggctgggtgcccacttatcagaatgtgctaggatgagtcttttgtggagtggtaagtggaactaaatccccttccagttccaaaattccacatctacattcagctttgttttggcaggctagtgtgcgctgtgctgaaagagtgccatcctgaccccccacttccacctagccttgtccgccctggtgtgtgctccgagttctctgacagtgagctgaggtgggccagttagactggaaagtggctgcatctgtgacagggatgatggagttctggcgggtttgtgtgggctcaaggaatgcggcattgaagccatgtacacacaacctgcttaagaacatcccatgggcagaaaatgttttcttcctctttagccctcctctgttgctgtgccaggcgggcacaatggtgcctttgagaggggcagctggaagggggtgttggcaggcagactggaagtagaatattgcagctgggggtgggggtgcccaaattcatttccaggagtgagccggcactgggtgccagtttccaaaacaaaactgctgtttctcagagttcacagtgatgggttgcttcagagttggacagaaggcaaagctgtttcctatccactgctccaccctccccaggtgtttttttctctttctttctttttttttttttaaactagtgtgttaagggattcttgctctggatgcagattaataggctttgctgtctgtctgggaagctgaggccaacctggagtggatggggctttttgagggatcacactttcctgcagacaaagcagggcctgatggcctgggggccagcagggatcatgggcaggtaggcttctgagccatgagagagggctcagaatggagaccctttctgccctgcagggtgacttccaccctacagccacctggcaccctcactgccacatgagctctgcccactcactgtcttaattctgttgggtgggaaagaggtgggagaatgttggcatttcctgtcctggttcacagttgtcccggaccctctgctactatcaaagataccaccaatagcttcctagagatgggcgtgggaggccttctcactcactgcgcagttaggagaaggcatgagtgccagccatcttcccctttgtgttacaaatgcagcaaggtgggcccctttttctggtagcttccaagaaaaaggcgggacttgaggctggccaagtgatcattgctaatgttcacaccaattgtggaattccctatacttggttcaattttataatcaacaaacaactattgaggaattagttcattttaggcattgtgctaagtccaggggtatagaatgaataagataaagtccttgcttcagaaagctgactgcctgatagatatgccaagtcctgaatgggagcccctttatcaactaaatggacacatgacttttctaaaagcaggaaggtaatgcagaggtcatctcctactgcaggtcccgtggcattgtgaagggcatatgggctggggatcacagattgaggcttgaaactcatctgatcttgggagtacttacttgttttatgagatgcagtttccttgggtaaataatgggaataatacacaaccatgcagagctgttataaagatgaaataagacagagcttgccacgtggtaagtactcagtaagttgctgctattgttattcatttgttgagcctaatgggcttgagatataacacgtgtgtgtgcacagtggtatttatccaaccccttgtagattctatgaccttctttaaagattcagttcttctaccttcttaattcctcttctagtgaagactaagattagtaagtttatgacttcacaggataagttagaaaaacaaagacatatccactatagccaacaagacatatttgtatataatattctctgtttaataacctgtgattgtagaggaagaaaaggattgtaatgtttctcttccctgaggttcccaaatctcccatgtgtggtgatgaagatcatgaattcctctgaatattctaaaaagtctaggtcatttcccactgatggggcctcgcagtttattattacttaaaagatgcatttgtttggtagacattgcttggggaaagttattcttttagtaagggaccttggtggtagaagacatatgcttcctggggctgggacagaagttggctgagaggatcttccagaaagaaatgtattgtgggagagcattctgacccaacatgctgaatcacttgacccccaactttggtcttctgagactttcttgggccccatctattaaacatgctgcatatccctcaacaactactttgtgaaaatgtaggcataaaacataatctttaaaagttacttctaagtccacggaagacacaaagtagatagagccaggagtctgaagacaaaagaaaatcaaagtaattcacaaagaacaaaagaaatggaaaagaaccggaaaataaaagcatatgaatgaatagaggcttgaagtgaactacagggtgcacattagtaagaaataaaaaagagggtcatttaagaaaaagaaaaagttttatgtgccagaaactgcaagcaaacaatggaattttgtaagggaaagttgacagaaacagtttttctttagtaagctgaacgattctaagcattagtgaaggaaactcgtagtcagtgcacgactgaaagagacagagatggggatgatggagctgcatttaaaaatgaataaagatttaataagccaaagaatcacagaggtcctcaggaggcctgatgataaagaaacaagggctaacattaccctaagattgaaacgaggccaatgttgtagcagtgctgattcctggttggtgggattgggggttattttcttttttgcccctctgtattttaaaatgttctgccatgaatttggattacctttgtaatcgggaaaagaggttagcccacatattaggagtagcggaaagaaaccgattaggaggaagcagaaagaaaccaagtggtgagaaccggtgaatgggcaagaagaagcaaccagaagtggcaggagctgccttggatggtctcacagtgaaggtgatgctggaatgagggagctgctggactggattgaggaaggggaataaactagaaggaggagctctctcaggaccattctagccttacttttgactccatggtttgatatgtaatcaggttggccctcttattttccacgaactcaaaatcccttctaatgctcttctcaactttcccttccccatgcgtgtttccatttcttccactgtggcggcatggacaggctgtacgtcagccaattcctactttccttactccagggaaaggctctacctgtggtagctgagaagaaggttcagatcatatcaggagagaccaagacttgaagacctctttccctctagtttaagagtgtgcagcactgcaggtggatgctaagacagagtagagaatgcccacagctggagcttaagagccgtgagttctcttctgcacatactggtttgggtgaagttagtcaaggtacttaacctgtgaagtccttgatgtctcttttttaaaaataatagcactggccaggtgtggtggctgatgcctgtaatcccagcactttgggaggccaaggcaggtagatctattgaggtcaggagtttgagatcagcctggccaacatggtgaaaccccatctctacaaatacaaacattagccaggcattgtggtgtgtgcctgtaatcccagctacttgggaggctgaagtaggagagtcacttgaacttgggaggcagaggttgcagtaagctgagatcgcgccactgcactccatcctgggtgacagagcgaggccctgcttcaaaataataataataataatggcgctggtttagattggaatagctaaaggtatctgcccaatcttaaaggacagtaatctgactcattatttgtgctaaatgttagttttagaatatggattctcataggtgagacccatatcctgatatggtgatatggattaaatatcaccagcatagtacccagcacgtccttttttttaaattaaattttttaaaatttaaccattttaaagtgtcagtggcatttagtcacactgtctttttaaagtgttagaataacatagtcatttgggttggttccattttgttgcaataaaaaaatgttgcattgcacctctatgctcatgtgcgagaaactctctagatcgatgttgagaagaacttgctgggtcatataggctataaatgcattttcggattggcgtgtattgctgaaccgctctccaaagtggcttaccactgatgttcccaccagcagtgtctgagagttcccatttctgctcctcgtcacggatagtggctgggttttcatggaactccatagggcagttaaaagtgacgaaccaggccaggtgcagtggctcatgcatgtaatcccagcactttgggaggccaaagtgggctgatcacttgaggtcaggagttcaagaccagcctggccaacatggcgaaaccccgtctctactaaaaatataaaaattaactggacatggtggtgggtgcctgtaatcgcagctacttgggagactgaggcgggagaatcacttgaacctggaaggcagaggttgcagtgagccgagattgtgccattgcactccagcctgggcgacaagagcaaaactccttctcaaaaaaaaaaaaaaaaaaaaaaaagtgaccaacctgctctatcagcactaacatggagtgatctcaagaacataaaggtgagtgaaaaggtaagtttggagcataaagaggctggggccttcagctttatctgtaatattttatttcttctgttgaaaaatagttgaaggcgccaggcgcggtggctcacgcctgtaatctcagcactttgggaggccaaggtgggtgggtcacctgaggttaggagttcaataccagcctggcaaacatggcaaagccctgtgtctactaaaaatacaaaaattaactaggtgtggtggcgggcacctataatcccagctactcaggaggctgaggcaggaggatcacttgaacccaggaggaaggggtttcagtgggctgagattgcaccaccgcactccagcctgggtgacagcaagagctccatctcaaaaaaaaaccaaaacaacaaccacaacaacaaaaaatggaaaaatagttgaagtaaataagacaaaataatgacaatatcaattctgagtgagggggagttgggagtatttgatatactattctcaagacttttctgtattaaaaaaatcctcaaacactcaagaatgatcaataaatactaaaaaaaaaattaaaaaaatcctcaattaaaaggagtaattgatgtgcagagattcccaaaatatactggataaccagatattttttttgagcagcttccagatttggacttacttcccctccatcaaagtttatattagttcatattagtggagctggctgaccttcccttgtgaatatgttttaaagattggattaaatatcaaggaattgggccaggcacagtggcttatgcctgtaatcccagcactttgggacgccgaggcaggtggatcatgaggtcaggagttcgagaccatcctgccctacgtggtgaaatcccgtctctactaaaaatgcaaaaattagctgggcgtggtggtgcacgcctgtagtctcaggtacttgggaggctgagggaggagaatcacttgaacctgggaggcggaggttgcagtaagccaagatcacactactgcactccagcctggcaacagagcaagactctgtcaaaaaaacaaaacaaaacaaaacaaaaaaacaaggaattttgtaagttcttatttttagccagtgaaatgaaacatctctacaaaatgtaaaataagtgcttgagttgaagcctgtctggtttgctctacctatgatcccatccagaaacctctacaaggttattctgggcctggggtgggggaggtgactcactgtgtgcctccctcgccccaccccccacctgcttaatcaggtgaaatcaggttagaatgaatattaagagcctctggaagggaagagatgtcagagaggagtaccctgagagactgccttagaccagggatggtgagggtgagggtgggggtgtggggacatgctggcttcttttttgtttttttgttttttttgagagagttttgcttttgtcacccaggctgtaatgcaatggcctggtctccactcactgcaacctctgcctcatgagttcaagagattctcctgcctcagccccccgagtagctgggattgtaggcatgtgccaccacacccagctaattttgtgtttttagtagagatgaggttttaccatgttggccaggctggtctcgaactcctgacctcaggtgatctgctcacctcagcctcccagagtgctgggattgtaggcatgagccaccgcacccagctgacatgctggcttcttaattagggcccacaatgatttatggagcacccagtttccaggtacagcactcacgttcacaggccttcctttgtggtctcatagaagaagcatctagggtgaacgtttgcaatatttttttatgctcccattttgacaaatggaaaaaattatttcctgcttttgacgttatctgaaatgtcaaaataaagactgggaataaggacattggatatgcccaaacctggttgagagtctctgctctagactgagcttctcaagtgccagtactgccccgaaactctcgggtgtctggcaaatctggatttgaaggctgatctgatcacttgtaggttatggacctcaggtgagcttcttaccttctctcagcctgtgtcccccttctctggaaaggtgattatgacacctgccacttagggctgctttgcagattccatgaggcacttagcaccactgccagttacataaaaaaacaaaaacaaaaagccctgaaaacttcaatcctaataatggccttgggaggtagactaacccctatgccccccattttatagatgagaatactgaggctcagatatacagttcaataagtggcttaacctaagcacagaccagggctcactgccaggccttgtgactccaagtcagggccctggccatgtgtctacaggtgagcaggagatttagagtcaccttctcccctgcctgagtcacaggcagggccaggagtgatttgactcacgtggctctgcaggactccttgcatctagtttccttagcgctaggtaagcaagcgccatattgaacagcttttgtgtgttctgtggactcccttcagtttctcttttgtccagttggcccagttggccacaagcttcgtttcagagatgagaccaagtctcctattccttctcaaacagccactagcctcagagaaatcgcctgtatatcgcctgaatggctttttttctttctttcttttttttcttttttttgagacagagtcttgctctgttccccaggctggagtgcagtggtgcaatcttggcccactgcaacctctgcctcccaggctgaagccatcctcctgcctcagcctcccaagtagctggtatgacaggcctgcaccaccacacccggctaatttttgtatttttagtagagacggggttccaccatgttggccaggctggtctcaaactcctgacctcaggtgatccacccaccttggcttctcaatgtgctgggattacaagcgtgagccaccgcgcctcgccacgcgaatggcttttaatggaaaccttccctgcagtctctcatttgagctttaagtttcaccatccaactttttaccagattggcaaaaaaaaaaaagaagaaaaaaaaaaggaagaacctaaatagacttcactgtttccctaagttccttacagctgtgcccttcctctggtcactgaacctgtcaacctaagttccctcaaccgtaaagtgaggacattaatattggccctgcctgttctgtgcatcaaaataaatgagatgctgtgtgggaagaccttttgcaaactttaacgcagttttcctcctctctgactctctctcctatgatccagcctgaatctattccttcctcaaatgagaagtaggactgagtcttctgttctttgcaaagcatttctcagcacacctgcccagctgcatgagctgagaggaaatcagcatattaaggaagaagaaacagtgcctcctgctgaagactttactgcttctagcacctgttaggtaaatctctgtttattgggttccaagctaaattcactctaaaagacctggaatcttctctcttatcagttttcagcaatgaagttttggttgagacactgaatgtacctaagcctcatttttaaaatgtgataatagttgccttgctgcgttgtcatagcatattaggacatgttatggtcggcagtcaaagcacgtgactttttcctgtcccactggacttttctctcccttcagtttactcttctttttttttttttttttttttttaagacggcgtctttctctgtcttgcgcaggctggagtgcagtggcaccatctcagctcactgcagcctctgcctcctgggttcaagcgattctcctgtctcagcctccggagtagctgggactacaggcgcccaccacccacacctggctaatttttgtacttttagtagaaacagtgtttcaccatgttggccaagctggtctcgaactcctgaccgctggtgatccacccgcctcggcttcccaaagtgctgggattacaagtgtgagccactgcacctggcctagtttacccttctaaatctctgtgcctcagcttgcttccccataaaatggggataataatctctggactacttagctcacagggttggttgtgtgactttgaaataaaggctatggtggggaactgaagatggcgaaatgtagtagcaatgcctcagtggggttatttgctggcctggggctggtgggtcgtgtgctggttctcaaaggcctggcctgttgtctgcagcaaccacgtttagaaggtcccttagcatagctgctcttaccagctcttcctgaggcccctgacactctcccatctccctgcaaggctctgcggtctccttacacctgttacccccatgcctcgccctgtccgtctctcttagtccccctctagatcacaaggcacaggaccattcaccgctattctctggatacagaaatggtgcctgccccaatcctgagggctgtcagaagctgcccatcacatgacacgctcagccccactcccccagctaatcctcatgaataaatactaaaaagactcattatggagagataaggaaaacaggaagtgcttctgaaagctcccaacaacaccctccctccagaccagtgaacaaccccaccccctccagaggccaccagtgtctttagcaacgaggccccctctgcggttgaggaagagcctctgtctctcaaacccagaggggactgtggggcctggagccgggagggcaggccagaggcaggggagctgagttgctgtattctgggcacaatttcaaggccagctgcagggagaacaagcagtcgctgtgcgcctgcagctggctgtggttaggccagggctgtccctcacttgtggtatatttaaagagacctcaccagacggctgtgccaaggggaaaaaatgcacacatatccctgttagccacactcggttcccctgccaaggcctctcctccttcctcagctcccagcactgcgttcacacgtcaagagaggaggaccggcttctcagactccctgtgtgccacctggggacacacaacctggcgcctggcctctctgccctcttaccaagctggccaaaagttcaggggattagccagatcggcgcctcccaccctggcgttggtaacccagcaaccgaagaggagaggcaggcagatgagtcaaatgcagccgcacagaacctctggcttcgtgttttgtttgtgaaaactccctgtgagtgaggagcacaggggcccttccggcagggaggggcagggctttcctacaccactccaggccacaggtgcctcctccagggaggcccaggccccactggactgcagtgcgggcttagaggccaagctggtgggccaagaggagcccaccctggctgaactctctggctgcctcttccacttattttcctcaagtgaaaagaagactacgggcctaaatcccacgggaaggtaggcctggtagcaagaactctgggcaagagaaccaatgggcgtaaagtcccacggagcaggtgtgcatagaagtttgggctttcaggtggccagacaccaaggagctgtcctcatggcaatcaatgagagggcttccggagcgaagcccagccaacgtggggtgagagggtgggaagtgggcagcttatcaaccaggggaggggagccagcaggcagactgtctgaggcaggcccctacaagtgccggaagagttagtgaaacacaagtgcaccaacaggattggctacataatttgcggggcctagttcaaaatgaaaatgccagcttctttgttagaaaattatcaaggatttcaagacagtgacagcataggatgaaatcaagggcccttctaagcacaaggacattttgtgaccacacaggttgcacacccacaaaactgaccctgggtacctgtgagtcagctcgctgaagcagatgtgaaaatcaaggcaggtcagctgggggatgtctggctgcagcccctatactccccacccctgctgccctgtaacaccagttcccagacttttaccaggcttgggacattgtctctccaacagcagcccctctccctgtgctgacggcaatggagactttatctctcagaaaagagggaatcgcaaggccacggtggaaggagggctgagggctggaatgaagtgtggctctgggctctcggggcctctgagtcccaaagccccccagggattctctagacaggccactggagccttctgagtgagcgtatggaggtgttttggaacaggatggagaaacaacagagactacgctctgggtcacctcttaaggtcccaagaggatacatcctgtgcatgtgtgacagtccaggagcagaaccaagatccaggaagccttctccccacttgggaacttacctccaactcaatgtggtcgtggagtttcttgcaggtcgctgcaaaagtctccgaggtgccaaattcaaagtaccacagcttgttcttcatcctggaccacaaagcagagagatgtctcaatattccatacttgaaatgctcatgtaaaatagctatgttctttggattgggaggcccaagccttcagcaatttccccaatcttacattttcagcacttgttaatcagatgatcaaggaatagaaattttttaccaactgttcttgctcggaacttagagaaaatccacttatttcttagacatcacggcaaccctgggtgaactaccaactgctccccgagtttcctggtcagaacaggaagaaggtctctgtagctgcattaaggaaagagctctacgagaagtcaagccagaggtggcaaatatcaatacagtgctctggccactgtcctttccattactcaggcagaactctcttttgggtatgtttggggtgtaaagggaagatccttctaagacttgagggatgtgcagtcttaggacagaggagggatagccccacactaacccagctaaaatgtgtgctgcattgcccaggctctgactgggggaagcagagtggcaagaattagatacagacttgcaggcaagttggaaaaaaagaagagttgattggtagcaataatcacctcccctcttcctcaaatgtatttgcttaggccatggcaatccttcagttaagggcaagacttgtcatatttgcttcaaagtaagagttcactactttgagctttaaaaattttcagcattttccttgagagaaaaaaaaaatcaatcaatggggttcccgtgtagctgggggctttgcaaagtcagatggtgtgtcctgacacttggtgcttttgatcagatggtctcactgggaagtgtttctgaaggtattccattccttccaccccaactgtcaccccattatcaggggttggctaagagaagggacacctgtccagtttacgagctgacagattttgctaaggaaggattaaacaaaatcacattcttcttggcactcagaagagaggatgccaccttgcatggcgctaatcctctctcctcaggtttgcagatgaaggggaaaggagcagtcttcagagggaagagggctcttattttttcctcatgttccttaggttgtagcagatgactctccagaataatagacacaactcttttctgcagatttccccaagagtctacctagaacttgaagatgaaactgtgttcttccattgtatgaagacttctgagatctagttggttgggaaatagcttctctgactcttagtatgcatgaaaagaactaataaatgatgaagaaagtaagagtaagcaagctctgggaattatgcctcatgaacaaaattagaagagctgggtgtactgtaagcagaccggtgcttctcaacccatgtgctgtggcacaggcgtacctgggatgtcagtctcctcagcctgcagagcagccaggtgggatctgggacaggctgagccccaatgccatggcaaacattctcatttgtattcccagtgtgccacacatagattttcattttctatgcatgccatgatgatgtaaaataattgggggaaacattgttctagatgactggttctctgcatgcacagtcatgtgcatatctaatcacttggggattttatgaagatgcacattctgattcagtgatttagggttagggcccaagattcctcatcttcagtgctgctggtccaggggatactgtgagtcatgtggatctggagactatgcctgtggttctcaaacattggtatttataagaattacctggggaatgtgattaaagtgctgcttccagggctccaatctgtagagattctatgagagagttgtggaacggggcccaggattgtgcatttttatgtgtgtccaagtgatcattatgcagatggtcagtggacaggacattgctgtagatcccagtgaaatgaaaacatggaaaaggacagaaccagttaaacctgaaggagagaattctccagggaggacagaacgagggtcagtgcctttccacagtcaatgatggcaaaagactaagtaacaggaaaaacacagattgtcataaatgtcaaagctgagcattcctttttggcagcaagagcatctttgtagccaggagacttgcttgtgattccattttcaaatatcactgctggcctgaatcatgacttttgaaagttattgccaggagatttagagtttcaataaaagtttccggaagccacagctatttttgcccagtagtagctcttctgatgagctaataaaggttaagaggtcacggttaggtcagcatcgcagaataactgagaagatcaaacggactactcattcattgctggctgtgtaacctttgacaagtgatttaatgtttttaagcctcagtttcctcatctctaaaatagagataagaaaaatatctgcttcaagaggtagttgaaaagttaaatgagataacagcaaagcacttcacataggattgctgtatagcaggctcatcaagaatgccagctacttacttattagctattattatttcagtgtcttgagctggcatatttggataatatagtgaggcaaaaatgacagataaggatgtgtagctatagatattatatattaatatttttctgggcaagaaaaaatgtgatcatatttattaaattatgtgtcttgatttttggtgaaaaaaatatgctccccatatgtccttaatagatttttccagagtcataccatgccctaatccttgattaattatcttgactggtcacacaattggccaaagcgatgctaattgctaatatacttcggagaaagtgcatgtttggtgtgagacaaagtattcatcaattcaacagacattcattgtgccagggactagagaaggtgtgcctggtacaacaaagaacaaaatagcattcctggacatctggaaaagacagacaggaagcagaccacagtgtggttggccaagaaccaggcaccagagttcatagctggagggacacccaattcttagaaggatgtagaaggcaaacagggaaggtggagaaagagcatttcaggcaaagaaagaagctaggccatgggacaggcaagagagagaatagtcttgctggaggggacacagaactcaaggtagggcttggctaggtaaggctggaggcagacaggagcaagactgtgaagggtgggcacgccacactcaggggtttgtgctttatcttaaaatctggtggggcgcgacggctcacgcctgtcatcccagcgctttgggaggcagaggcaggaggatcacctgaggtcaggagttcgagacccgcctggccaacatggtgaaaccccatctctactaaaaatgcaaaaatgagccaggtatggtggcgggcactggtaatcccagcggcttgggaagctgaggtgggagaattgcttgaacccgggaggcggaggatgcagtgagctgagaatgcaccactgcactccagcctgggtgatagagtgagacccccatctccaaaaaaaaaaaaaaaaaaaaattctatagggagtcatggaccatcctcaagtggctggggagggggatggggtgatggtagtgacctaatcagacttaggttttttaaagatcattctgttccatgtgtggagaagggactggaaagagaggtacagactggaagtttggaaaatagattggaggtggtgtagaaatccaggagataactgggaagggcctggacaagggtcatgacaatagcattagaagagaagagtgggggagactcacaagctaaaatttaggagttattttagcttacggaacaaaaaagaggggtcacagtgatagccaagtttttgtcttagacagcgtgatagatgacaggtgccatttcctgagagaggggcacaggatattgatttcccagtggcagtcgtctttgtaactgaaagacagcacttttgtttttggttaatcttttcattcatccatccatccatccattaaacatttatggacccctactatgggccaggtgctgtgtagggcttggagataagtgatgaataagacaagcaagacccctgccccaccccccaaacccccattatttggggggtggggcagagtctcattctgcctcccaggctggagtacagtggtacaatcttggctcactgcaacctccgcctccccggttcaagcgattctcatgcctcagcctcctgagtagctgggattacaggcatgcgccaccactcccggctagtattttgtatttttagtagagatggggtttcaccatgttggccgggctggtcttgaactcctggccttatgtaatccatccaccttggcctctcaaagtattgggattgcaggccaccgcacccggccgagcttatacacttttaatagcatcaccaagacctaagattgaacctctgacccacaagggacgtggcttttagatatgttcaaaatggaaatgcttctatttctcctcttttaactcaggcactttttggctagaagtgaatgcattctattcccatggccctttggttttgcactctgctaaacattttacacacaccatctccttcagttctcagaagaagcttacaggtaggttactctaagatttccttattgctacaaataaggacattcacagatggaagtgaattctcctctgcctcgtcttccttttcctttgtcaacaccagcacaccaccaccaccacccatttccaaagccttcaggaaaagcctataggcacgtggtaccctacaatttgagctgggagatgcagcccccactctccctgactaccagagagcctgagtgcaatgttccttcttctcttttgaagctatctcccctcctactttactcttagcccttgttggaggaccgttgctgcagaatgtggcactgagcttttgtctgtttcatcttctattgtacaagaatatggcatctgagagctgagaggctagggttcatgactggctttgccactcactggctgggcaagttatttaaattatttgaaccttcacttcttctacaaaatgggaacattattttctactcacaaagttgtgaggcttatgtggcaaatgcaaagtaccaagcaggtgtttaatgcatagtaagtgctcagtagctgttcttccttgttgctaggagacacaatcactggaagaagacgcattccccacaggctgcaggggtaagggtgggtctactgtggggagtctatcgtaggtggcccatattttttgaagaaaataaaactaacgatgttttcatggctgctggaatgctttttctgcatctctcttcctgagtagtctttggcccaccatttttttttcccctcttacaatcacctttcagctggagatgactaatccttaaccagctgttctgaggctgatttccagttccatgaaactcctaggttcattgtcaggctctgaactatccagatgaacccattcttgaggcagaagatcctcctgtgtgctccaagggactctcagccacatggagaaatggcaaatacaaacagtgacaccatggctcaactctatttctgggttttcttaattgccccctggcttataagaaaataacatcaattgcacactagctagttgaatcttttcattagacagatgagagaaaaaatgagactaactaaaaatgttcttttatgtttgtcagcaatttagggctgaaatccatcatcctgacagctatgaatagcctgttttcaaggatgtccacagtgaaacccagctagctgctggccattcactttaccagcagaggctacgcactcagcttcctatgccaccctgagcttctggggaccctttcctgagaatcaaggaagttttaagggcattgggcttttgaagttgtcaaaacatgaaaacatttatttgggcttagaagtctacacagagaacactacagttatttctagaaatagaagcccttgaagtgaaggtattcctctttgtggtttggactttgataatcaggttctctgagtgactcataactcacatagttagttaggccttgggtgtcagcattagattgggaggcctggtgaaacagatgctacccacaagatggtgttctgtatggcatggggggagggcagaatgatttagtggagactgtgctgcaccagcgggcagagctgcctcccagaccccattatcaaacacaccagcatgtgacttcatgagagtcactcagcaacaccaggcctcagattcctcatcttaaaaatgaagggcttggggccgggcacagtggctcacacctgtaatcccagcactttgggaggctgaggcgggtggatcatgaggtcaggagatcgagaccatcctggctaacatggtgaaaccctgtctctactaaaaatacaaaaaattagctgggcgtggtggtgcatgactgtaatcccagctactcgggaagctgaggcaggagaatctcttgaaccagggagttggaggttgcaatgagccgagatcgcgccactgcactccagcctggcgacagagcgagactccgtctgaaaaaaaaaaaaaaaaaaaaaaaatgaaagactcggaccaactgctttccaaggtttctccaagctccccagacaacttgagatgacacaattcagaacaggatgggaggactcacgtgttctacaactgctgctgtgtaggagtgtgggcccaagtattgtcagaactgacatttttgaaagagaatccagaaatatattttcatgtaaaatctcctgattattggaattggcaactaattcaagtttttaagaacctaagccaaaaaactacacatttgggaaaactgtagctagccaacaggacatttctgtatatgaattataaattttcatcaggttcatctcaattaaaatataaaacaaatgatctcaatcccatttgggatttgctgggttattagcggtgttattgctaccactactgaagataatagactagcattggattactaaggtaaataataatttagcaaatcaggtataacagaaatgcagaacggccaaatgcaacaagagttgaattataattgataaatattagtaataatattgacagtactttacctgttaacattttacattacttgaatctcaaatacctttggaagcttagtgattatgttaaccgaagtttacatcaagagttaaaaaaaaaaaaaaaaaaaagaaaagcaaaggcaggtggggtctgctctgaggccaggatgtcaagtcctataaggggcccctgactgttacctcacaggtgctgcagaggccatctgtgtcacccgcacacccagctgccttggcccatcagagagtgtgtcaccacatctaatccacgctgcatgctgtccccagctctcactgctcatcagaacaggcacgcagtgatcctcaggcaccgagctgtgcatggaatcatcttttccaagagggggcagtggcccctttggttcaagggaaagtgaacacccaaaaatcaggaaggaggctttataaatagctgtttttgtactctgaatgtgactcttgtgcctgctgttcctgccaacagatttgtgttggctcgatgtgtttcagcttcaaggcgcgaggtattccctggcttgtttccatacttgggacaagactggtgttcatggcactcagaaaaatctagggtggtgaatgatgggaagactggaggccagagaccaggaagagtgggcagaaagatggagaacaggaaaggggagatctcaagaaggggctcagaaaaaaaaaggctgaggaaggagggagaaacttgagtaggatgtattttattgtataactatggaatcctcttaataacctctgaagacacttcttgagtcatttccatgtgtgagaaattaactgtaaaatcacagatgacatactgtttgcaactaagaggtcttcagggttcagggacttattatagccaggggatcacaggttccaaagagttcttccaaagtgtaaatggagtccaggagctgctgtcaatatgtcttaatgtaaaatagtatttgtgcatttaatcataataaagacagcataggctaactagtgggttaaactataatttttttgatgtgcaatggaattaaatcagttatatcagttactgcttggtaaccagagacacggattgaatggcaattgaatcctgaataatcaaaatggggaaacaaatgattacttagaagagctttatggctgaaaaaagtcttactcaatatggcacccatggtgggaggcagtgggagaatgaataaaaatagtgcactattccatagtaaaagggtacatgtaaaattactactctataccagggctccatggtggttctcttctaagccatggcagccttctcacggtacagcttaggaaaccgagatcagttcttggtgatgcagctgggaggtatggagctggaatacaaaccccgtcttccagcccatactccttactggtttactctccctggctcctgttgctatgccccagaggcacctgagagaaatggaaaagtcaaccgaagtcaccagagctagtgactgcaaagctgtgagtcattctcattcatgcctgtgagctgggtttactcacatctaccacatgcgccaccggtatggctgtaggatcccagcttgaggttggctgggaccctgacactctttagcagagtccatgatctgggcctccccattggtctccagtctccactcttgtcccagagtaacaaagggccaaacccataagcctcatatttagagcagcctctgtaccccttcaagggtaattctgggcccctaagaatctactgcctctgaacagtgacccttctcttccatataagacagtgtgtttctgcggaccaaggacacattctccattgataggatctccgaattctgtctggcacctgacagtatctcctcctaagggcaggactccaagcacgaagattgccaaagtctgaaatcggatcctttcccagtgcagcacacaaggacacacgtgtgcacgtgcgggcacacacacaggccgcaacaagaaggcttccctgagactcatgatccactgttaccaaatgtgctcgcagacactgcccctctgaggccagagagtctctccaaaggcccagcagcctgactggagaatggccactgtgctgtgaaaggcaccactttgggggtggccctcaggggagaatgctgaggggcaggcaaggccaggaccatgttgtcagggttttcctttcctgatggcctgggtctccagggtgtttttccagttagtatctgtccttgccaagagaaaatagctcctttccctcatccaaaaagaaaaaagaaagaaagaaaaaaccctcacagtttggctgcttcttagcaatcctttctccctttgaagagttattcgtggaaagaaaatccccttcaggctgatttggcggagggtggagggcatggaataagcttgctcttggcagttaacggagagcaaagtcaaatactgggacaaaaagaaatccctgcctggagggacggggaaaaggcggacaggaatgctcactcctgaggttctgtagtgattccttagctgtgctttccagcatttacacatccatcagccctgggaactggtatctgaaggcggtggggacagtgaagatacaggtgggtgaggcctcgtgttagaaactgagccttgaaggcttagagaaggtggctgtcctgctggagctgagcctctcgctgtggaaggtgacttcctgggtcctgatcaaccaagactaaaaggtggaactgtctggaggagcagaggcaaaccctggaagcaggtccacaccctcacactaccgtgaccgccgggtgggtcctgagggagccagctgagctctgccggcccccagctgttgagaggaatctcacttcccacttcataaatgttgaccgtgggtctgacctgcactggctgctttatgcacccaagggtcgcgctcttttgatcctcacgtctaccccctgcggtaggtactatggtggctatttgtagacgtgtgagatggttgttccttggcaaacctacagctagactggaacgggatcacagagtctgaggggatgcaggctggctgatcctgttctcccctctcgctccccagccagtctttctgaacacgaggcagtgcctgctttatgataggtcgggttacaaaagttccttggttaagccagttgtttgtcactctgagcacatttccccatagaaacaatgtgatgttgaggttgggttcccaggctaacccacaagagccaattaacccattaggtacccaaactacaatgtctcgttttagagagagcttactggagctgaaggagttctggtgggaaggcagaaaggcctgggttcaagccacagttcagtcacttacctgccatgtgaccttgggcaaatcatttagtctgtctcttagtttctctatttttgaattgacacaatatgacctaccttgcaggggttgctggcaatattaattaagaatacacacacatggtcgggtgcggtggctcacgcctgtaatcccagcactttgggagactgaggcgggcggatcacttgaggtcaggagtttgagaccagcctggccaacatggtgacaccctgtctctactaaaaatacaaaaattaggccaggcgcagtgggtcacgcctgtaaacccagcaatttgggaggctgaggcgggcggatcatgaggtctgggagttcaagaccagcctggccaatacggtgacaccccatctctactaaaaatacaaaaattagccaggcgtggtggcgggtgcatgtattctgagctgcttgggaggctgaggcaggagaattgcttgaacctgggaggcagaggtggccactgcactccagcctgggcgacagagtgagactctgtctcaggaaaacaaacaaacaaacaaacaaaagaatacacacacgtgtatgtatactatatatatatatatatatatatgtctcatgatatacactccaataaaggcacagtagaactccattgttgtatataaaactggcttcgtggcctcatgattctgagttccaacttaaagtacagggagcacatcttttccgctgaattgggattggggatctttgctttcctcaacttcctgggaaagaaacctggagactcctctaccctacatccccggcggtgaccctgaagtctgggctggagttctacttaggaggggaatggagacgccagagggagagtgagaagcagcagaagtggaaagggtagcagagagcacacactgaagtatgcatcctgtgtcttccttttgcaatcctaaaactctaggatggtctggttatttctgcctatgtttcctgtgccttccccaccatcggctggttagaggcatcttgtctagaattaagtccacggtaagtcgctccctccttgtttcccttacctttcccatcatgaaattgttagcaaggcaagtcaaaaatgcactcgatagggcagatgcctggataaataccccccttctcttccctattccatcttcttcctgtgccagtttaaaaaatcttaaataggaaagcatgagccagagcctcgctctgcctgagaagactgcggtagaccctgccagcaaaatcctttctatttcatccttttgaaaatctcatccatatgctctctactttgcttccactctgacgtttgtgacttcttattcttgtgtatacatccctgccacccatttcagagactgcaatttatgtgaacttgtcatcctcacctggcctggtggtgcagctgtgtgtcctgccccaccatgtctctgactgcaatctctaaggtcgtgctcctctcccctaaggaatacgaatcattcagtttgcccctctcactgtgtggttggcaaacttgtcccagctgtaggtgtggccccagtggtcctcccagccagttccttgggagagctgcttggcaccaccttagccacgcctcttatttgtagcttgcacctgctgcccttctgtgggctgtgattttagagtttaatttgaacactctactttatcctacttaaatctcattttaaagctcttctgtttggtcctcaagtatctggccaaaaatattccgcttggtttatgtgataagctcccaattccttgccagggtcctcttattccagcatcaaaatccatggtccagaagaacagtcgttctcagatcagctacagagcagctctgtgttccccatatgtgcctgtttcttctaaaattatgactcacggctgaggaagagactaaagcattgcctttgcccatgtcccttagcttgctacccaagacatcaaaggtcactagagatactaaccaggattcctccaaatgtgtcatttgccaccatgcccgcaggcagacaggagaaagagtctgtaagttatatgagtatgtgcactcgaatgcaggggctttcaccaatgaattcggtaaaatattggtctcaagaggctctggggtaaggggattctgtggtcaggtaaatttgggaatgaaatactttctcttgcttttgcatgatctcagcaggttagaatctacattaaaagctctacaatatcaaacagaaaagaattatgtttgactcaattttccaagtgtattcaatgattgacacccccccgccccccaatcttcttgtgaatttctttttaacatcctgtggaaggcattttaaccaatgctacatactttaatacatgctggaagaagacaatctgggtagctacctctgcaggctcatgaggagttgaacctcatggtaagtctgttagctgctgtgtctcccttctccagaaggtccaaatttattctccttgtgcagagactatacttttaattttttctccaaacaggaattgggaatttcctctttatttccatatctatttattaatcagagtgacttctctttatgttctctttgtccccctgagtcccttttctttctgaatcatttctttctttttttttttaatgtattttatttacttattttttttgagacagggtctcactccattgcccaggctggagtgcaagtggtacgattatattaatagttccctgtagctccaaaatcctgggctgaaacaattctcccctctcagcttcgcaaagtgtagggattacaggcatgagccattgcgcctggccctgaatcattttttttaatgacatctaggaaccctttgtcaatgctttaaaattctcctcaagcccattcattctctcctttggcaggagatcagttcacatttatagcaccaataatttgtgaccaaggtcaagcaagaaaaataaataattggcccccatcacaaccctaaggttatatttcctggacatcaacgtgacaagttggagggccaaggctcttatggggcctggcaatgtgtttatttggcttgcatggtggtgtttaaaattggaaaattttacatacacacctgaagcccagcttctcttgagaaatcagatctgttaatactggattgctttccaacctggcaatgatcgacggccactgagaactggctgctccctttacacagcactcaggctagagttctcaccactccctaaagcctcacatctacccacttctctcatttacatgaactgcctgcctctgcatgcgtttggatttgtgacccctcatatagaccgctgtagttttcccctgggaatttccctggacgatgcttcaaaagtgtctccgctactttcttcctcagatccttcctgtctgagctgctggtgtctttggttatgagtcctaatacatgtctgatttcaagggctgaccagctgcagcagggtgagagatgaatcatattggcatttgcaaagatcacatgcacagaaataaaatatcatccaaatctacctcttctgggaaataatattgcagttgctctgtgtttggaagttagggcacaacctggtagatagatcaactattccacaatcatggaacactgagaaatgaacttgactctaactactagaaaagtagcctaagctcacatttaccttttccctgaactcaccactttgtacaaaccatgattattgtgaattttaagattataccaccaaggcttgattattaagggacaaattctttagtaagtagataatccaatccttcaaatttcttcttttctaacccatcagctgttaaccatttcatttttctttagtgcaatttttaccagttgtggagatggggccagagggggaaatgtgtacaaggcatgaaccagaacgtcagctcaaatcagagggcatcccgtggtgttatctccaccccaaccctgcatatacagaaaccgtgattatgagcagccgcttcccctctccccacccaagttcaggggcaaggtggtacagaagaggaaagggggaacctgactaattacaacactctgttgagagctccaataaaagtttcactgagatcaacagtttgcagttttcatttacccaggactttctcactccctcttactctgtggtaacccaaaactggagattacagacccgctttcagcttattgagttcaaaggcaaggtagggtacttggcttgattggcagtttggaatgctctccaaaaaggcccactttcaggattaaagggacactccatttaacagaatagaaaacatcttgttactagagagtgaagaatttcaatctaagtgtaggttcaataaacatgaatattcagcaattacgtaattccctgctgtgttagtaatttgagggtataagtacattcttgaagtgagaagagcccctctttcattgaagagcattagaagattgggaaaatgccttcttagtaaaatatgaagtggtaagcacctcctaaccccttcaaatttaaacactcctacaatcttcataatagagatctacagtcttcaaagtagagatttgatgaccccctttggaggagcgtttatagaggggatgcttacactgagaagggggttgaaatctaaagtcccatccaaagctaggagtctataagttactattacagacaggaatcatgacagcatgcctttaaattagagattctacaatggattctcatatactgctgcatgttctccttacaaatccctgtagtaatcaatacagcatcataccaatacctgataaacttcaaatccattgatttatctactctaattctcacaggcaccttgtcaggcagttgtaatttccattttacacatcagaacattaggaatcagagaagtgagtaactttcccaatggcacacagtaagtaagaggcagagtaagggctgaaactcagttcttttgatgctgaatgcaatgaaactcaggaatttgtgtctgtatttcacatgagggtgaccacgacctggcatagcagagttgtaaagccatttgttcagggtttctgtgaaataatttactgtgaaataagtaaattatttcacagaagagagttactgcgtttcctgataagtacagtgaaagcttgcttttgaaatttcctttggcccaataataagtgcattacaacgttttttagtaaatgttgatttaagtggggagttaaaattaatcacttgaatcttttttgagaacatctattaccttttcaccttgtttttcaatttcttcataataaaacgcatgcaattatgaaaagtttaaagaaaatatgggcgactgaatatgctaatcacatcagccgtaaatacagatacagactctgttgtatcaccaaaatacccttatgcaaaagggcaataattttccaaaaatactcttatgcaaaagggcaacaattttctgaagttttaattagtaaagtacaatagaaggccaacaaactctgacattattttttctggagctaaaaacaaacaaagagacatgttaaactaactttaaaagccacctaagttgccctctccctgaaggcatctgaaattgtggtggtgaggaagagagaatgacatgcggattctttttttcaatatggatttctacttcacaaccaaatagcatgctttaaagctcaaggtttataagaaagctctgtcgttggtttccatagtttttccagccctgatgtgtactgactcctccagggcagcagagttggctccttctcctctctcctgatgcccctcttccttctctctccccctggggattgcctcttttctgggtctttctgactaacactctgtctgtactattctaacacttcagcaaggttcagtattttaaagtcccagtgtttctaggagccctgaaatttttgctccacaaatactttgaaaggtaagccattccttcattaatctgttcaaaaagcacttactgatggataccctcactgtccactcacccactcctaggataagatgcaaactctggtgcagaccagcgagatctgctgcaactgctccccccgccttttcactccacccgggaacctccggcctctccgctcatgtccagtgtcctctcacacttcagcccttctcccatactgcttccctcctcctagcatttccccggttgcttctctccttggcgaatttccatttctgtctccagcgctcatgcaaatgttaccttcctcctgaagtttcatcctagtctctcacaacaccctcattgttcacgtcccttcgtgaaaacaaagctaccatattacattgtatttccttcttgtgtgaaggtctgggggaagactgatgctgtgggctgaattgtgtcccccccaaaaatgatatgctaaagtcctcactctctatacctgtgaatgtgaccttatttggaaatagggtcttcgcagatgtcatcaagttaaaatgaggttataccgggttagggtgggtccaatccagtgactgacgtccttataagaagaaggagatttgaacagagacacagatacagagggagaaggccgtgtgatgatggaggcaaagatttgcgtgactgatacatctacaagctaaggatgtcagactggcggcaacctctagaagcaaggagagaggcacagaaaatcattctctctcagagcctggggaaggaatcaaccctgctgacatccttcagacttgtagcttttttttttttttagatggagtctcattctgtcacccaggctggagtgcagtggcatgatctcggctcactgcaacctccgcctcccgggttcaagtgattcgcatgcctcagcctcccaagtagctgggattacaggtgcccacccgccaccatgcccggctaatttttgtgtttttagtagagacggggtttcaccatgttggccaggctggtcttgaacacctgacctcaagtgatccgcctgcctctgcctcccaaagtgctgggattacaggcatgagccactgcgccaggccagacatgcagcttttagagctacgagcgaatacatttctgctgttctaaaccacccagctgtggtgctttgttatggcagcccaggacactgatatagttggtattaacttctgtatgtgctcatcttcccagttatacccacgaactcctgaaaagcaggggctgtggtgctccatcgttcctctcagacctagcatgatgctaacacaaatagatgctcaactcattttggctgaatgaagaaacatgcttagcatcacccttctggatttagttcagtggatcctgaagagagtcagactcctctccgagtgagaaagcttatgaacaagttggagacataacagtagtttagcatcccaaacaatgaattatagaagacaaagagggtgcagcaaagtgggacagaatgtgtcaaaaacactggagatgggctgggcgcggtggctcacgcctgtaatctcagcactttgggaggccgaggcgggcggatcacgaggtcaggagatcaagaccatcctggccaacatggtgaaatcccgtctctactaaaaataaaaaaattagccgggtgtggtggcgggcgcctgtagtcccagctacttgggaggctgaggcaggagcattgcttgaacccaggaggtggaggctgcagtgagccgagatcacgccactgcactccagcctgggcaacagagcgagactccgtctcaaaaacaaacaaacaaacaaacaaacaaaacaacaacaacaacaaaacattggagatggagtgtaagagaaagtggagtaccaaatgggttggttaagtaggttcgttcagaatattctgtgctgcattttgaaacaagtgatgactaggtcacaagaggagatgtcatctaggttgagggattgagggaatgagagcagctgtgtggggaaggtgagagtaacagagcaagcaagcaagaaggtgaggctggtgtttgaggaggagaatgttataaagggcgctaaatgcaagcatgggatgtaacgtgggaggggggtggtggaagtaggtgcttgtgcagcagcaacaggaccacaaacgtgtcccagggagactaatgggcagctccaggcagggtgggcctgaatgggaagggcatcgagatgggccagagggtggctgaggaaatcctgaggatggaacatcttggggaccaactgggaagtgaggagcacaggaggcaagcggtctcacaagtaaataaaattgtgcaattaaactgtgcagcttggtcagttgtggagtgggaggcagaaagctcccatctgggtggggacctggtgggtgcaatgagtacactgctgggctcagagaaggtggtgtgtttatcatcctggatgaatgcaactctctgtttttggaagcctttgcaagagattccaaaactactctcaataactcatttcagtctttaatatgtctccaggccagaagattcctgctcccatccaaaagagaattctttacttttagagcacattttttccctctctcattctttcctgaactgagatgaagagtaaggaggtgcagtcactatttcctgttgtgaatccttcacacacttgaggcccattcccagtacgttctctgtttctctccaggaaaagtgattttggataacttgtggttttctcatgggccctttaatcatatctatggctcttttctagtctttttttgggtgcatctttggtcatggggcacaaaactgggcacatggagaggcagggaattgtagcaggctaagaggagatgtggagtggacaggcctaggtgtgaatcgtagcttctctagtaactagtgtggtcttgagcaagttgcatcatctctatgagcctcacttttctcatctgtaagatggatcaataatacttacacttggtgagttgtgccacttaaaaataatgtacatgagattcttgaaagctctcaataaatgatggctactattgttggtatgggttggagcaggactgattacattgggaaaaccacctttctaaacactttaataaatgagctcatggttattcatgctttaaaaactatactaggccaggtgtggtcactcacgcctgtaatcccagcactttgggaagcctaggtggttggatcaactgaggtcaggagtttgagaccagcctggccaacatggtgaaacccgctctctactaaaaatacaaaaaaattagctgggcatggtggcgcgcacctgtaatcccagctaatcaggaggctgaggcaggagaattgcttgaaccctgaaggcggccatgtcagtgagccgagatagagccactgactccagcctgggtgacagagagagagactccgtctcaaaaaaacaaaaataaaaacaaaaactatactactgcatagttcagacagcaactcttgctatctctggtggtcaaataaaacacaaactggttcttttgagatacagcaaaactatagacaggacccagaatcgtgttgaaaggataaaatatttttcatttaccctgcacgatagtagagctgcataacatctgaaatagttatttcaattgtgaagggacttgggtaatggtatctttaaaacactcaatgactgaacaaaagcgttgggactttttaattggaaaaggccaataaaactcctacagcagatgaactcactccattcagctcctttctatcaccttcccttcataacctataaatgctactatgttaatgttttaaactagtgtctagagcatgatctcaagtcaataaaattgtgcaattaaaatgctgaaagaaaatatgttatagcgctgagtgtttatttcttggaggaggggatgcaaaatatgattttttttacaatgagcctgaatgacttatataaagaaaaattagtttaaaaatgatatgtatagctttataaaaacacattatcacaaatattttaaggtatatctatcaagttaactgctgtaatgcaccaaaatggcaatattgtgtttctccatgatgggaatatgagtgattggttttttttctcttactttaacttttctgaactttccaaattatttataatgatattgcaatgtgctatataataacactgtctgatgtattatttaattacatgataaatgtattgatattttattgaaaaacgtttaaacaagataaatgatgagaaaaataattccatatatttctacattgatgacttacaccctatttaatattaaatagatgtttatctgcctatattagagaatcaccaaaattcagagtcttaatggcttctgaatcatctaacatggttattatctgatgtaggatctgtctttgtaataagaatattaataacaatcataatagctaccactgatgtgcccgactctgtaatagacactttaaatgcattgttccaatagatcctcgaaataagcctatgaggctagtaggtggaacaatgccctgaagatgtccacgttctgatccccagagcctgtgagtatgttaggttacgtggcaaaggggcgaagggggaattaaggttgcagatagagtttaagttgccagtcaattgaccttgagatggggagaggatcctgaattttctgggtgggttcagtgcaatcagcgttctcataagtggaagagggaggcaggagaaagaatgtcagggggacgccatatgagaaggactcgactggccactgctggcttcaacaatgggagggggccaggagccaaagagtggtgacacctggaaaaggcaaggaaacagcttttcccccagactctccagaaaggaatgtagccctgatggcaccttgattttagcccggtgacacctatttcagacttccaacctccagaactgtaacacagcagtgccgtttttgtcgttgttgttgttgttttttgagacggagtctcgctctgtcgcccaggctggactgcagtggcgcgatctcggctcactgcaagctccgcctcccgggttcacgccattctcctgcctcagcctcccgagtagctgggactacaggcgcccaccaccacgcctggctaattttgttttcgtatttttagtagagatggggtttcaccgtgtcagccaggatagtctcgatctcctgacctcgtgatccgcctgcctcggcctcccaaagtgctgggattacaggcgtgagccaccacgcccagccagtagtgttgttttaagccactaagtttgtggcagttcatgacagcaacaacaggaaactcacataatattatacctcagttttacaggtgagccgactgaggttcagggagagtaacttggtcaaggtcacacatagtggttaatgagaactccaggatttgaatccaggttgtatgataatggaacctttcctactgggcacttgcttccaaaatcattgccagcatgggcttgaacgtaaaataggaaaactcatcaccttctccaatagctcactgcacttgaggatggctctgaccagtagaattaatgtcctatttggggcttaacccagtcttgcattccagtcaccttttcattgattaattgtgcaaaataacacaattcctgctttatacgaaaagccttttaaatatttgaggccaatgatcacttctctctaaggcttctcttctttgggtgaaacaattccagattcagccttttgctcgaagacatctaaagttccagcaccttctcaacctctcccttctggaaagcatccagactgtcaacactcacgttaggatccagccagttcctaccttactttgaatttgtgtgctttgattttcttccataaggttatcgtgctaacctcaactcttgtgaactgattacacattacatcttgagttctttgatggaaatatttctagaaatcaatcagtcagtaaatactgataactttgggattatctggcctatagtcttgaaaacatagcgtgctttcaagttccttctgatatgatcacaaaccgattctactctttgttgacatgaataagacctttcctgttctagcctagcaggggctacaagaaaaagcccattaagctacagaaagaaacggttctggccagtgggtaaccttgtagggaggcttgagacgccacaggctgctgctgtgtaacagtctgagaggttgtgctgtctgttcccacgcggactagggacccaggaggaaaatgaaaggattgttaagagtcagtgtgatttcatcatattatttaaaatactacgaatgttagggcagggagaactgcatacaaatattaataacagactcccaaaatctttgatcatccaccactgtagatgatccacgtggttgctcccttttttctgcgaataatcaagagttaactataaacaatccaacaacaacaacaaaaaaccctggacttctgcatttgtgtaacgttgagcacctgatgaaaaaaacatgaacccatatttcattcattttactctctgcatctctcccaaagagaggtggggagggtgggggacaaaacatttttgtggcttagtatataaacattcaagtaattaagtcagttgctctgtcagaattgacttgaaaatcaaaggttcttgagcacaaaacataaggtttgtatttctttataaatacctacaggaataagaaaaaacacagaaaatcccacaattaatttcatttggggcttttctgaatcccagatatttaagaaaaatagtttgctatattgagggaagcaggtgcagacagtctggacctctggctacctacagcaggtctcttttgaggtgccaaatattagatgaagagaggcaaagcctaattcagggcacagaatgaagactttgatggcaaggatttttaactttgctatatttgctgctgttgaacctttatgccttgagaaagtcacacatctgggttgtaatagtgggctacctcacagggcgccaggaaagaataacttagaagggtttcatttttagatataagaagaaaatcttatgtaaatcatgatatattttatgcttgtgacggcagagcatactgcaggtattcaagagaggaagcccttcctttcattttcagaactgtgtgacttgagctttgtcggtttctattttgttccccacagaacatctctgtctttatctgaggtcagggttggggagaggtacgtggtgggtgaggggaaagaagtatccgtgagggagggttagtcacatccccagcatctgaccacagggccacttgcctacctgccatgcagtccatgacccctgctagtaagccagaagcacccagggagcacatggaatctgtcctgccactctcctttactcactcctgccctgttcctcctgaggccatttcacctggggtctatgaccccctcccttgatcctgctagcctggatttggcactggacttcgaatctctagtgtccagatccccaacctctgcctcttggacttccatggagccagtgaaggggatttcctctagagcttctgtcctgtagaatccaaaccaaccaaagtggtgccatattcccacccccaggagaaggatttgggcagattcaatgcatcactgctggggtctcctccaacttttagttgtcctccaacttttcaggttaaaggccatgtcaatggagcattgattctgtgataactgaatccaatttgtcactccattaaaaacaacccttttattgtcaatactttatcgtcaatttaaggcaatgcttgttattcaatgatattcaacaacaaatgtttattgcgaacctcctgtgtactatgaacttaggtattatgtcactaaatacttatagcaacattgcaagattttcaaaagaggcagcaaaggattaagaagattaacttgcccaaggtcacatagctaataagcggcaaagccaagttttgatgccaacttactctataccctgctgccttcttctataaatagttactaagtgcttagttatttacaaggtatatttccaacctcttaaaaactcaagctacattagggcttctggggagcccctcatcagtgactccatgggacctgctccaagaaagctaatatttcagaacctgttaattagtcaagggcttttgagaaaggtggtcagcttctagtaggaatgaagcactgcttcggtccctctgaagggcctaacaggaaataacttgcttcagcctcaactgctgagagacgcggtcaagtggatacactcaacaggtttagaataacacattccgcaagtactctgagtttctaaccaacaatgaaaacattccacagttagacttctctttctagacactcactgacagtgacattagaattaggtggcttttatgtatagatttcatatgcaaaacccttcatggagacttaatctggaaacttcatggtgggctggtttttggctatctggaagactttgacgggattcttggctcctctgctagtactgattgctgcctgtttgtgggactgagagtccctctccttctccctaagttgaaaccctctttcctccattcttttgactttattgcaaacaccctactctgtgactactggcaaaagtgtcttctttttattaattcctctgtccttgccagggccacctcataggtgtgagatgtggactccagggccccacacttaagagggctcagtgcttagtttaatgctttgctgtcccatttttgaggaaggggcctcacatttttaattttgcactgggtcacacagatcatacagccagtcctgctccttgctgtggacgtggaaacagggagaatgctcacaccatacaaggtatgactggatggtgtacctgttctcctcccctttggaactcagcaggcattttcccacagagacaatccataaaggcagatgatgccaatgacagctccatcctccttagcctcagttccttcatttctaaaatggggacagtagcacttacccttgcatgttattgtgagcaatgagtgggatgatgtataaagtacttatcagagtgtctggtatacatcagtgcttgctcaatgaaatctatgtgagacagcagttgcggcaaacagagcttggactctggagtgaagagctaggtcagaaattaaattagccccactgcctaaaaaatacatgacttttgttagttgacttggtttcttccagtgtcagttcctttatctgtaaatgggaatgctaatatttatcttgaaaggttgttttgtgatttaaataatttaatgtatttaaagaccctagttcaccacttggcatctaggaggagctaaaaaaatgaaaacagttcttagtcaggttcccctttaacactattgctacacctaaaacaaccaatttggccaggagtggtggctcacacctgtaatcccagcactttcggaggccatggcaggcaaatcacttgaggtcaggagttcaagaccaggcttgctgacatggtgaaaccccatctctactaaaaataggaagaaaagttagccaggcgtggtggtgtgtgcctttaatcccacctactcaggaggctgtgtaggaaaatcacctgaacctgagaggcaaaggttgcagtgagccaagatcacaccactgcactccaggccaggtgacagaatgactctttctaaaaaaaaaaaaaaaaaaaaaaagaccaaaaacatcccccaaaaagaaaacaatccatttgcaaatgatgtttgggatatgaccattaataagttcttacatattatacgacttcctgtatactatatcacctatgaaatgtaaccaccttgtatgttaaaataattttgtaaagaatacttgagcactatttttccttttcttttgctagacgacgatttccttgaaggcaggggccacatcttatgtgccctttattccagatcactttcaaacactttagaatctcagttgaatcaaatttctcttttgttctttatgccaacagtgagacgataatctccctaacattcctcaattagcaattaatgattagcctattgataactaggaggtagacagggccaaaaataaccccatctctgccgttaaaggccttttcttttttgcccatcatacatggctcgtattcctgcctcctcggttctggttcttgctccattaatgaaactattccatcagagaacataacttggttttctggaacccactatcttccctggcaacaacccatctagagaggccatggaggaagaatttcctgaaaccccaacatttgagtcataatttgatgcctcttaggattcaaagaggcctcagacctgtgacttttaaacattttgggagtataggttcctttaagaatcttctgatagttatggacattctctgcagaaaaatacattcagtaccttagtacaatttcaaggtgttctcaaaacccctgaagcccttggatcccaggttaagaattcttgttagaatagccaagaaaagggaatcagcaacgtgaatgattccggtttcctggtaagtgttccggacctgactagtcactctcccttgctgaaaacaaaacaaaacagaacaaaacacagcaatgacaactcccaagatttaacctcaagattatccctgagagtccaaacctgggcagtaatggtaaaggcttccggccaagcagtaactactctttggagaacctcagttcagctgagtaaaataggccttgtttgataatgccgtttacatttccaaatcctgggtatcaagctttcttcctatgccttgcggcctttcctaagtttagccgctggtgtaatggggtaaccatggcaacaaccacctgcctatttaaaaccatctccaatgctaaataaggaagcctgaagaaaatggctgcttgcctgcctctcagtggacaaattgggcactcctgggtattttagacatgggcgaataggcagggtagaagcagtatgtatgcaaagttcttcataggaagcgttcggtgaccttgtgaaataggtgctacctcagcccttctgtcttcgtttgttaggcgagcacgcaggtttacgtgcaaatccgtgggcctgtcaccatgtcatccatgctaccttgacctcagtcaggtgaagagtgagctgagaacctaccctcagagagaagtattgtttataggatctcggaagggagaaggaaaaacagttctacagatcacagtgaatttgttcatactttgcattaaaatgcacgctacaatctttttttttttttttttctgacggatgtgtctttctaattgtacttaatcatgtgggtgatggatgattgctctatttatgtcatatgttggcctgcctattgatttttggcatatggagaaatttctccctccctctgcttccttgctttctgggaattacagatgtttggtttctttcctctgccgagaccatacaactgatcacactgaacatcttgctcttccacaagtatactgcaccctctcactccttcgtatcttttcgtacatttgcttccttctccctgtgttgccctcctctttttccgtgtcttggttcaggcgtctctgtcattggaaaaccctccatgccacgtttcgtgtccttggtttttgctcccataggtcacctccagttacatcacttaacacaaaccattctgcacatctgctttccagcctgtttccagcaccaggctgtgagtcccctacatgcgtctgtccaaaatgcctgtagaacagtgtctggtgtgcattacgttttcaaaagatctgctgaatgaatggatgaatgaatgaacagagccccgtggctttcacaagcatatggcacatgtgcatgagtacgtataaggatacttgtgtgaggccgggtgcagtggctcaagtctgtaatcccagcactttgggagcctgaggtgggtggctcacttgaggtcaggagttcgagaccagcctggccaacatggtgaaacactgtctctactaaaaatacaaaaatcagctgggtgtggtagtgggtgcctgtaatcccagctacttgggaggctgagacggaagaattgtttgaacccaggaggtggaagttgcagtgagccaagatcgcgccactgcactccaggctgagcaacagagcgaaactccatgaaaaaaaaaaaaaaaagatacttgtgtgaaaagaggaccttaaaagcctgaggaatgggttgaagaggagtactttttaaaaaagtggtttgtgtgtatctgggagtgcaaaagaccgttagaggagatcatctgaactgtaagtttgtgactatagtatcaggggctggaagtacacgtgttcctagtgtgcagtgagtgtgtatagtctgtgtgtgtgagagcaagaagatgctgtggcaggatgcacttcctaaaaggttcgttcagctgctatcggatcccacagatcgctctttctgaagctatagtgttcagtttctgacctctaaaaagacctccttcttcttggttgacttctcaggctgtggggtcaggacaaagagtaggaatgaaaatggccagtgatgaaaatgatgggtcctgggctttaaatgaatgtcttcaatgaacactctaacctctcttttaaggacaattcttgcttgtaatcccagcactttgggaggccgaggaggacgggtcacttgaggtcaggagtttgagaccagcctggtgaacatagtgaaaccccatctctactaaaaatacaaaagttagccaggcatgatggtgcacgcctgtagtcccagctactcaggaggctgaggcaggagaatcgcttgaacctgggaggaggaggttgcagtgagacaagatcacgccactgcactctggcctgggtgacagagtgagattccatctcaaaaataaataaataaataaataaataaaaagacaattctgtgggctaaataaaagtcaacacctttaggctcaaaaacaaagtccaaatcattatccattcttctcccaacctacctagggttggggtgggaacagtgtctgaaatagtggtcatcttgaaatagtacaacaaagaaaaagaaagaaagaatgaaaattgactaatgagaagatacagacaaagaaggaaagagggagaaaggggtagctatacgtcagtcacaactaagttctggcaaatttcatcctacaaggaagaagggtttgctttctcttgcaaatgatctggtttcctctttcctttcatttttgaacctaacttggtgacttcacagagtgcccaggctgaggctgggacttagtgggttccgggtctccagcctttgcaggtacctctctgctgctgccctctgctgtcgggggaggcaaaggagacacccttctggtcctcctggtccaagtcccggagctgccacctcctcccatttgagaccgacagaagctagggtctcttccagcctccctgctcttccccaaaagaatcatgaggggctggggttggaggcgctgtacttggaagcagcagagactcaggacgggggttccagttagacaagggcagacgccctcccacctcctcccctgcaaaagcaggcccttcatacccacctcctgccctccagccctgccctctgcacagatcctttgggagaggacaggcagttagcctgcgccaagtttctgacacttttttttttcttggaaatggaaaccctccttccggcaagtggcaggaaggccaagtccccagcggccctggctgggaaaatttccagagagcaggtgaaaggcctctgttccgccagggccacactgggtgggtggcagcgcagccgggcctgcagcttacctgctgttgaatttttcaggatgtttctctctcatcacatggaatctgtgtgcaatggaagcgtcctgaaagtgaaagagacaaagcagatccttggtgagtggtcatgacagtgcagtgcggagggaagggacgcacgcatgcactcgctgagtcatgccaaccctgggactctatctatcgcatggtggggctccaggtcacatccgcggagccaacagaggctcaacactgcctccagggggatgagctagcaccaccaatactcttacagcctatgccagttgactctggagtccttgctatttcactctagcccggacccgctgagaacagatagatagttcaggggtgagtgaaggggaaagcctttgccctctggggagactgagagtctgtgagcagttagagatcaggagcctgtgtctggggctgagcatgagtctctggaaatgactttccatactagttctttttaaaatagtttttattttggaatattttgactcacaattaagttgcaaaaatagcatagagttcctaggtcccgttcactcagcttcccccaatgataacattttatataactataggatattgtcaaaaccagaaacctgacattggtagatgctattagatattaagtcttaaccatccacaccaatagaaataattagtggcactggataacatgcttactagataataaaacaaaattaaactctggcttctgcttcttgatcacttcactcgaaggactccctccaaggccaataagagtcattattacatcatgtggacactgccctcctattagcacatccctttgccacactagcggccccctgcactccagcactcacagttaggatggctgtcatgcactgtgctcctgggctctccatcctctgaccacaactccctaaccctgggttctacctgcggcccccactccacaccgtggccatctcgtgagttctcgtggctgttaccagcatctgaatgatgatagctccaaagtgtcaatctctagagccaaccctaagcctcaaacctgaaacggaacttgtctttcctcctcaaactcggtcttccaccctcgacaatggtctcattttccagcagaagaatgtgtaacgccccttcaccgctcaggccccatactggtactttgggtgcaggtgctgggcttcagaaataaacaggctaattgagccggagatggggggtgacacagaaaccagggagttgactagatttgttttgcaatgaaaaatatacaaacccatttactggaatacatggctacaaaacacttgaaattccatgcagtgaattttgaattttcatcaaatgcatattaattctatttcttatatgaaaatttctgtgttttttttttttttttttgagatggagttttgctcttgtcgcccaggctggagtgcagtggcatgatctcgtctcactgcaacctctgcctcccaggttcaggcaattcttctggctcagcctcctgagtagctgggattgcaggtgcctaccatcacaccgggctaatttttgtatttttagtagagacgggtcttcgccatgttggccaggctggtctcgaacctcaggtgatctgcccgcctcggcctcccaaagtactgggactgtaaatgtgagccactgcacctggcctctgtgtgtgtttttaagcatcaagaggtatagttctatgaagaagctttttgagcatgaactctgtgtggtgaggtgcacctggcataggagtccagcagcccacatctgaaaggtggcagggcaagaggagaagatgggcttattttgtgattggcaaacattctttgctaaaatgatgttttgagagtttaaaatttaaactttagctattgatgtttttttttttttttgagatagagtctcactctgtcacccaagctggagtgcagtggcacaatcttgtctcactgcaaccttcacctcccaggttccagagattcttccgcttcagcctcatgagtagctgggattacaggcatccgccaccatgtcgggctaattttttgtatttttagtagagacagtgtttcaccatgttggccaggctggtctcaaaactcctggcctcaggtgatctgcccaacttggcctcccaaagtgctgagattacaggcatgagccaccaggcctggccaatttattttttagcttaagatatattaagagtttaaggtcttggagaggcacccccatgggtgcacgggtgagatgtgcggaccccagagaggcctctgtccctgaggcctatccagcctgcaccgcttccctgggcagcagcacttcatgctcccagactgtacccacctcccactctctgagcaaatttcagtgaacaccctcaataagattcatgtgacatttgtcaaatgcttctctaaaattcgagaaaatattccatctacttctattcctttgaagcactaattttcgtctgtcaggaaaaaaaaagtggaggggggcggggaagaaaaaagcaatcacatgttgcctggcacaatttgtacttcgctatcccctacccccaatactgctgattgactcccagcttttttattctccgggatatgtgtacaggccccctccttccatgcagttctgattgtctttggtttttccataactaggttttgcaaagatgctttttacaaagaccagcctttaaaacattattagtgaagcacgtggtccctaatttgacaatgtaatcccttggcaaatacacaaagtagcaagggagagtagagcagctccttttctaagtcttaaaaaggcaatgagggtgaagactctgaccacgtttctctatctggggattaaaaagagagtcgagattcactttcactctctggagcttctatgtcaggcaatgacctgagcatatttacaatcagtagtgacttcatttaaatttgggaaaccagggctacgatggttcaaaccctttcttggttattaaggcgtaaaccctttcttgatgataattaaggcaaagcgagacttctgttctgaaggcaggagatgggaattacaaatccatggaagtgatgatagcatttctcacagccttactctctgaggtcttttctttcaggtgtggggtgaagaggagatggtggaaggtatggacatagagcctctttcctgaactacaactccaagcacatgggtggacaaagaaatttgggccccttccaagtacatgcatcagtcatttggactctgagatattggagtatctaggccagtgctatccaatagaaatacagagtaagctacacatgtaaatgtaacttaccattttctagtagccacataaaaaagtaaaaacaaaaaacaaacaaacaaaaaaacaacaacaacaaaaaaaaacagatgaagttaatatttaaaacaatttttaaatttttttatttttttgagatggagtctcactccgttgcccagcctggagtgcagtgccatgatctcagctcactgcaagctctgcctcctgggttcaagtgattctcctgcctcagcctcccaagtagctgggattactggcacctgccaccacgtctggctaatttttgtacttttagtagagacggggtttcaccacattggccaggctggtctcaaactcctgacctcaggtgatccacccacctcagcctcccaaagtgttgggattacaggtgtgagcccccacgcctggcctgaaattaattttaataatatattttcattaacccaataagccttgaatattatcatcacatggaatagaataattattgagacattaattttttatatcacatttttgaaaagtattgtatattttatacttacagctcactcaacatcttaattaagacaagccccatttcaagcatgtcataccacatgtggctgatggctattacattggataacacaggtctaagtcactttggcaatttacggagataaaaagatggaaaggagaccataagacagattatttgaaattggggttgttctgaaaattatgggagattggggaatggaaaagggtatagacccttgtccacgtccctctggggagtcccactgtattagtatcttcatggctctcacaggtgacaaataacctggtgccagcagaatccaagaatctgcaggaaaaattatgtcttgttgagaaattccctatgtgtaggacgcttatcatggtgggaagcttgtctggtgatagctaggaacgatctgcaaggtggaaaacggtgcgtgggtcagtgcaaccactgtggcctctccttggcccttgggctcccctagcatcagaaatagatttcactgaatcaagggattagctgttcacccgtcctgttaaggctcatgaaagcagagcttgtgaggagttcagagttacacataccttgggaattattttgtagtcccaaacttcctgtcactgatacctggccatcctgacattttctgctaatctaaaaataaagaacagggaggagcaggccagagaagtcagaggaagtggcatcctgaatgactgtgtttaaaatctcctgccagtagatattatcagttagaaggactgataaggccaacgatcttagcttctcactggtgagaaactgatgtgtggatggggctgtcgtagcaatgagggcacagtcactccctggagaggccaggagaccctgccttatttattccctcagctattaaatgggttctgttggcatcaaggggtctcagtaaactcatcagagaaaattctacccacagcacccaagggcactgtctcagaggtcattgtcatcatctttataaatacaaagcaacagatgtttgctatcataagatattctaggtccttcaaaagaggcaaagaccttggcagggctctctttgccagtggagtccgcctctatttgatcatcataaggaagtaaaacttcctcggtttacatacctacttctcttacaaagtttgggaagtcaaatagggagcaagaccttctgcaaatgtcagccccagactctgttagggttgcgtgttggttacttgttttctcaagaatttctcttttcaacttttaaagagcgagcatacaaaccctgcaaacattttattgagagaaagccaagggcacaccaatgagatgagaacagccctggtttctcattcttctgcaacataatattaaacatggataagctaaaggtgtatgaaaaaaattacaagaaagatattgtgaagttgttcataattggaaagatgaatagattggattattataagtcagcccaaggtaggtaaattatcttgaccactgagagtgatggagaatctgtttatatgtgtttccttggggacaattaattagccagccagcaggacttccttccttccttctttccttccttcctcccttccttccttccttcctccctcccttccttccttttttcctactttttttgctagaataaattaaaactatgattactgaatagtcttggctcttgggtttagggcctggctatttagttgagggaaggctgtccattcctctttgtgtgttcatccatttggtcagcagatactaaggagggccatcttatacagggcactgtgttgagacagggaggtgtggggaaccatgtttttgtcagccagagctgggtgtgttagaaagggaagaggtggggctgaagcttctgcaggcagctgcgctgtaacctgctgtctagaagttcccaggcagctctgccagtcttgctcctcagctctggcttccagcccgttgcttagagggctagttctcccctccttccttgcttccctctccatttatttcagttccggcttccatgccagcgaagagccacttcctttgaccattcttctctgctctagtaggttgtcttcactccctgagaacttggtcaggaccatctgcatcagaatgatctcagggtcttgttaaaaatgccagttcccagaccttacccagacctactgagttggaatatgaatcagcatctgttgtgggggtggaatttacatttctgataagaggtggtggtgagccaccacaactaaattttgagattcccctctttcaaaccatgttacatttggcaacatgaagacggagggggcttcaaggaggcacaaagctcagtggtccacagctcagttggctctagagttcaaatattatgattccaagctctgccactcaccagcctgaacttgtttctgtacctctctaagctatggttccttcttacaaaacacaaatggataatgcctgcctccactggcagggaaactatgtctggtgtgcagtaggtactcaataaatgttagcaagttatgttctggttactataggaaaaagacatatgagttttttttaactgtaatgatgggaagcccacgctccagaaccccggacctgtcagtcatgtctaatttgcaggagctgaaggctgcacatgttcctgctgggggaagcggagcctgaacagccggtccaaaaaggagaggggcctttgagcacgaagaggagggagggcatctgcgtgggtcactggagggggcacctggaagaggtctagggaaacattcccctcagctgaggccggggatccagtgggatgaatcagattgggacataggaacccctaaacttgctcccagtctaccacctccaccctctcagaacccgatcatgggcccagcaatgcttccctcttctgctttagtaatagaaaaagagcaccggattaggagtcagagaataaaggcaaatcccttaatctgagtctctgttttcttattcataaaatagagataataatgcccttcagaatatatctgtgaatttggtaaattttaaatccttctgtaaatataaggtattattatttttagtcctttcttctcccatggttctctatttagccttcttattaaaaaaataaaacctaggctgggcatggtggctcacgccggtaatcccagcactttgggaggctgaggcaggtggatcgtttgaggtcaggagtttgagaccagcctggccaatgtggtgaaactccatctctactaaaaatacaaaaattagctggatgtggtattgcacgcttgtaaccccaacttctgaggcaggagaatcgcttgaacctgggaagcggaggtttcagtgagctgagataatgccattgcactccagcctaagtgacagagtgagactcgtctcaaaaacaaaacaaaacaaaacaaaacaacaccctttacttaaacttgctatcccctcaagccacctatcatttctccttctctttcctttaaaaaaaattaaaataccaaaatttcaaaagaaacacagctgaggatggttgaggagtgcaggtatcacagagtctggggcagaggattcgtctggagggtttcatatgcatgtgaaactgggcagcacaactccaaagacaagggaacagagaggagagaacctggctccagaacaaggcaccaccatgcgagtcaagggtctcgaagcctcatctgtagagtgagatgagcaggataatgatacctgcaggactactgtgagggctggaatatgtacagtctagcactgtggagagcacacaggtactcaataaatgctagtggctgttctcacttacaagtgggagctgaacgatgagaacacatggacacgagggggaaaccaacacacactggggcctgtggggatgttgggggagggagagcatcaggaagaaacagctaatggatgccgggcttagtacctaggtgaagggatgatgtgtgcagcaactcaccatggcacacacttacccacataacagacctgcacatcctgcacatgtacccctgaacttaaaataaaagtttagggaaaaaatttgataaatatttgttgaaaaaaagaacaaatagttcaataattctgtcattcttttttttttgagacagagtctcgctctgttgtccaggttggagtgcaatggcgtgatctcggctcattgcaacctcttcctcccaggttcaagcaattctcctgcctcagcctcccgagtagctgggattacaggcacccaccaccacgctcggctaatttttatatttttagtagagatggggtttcaccatgttggccaggctggtctcgaactcctggcctcaggcaatctgcccgcctcagcctcccaaagtgctgggattgcaggcgtgagctaccgtgcctgaccaattctgtcattcttaaaaaaagtaaatactagtgtctttgttgcactcccaccccctcccaacccccagcttcatttatagaaatgattgatctgtcccctcctgttccgatcctgttcacagcagcctgggaagcagtgcccactccaatcctctttggaccagaagctgagctacactagatgtgctggggctagtgggtgaaaaaggaacagagtgctgtccttgcactgagggagtgtgtgtgtgtgcatggcagtggggggcaccagataagcacattaaaccaattccttcaacctaatgcagagtgtgcatgaatggggtgagcataagggctgtgggagcatcaaggaggctcacagcattcagcctaaggggtcagctgggaggagactcccctagaggtttatgatgcccatggagtgagtggaatggggttgagagaagagagaataggagagaaggaaatctgagggctaagccagccagggcaacttgggaccacatggtcttcctttgaagatcagaattcccagttcctgaagctcatgtgagagtttcctaccaaccttgtcccccggttatttcttggtgttgcttttctacgactgctacaaattgcagaaggagaaaatatgtcttttgaaaatttttctgtcttttcctgtgttagttaaaatgacagaggagagaatttactccctaagcaagagatggggaataaagcgggggtgcaatcagggtgtccacactcaggccaagtttcagaatgcttggacccaactcagggctgggggggcaggtaagacaggtagacactagggacccagaggggacaacagaaggctggaacccttcctgggcgtttcccttccatacagaaaggtgatctttgaccaactcaccacaccaatggagaaatagttgttcatgatgctgtatgggacctggtccccgttttccacttcctctctggggatgacttccagatgccagcggtccagcatcaccaaggggctctgctcaatgtctttcaggatttttgtcaagctgcccccttcataacctgtggaggacagcactgcatttgccaccacagcagaaaggctgtattcttgctaatgcacaggtagttgtcagggcaggtaagcccagggcatctgtgactatgggactccccactgtgtctgtgggctagagacacttacgttccccgagccacagagaagggcaggataactgaaagtaatcagaggctgggggcaggggagggagtgggtgctagctaaaggtcacaggcctgtgtagctgaagcgaagcaaaccctggagaagcggtgggctggatggctgggagtctctgcatgggagaacagcagatccttctgggctgtgtcatgtgggagatggacagtgtggcaggcagaattttaagatggccgctaggcctaggtcctgcttgctttgacactgcccaccaagcatagctgatcattgaacactgaccattgcactgcctggtcttgactcattctctgaattagcagccatctggagtccccaccccttttctggccggcagcctgatctgtctgctccatgtgttgagctgaacttctccattttctggcgcatgtccaacgccatgggggctactgcagtttgcaaagttctctgccccttgtcttatacactggttaccactctgtgtttcctcttagggaaatttcaaaatgagggcccatggctatggggcttaggatgatctgaatgcttctagtgacggtaagtaactggagatgtagcattttggtcctcagttttagtcctaattcagaagatcagccatttgtgggagagggaatttcacacagaaaacatctaagtgagcaccttcttggatgggactctggggatgggacatatgagactttgtctttaccctacagttgattgctttctactggggaaagcaggctctaagttgatggtttcaggatgatagtaaactcggggctgagggagaaaaagctcccagagcccagaagaggggcttctattctagattcagcatgggatggagggcagagaaagggtcatggacttgacatgactgcagagttgagtattatgctgcggaatgtgatccataaaagggtaagttcagcctagctctgtagagcatctctgtaaacaggaacacctgttcccagggtaccaccattagcatgcaaactcacctcctccccagcggagacaacgggcaaggtcatttcctgttccaagaggcaggacagccactggtggatgctttgcaaagttggccttatctgcaagacacacagaggaacagagaaccatatgccatgggactgtagaatgtttgagttgtctttttatccctgatctgatgcttgaacccctccatagcattctttgtttgaataccaccctgatgggaaacacactacttcctaaagccatctatcccatctgcagcgtgttaaccaccactaattgagttaaatctgtccatttgtattttatattgagctaaatctgtatccctgcaacttgcatatgtttattcaaatttcatcctaaatctgtcctttggggtggcagcatacaccccaaaacattaagttgcatgtttttaatccttaatgataatcagcacttactccatttattcctcagcctaactttgtaagggattatcctccttcaagtagctgaagaaactgagattgacagagggaaagtagtctacaaccattctaccctgaacacgctcaatctcatctgactgcagcagctaggcctggtcaatacttgaatggcagacagggaaagtaattccagagccaggattcaaacccagatctctatggctccaagtccattcccctcctctcttcaggggccaggcaggtatacagattagtaaaacaggtggggctaggacactagggaatagtgggacattggacaagctgaagatgctcaccttcaactgttcaccactcgagtttaaaagtttaaaaactaacattagctaaatgaacaaaacctccaggtgttatttggcccccacaaccagtttgtcacttccaccacctctcagaattgcaatgacacagattcctaattattcctcttctgacagttgtgaaggacatcagacagaaccatcagagaaagcacaatagaacatgttttcatctggcctcagatctaccgtggcatattgtctaggctgggagagctgaagagggcacaggcatccatcagtcttgggggtgggtgggtatttccatgagacctcagcacgcatggtgcccctggatgtgagcaatgtgattgcggcgtgaggagagatgcaggaatcagcagggaaggctcaagctagggttgtcctggcaaactgggagctcataggtcctccaggttgtctgacctatatcagaaatggctgagcgcaggcaagacccaggactgagatggccactggaaggcttgagatagagagcaaaacaatgcaatggcccctctcgttgtcctcagaacatgtgttcagagcactgcctccctgcctttgcacagcctgctccctttgcctagaaggctcttgtttcctgtgtctgccccttcttctgtgtccccacctcggcaggtcaactgttgttatggtgtttaggctagaaagctgtatgccgccctaggtttttccttttccctcacacatccattcacatatcacattctatgtgttgtctccttactagatctccaagcaatctcttctctctatccccatggtgatgcctgagtgcaggtatgattccttcccactggtatcgctgcaacagcctcctctcggctctctccgcctccagttccaccctcctagtgtgtcacccacactttcaccaagaagggaagtccatgaaccacagtccctcgcactggctcactgctttcacttctgggatggggctgtgtggctcctcatggccccatagcctaccacagtaggcccaggaagcaggctctgcctttctccctagcctcatccttctgcacatcctgcctcccacgcaacatgtcaaccgttctcaagtgttttcacttccttaaagcacaaagctctctgtggctcagctcagaagctgcctttgggagaccctccctagttgccccagcctggacctggtgcctcgtcagaatatttccttagcaccagaaatgatctctttgtactctcttgtaattatctccttgtttgttccctgaatgtattgtaacctccccgagggggactgggtctcattctcacagcatcttcatacatatcgactgaagcctgctatatgcagatgcagtgttaggtgctccggctctgagagtgggcaaaaaagccgtggcttgggttctcatggtgcttaccgactgtccagtgggacagacagataataatgaggaatccatggagataatgcatcatttcacattcacgttggaaaacaaacagaggagcactgtcgtataagaaggtgactgaggctggtgggtgtgtcaggggaggctcccctgagtaagccacatgtcagctgagatctggagtggaagctgactgagtgaaggctggggcagcactgcagacagggtggccaacttgtgtgaaggccctgaggtgcaagggagactggaacgcccaggggtctgagagatgggccgggacctgagtccagatggagagggatggaggtagaaataaggctggaagggtgcgcagcagctggaccacccagggccctgtagattacttcaagggttttgtctttatcccaagaataatggaagccactggtgtgctttatgcacaccatgcacccagtgacatgcaggaaagatcgctatgggtgtagggagagaacagatcagagaggggaccatgggggggcgctgcagagcactgaacaagtgctgaaatgagagtgaacggatgaatatcttacgcagttatcccttttgcttctgcttttttctctttgggtcactaacctgtgaaaaaaactaatgtttcttcctccttctgtgatcttccttctttctgttttgagcagcttctatcacctgtgtcctctgcggatgaactgcataaagctctccgccaaagcctacttctccctcatggtggagagggagccgtgtgagtagtccggtaccgcagccatccaccctctgcagatcagcttttccttccttggctcccggaggactcctccctcctcccacaaacaactccagagcccaaggtgacaggagagcgtgggtggctgcttggcagggctgtgtccatggcaaccaaagcgcccgggggagtggcgggcggcaggtgtacggtcctgcagccttctcgcccagctaggtggtctacttacagcccccggaggcacggctttctctgccctggtcacggtctagtcctggcttgtccttgacttccctcgtcctctcatctcccacatacagtctgtcagcaaatcgtattgccttcaccttctaaagatatccagaagctggccacttctcaccaccactctgtttctcctgtggtccaagccctggacatctctcacttggactgctgcagtggcctccgaactgatctccccgcttctgccctcttctcttaatctgtcatgttcctcctttgctcaaaaccatccaatgtcatgggaccctcccagtataaaagccatattccatagaatgccctatatgtcctagtcacctggcccctcgtcacctctgcttcatccgctgtagcttttctcgaatccactctgctttgaccatgctggcctgcctccagcagcctggcctgctcccactgcagggccttcgtctttgctgttccttctgcctggactgcccttcctcaggtatccacttgactcacccctcctccagatctccatgccaatgttgtcttctctgtcaggtgttagattgcagccttgagctccctgtgccccttccctgctgtactttaaacacttcctgacatactatgtctcacttatttaattgttcattgcctgtctctttcctctacatggtgtgctccatgaaagtggaatttttgtccgttcattccctgctgtatctccagtgccttggggagagcttgacacatcatggagcacaggcagcatttttgggatgaagaatggaaagcccagggctcatcgctcagggcccagtctctgactttgatgactgtcctccccagtgctcccccggccgctttcttgtccttatattacactttgcagtgtttgtctgggttctgtagggttagatcttgactctgcttccatcccagaatttcagtcagtttccatcacttactggggctgatgtgtccgaggacccacagatccaggtagagctgggtagaactcaggctaccagccttctggcctgggcctttttatctagatgtactctactggacacagctcagtgtggtccttctttgcttgcactgatctgtactttctagatgcactttctggactcaggctccgggtgttcatctcaaggtgatttgtcccaggctatgatctatgcttagttctctggcctttaccaaccccaaagggtctgcccagaattccactcctgtcctcccaccccccaaatctggcctgtcctgccactgcccaaaccccagccatgacagatctgctttacaggaaaggcctgaaactaaactgttacctccgtattggagggaatcattcgattgtcttatttcttttttttttttttttccacccaaagcaaatatttagtcaagtgttggtccaggggaagatacaaggatgaacagacatggctccatgtctctttcttttttattgccttctgctgattgtaaatacgcttactataaataagcagcaaacgccctctcagcccatgcttaccaatgcaatccaaaatccagccaactgtcccatctccaccacaggccaaaacacggaagtctggagtatcacggaaaaagttcaacctgggaagaagaagaaaggccaaaatgggcttgttactaggttgcagctgacattgatacatgttgagtcagagtctgccctgttccccaggagtatgttaagacctcgattccttttgtggttgaaagggtcactcaatgttctgaaaccagaagttactatgcagtgccttgaatatggagccaaggccaagggggccatccttgtgcaaggataatctgactcaacattcgacacaaatggaaaatggttttctagaaattctgtactagttacgcagaggagtccagagttttggcgtcaatacaaatagcccccagtgttttcactcctctcgggctctcctgcctgctctgtcctgacacccgccctggtaagcaagatgcaccgaatttgctggatcttctcttcactctcctgtgggccacagtgagtggagtgatgcccttctcttctcaggagccttaaccctggagagcagggtgcttatacctggggtccaccaacctccaagggttctatggattggattcagagggccattaacttggaggagaaaataatacattcttattttccctaagctcaaactgaaattagtagtatttccttcaattcagcatgtaggcaacagaccacagaggttggaaccatacccatgactttgtcagcggtcaaaatcacagccatgttagtgtttcattatggttgtgacagatgcctcataccactgccatgctcatcactgcttggaatttacggtagttattagacccacttctgggtcttcctatttgacgtattggtgaagctcatatattctcatatcactaatttgttttactgttttaataactgttttttgatatggtttccctggtcaccttttattattaaatttatgcattaagaaatattccaagagggggtttctatgcttcaccagactgccaagggggttcctggcacaaaaaagttaagaacctctgctttagaatgaatgtgccctgcggacaccttgggggtggaacttgggaagcctaaggtcaatatttccaatctgcccagcctggtggtctgagaagagccctggagctttcagaatcactgatgcatgtgtaggcaaattaacattccttctcttgcagaactctgctctccgacgggactctccgacgggaagtgaattctgaacagacgctccctccagctaggcagcttgtctgattagagagtgacatgcgcatgagagaccctcagggcgtatcagcccgggaagtagccacctggctcgtcgtctcagatgaaaacaatttagaatacacgaggtgaagctggaggactgtctgccagttttgacagtgggctggtaaaggtgtctgtggggggctgctccgtcacaaggctgtactgttcagcagtgatggcaatcacggtgactgtgatggcaactgcagtggtgtacagaggtgggctctgttctgaaattacttttacaggtaaatcatggcaggtgtactgaatccgcacttatgtttctttctctttttaactgggccttgtactaccgctgccataaacaatagctttggtgtcagccaaccaaagacagggtcaaattctcttttcagagtccttactccaacctctctgaggggtctagctgaacccggagcagaaatcctggtttggaggttgggcaaatggctgcgtgctgggcaagcccagcccagagtatgcagacagccccgggcccggggccggccagtagagggctctcgagcaccggcccggactgggaggaagcccaggctttcctggccttctagcccaggtgctgtaggggccgcatcacagagacctgcagctcaccattagccgcagacacagggaccacgcctcccaccaggcctctttacaaccccatgctaacgagaagagaatagccaatgagtaagtggcaggaggagcaaaacaacctcaaaatcgaatgatttagaaaacaaaagtgattccattgaacaagtaattgtcttgatcctaaaatgaccccacaacggaacaccaaggcagaactctgagtcactgtctagatttccaaactgctgactgacaatgataagaaaactttctcttctctgatgattcagtatgaagacaccagctaacagagccttgcaaataagttaaaataatttaccagcctgttcctcctgtcaatcaaatgaaaggtgtgtgcagttttccccctcttataaaataactttttctaggacaagctacaggaggccacttctcaaacagagttagccttcctgggcatcctgagtatctccaggagtcagagtcagacgtgagaaaaagcagagaaagggagtaaaatggcaggaaggaacaagttgagagacgaaagaaaaaaaaggtgacaaaagaggcatcttcattggagtttaaaagggagggggagaaataagaggtaaagattgtgatctccataccctggagtaggccccccattgtccaggttgaaaacttgtttggggttgagcagatagtggaatttccgaagaattctatggaaaaaaaaagaaaaggagggagagagagagacagagaaggaatatgtcatcgtgagaagtcacattagggcaaacacctctggagcccactggtggcagggatgagggttcatttaaaccccggaggggagggcactgcctgctgaccctggcgtccaggttccacctggcatcacccgtgttatcactcccggttcaaggctgaactaccaacctagactccagctcctaagcccagaagcatcgccccttacaaagaggacagggcagagaaacccagagaacagaactttcattctaaagctttatcctccacagagaccttctcccaaatgttctgtatggtctaggcagtgtgattctgccctctgcagactgtacaaaagcatcacaggaccccctcctccccagggagaggccccctgcagtcctgggatcaggaggaaacgcaggaggtggtgttgggctgtgggggagggagggcgctgagaggccgtgactgcacccaggcctgctttcctggctccagcttggaattgtcaggtcagttcaggaggggtgtcctgccccttggacaggggtgggggtcctcatagttcttgctttaactctactaattattattttttaacctggattccagatcacggtgccatctgttaatgatcccggaattgggaggcagagctgctttaaccattctccctgtccacctgtgctgttcagcaatttctagcctccgctgaactgggcatttcagcaaactgatgaggtggatgcactggcttctcacgggtgacggtagcccagcaggtcctaatcaacgggctgcccatcatctcttaaatcaagagatctgagaggctagaaaggcacaggcatctcagagcgtggtctaactctagtggtcttaataatggctcacgtggcaggctgtgggctaagcaccgtgtctgttctcacctgtgagaggaggaatgataattatctccattttacagagggagaaaccgaggcccggggacattaagtcacttgggccaggtcataaagtggcaggtggcagtgctgggatttgagtctgcctgtctccacagcctgctgtgttcctgccaaggggaggaagggcctgagtcgtgtcgccctagttgctccactttgaaacagaagagaacgtacctttctccttgtctccctccactcttggggttcaccaagaccagcagggggtgggtacccggggtggggatgatcttatacttgaaaggtaaaagaaaaagaaattagctctgcttcatccaatagggggcgtgagatgagagttgaagccaagacagcttcggagaggcagatgagaagcaggagggcaggcagtcaggtgtttttccactggctgaattttcggaggggctaagtagctaagtgtctccagtttgaatggcctttaagtagtgttaacggaaatgagggtttgaggtcaggatcagcgatgggacaatgatgctgtagcttcaaatcattcaacgatgacgtggtcttgtacctacagcacaagatgaaattttgtgggagacacagctgaatatgatcttagaaagcacggccgtctgatcatacgcgtaagtgaaatagcactcgtggagtgaaccacccgcttccaccctggcgccttccaaatgctcatttccggccccagtttcctcctgaaccctggtcccacatttctcactggccagtgggtagtactgtcgactggacgtctcaccatcagtacaagctcaacatgcctcatacatgacccatcttctctccctatgaaactcggcctttctcttggttccctgtttctgttattcatccatccatccaaggaaggtcttgtcctgccaagtctttccctgaaatgtccctttacctctggtagctgccacagccccatgctgcttgtgcctttcccaccctaggtaagtcctgcacaccatccccacacagttccttcccaggacaccaggtcagccataccactcttgcccaaaaacttgtaaagacatctcattattaaaggaggatttggattttgtggataaaatgtaaatttcctaacctggcatcaaaggccttttcagtctagccctattctactgttatctcctaattcctgctaaccctcagctgcaggtgcagccaagtcctgctcttgctcctctagtaagtctagagtgtgtctcttgcattcccacccatgggtctgctcgtgcttgtttcttctcccattccatgtcccgaaatgcccacttccttctttgcagactactaaaaaaatttttggctgggcatgatcactcacgcctataatcccaacactttgggaggccggggcaggagcatcacaaggtcagaagttcgagaccagcctggccaacatgatgaaaccccgtctctactaaaaatacaaaaattagccgggcgtggtgggaggtgcctgtaatcccagctactcgggaggctgaggcaggagaatcgcttgaacctgggaggtggaggttgcagtgagctgagatctcgccaccgcactccagcctgggcgacagagcaagactccgtctcggaaaagaaaaacaaacaaacaaacaaacaaacaaaaaacaccaccaccaccaccaacaaaaacctgcttatcctcagggctcaattcaagagacatctctatgaagtttcccttcatcattgcaactaaaatgattgcacttaaaacatgtactattggctgggcatggtggctcatgcctgtaatcctagcactttgggaggctgaggcaggcggatcacctgaggtcaggagttcgagaccagcctggccaatatggtgaaaccccatctctactaaaaatacaaaaattagccgggtgtagtggcgcatgcctgtaatcccagctacttgggaggctgaggcaggagaatcgcttgaacccgggaggcaaaggttgcagtgagctgagatcgcaccattgcactccagcctgggagacaagagcgaaaccccatctcaaaaaacaagcaagcaagcaagcaagcaagcaagcaaacaaacgcaccatgtactatcttctggagtttcttttgttgttcatttgtatttttttttttttttactttcttagataaatgactcaaaacatcaactggatttaaaatgcattgggagcagagtggggtgtgtgtaaccctactaccaaggaccctatagcaccagacacaagagtgggtgctcagcaaatacttgtgggttcagtggaaggatacaccaatgtggacgcacagctctgctccatattcaatatctaatgcctgcttttccagatctcaagctaaaagtccagcaaacacagtgccatgttgtttgaaaaggatagtagcatttccgatgatctaaaaaatttgtctcacctgcccagggtgactatgtgatgcccagaagcatcttggaggctgaggaataaaccctcacctctggagatgatattcaacgtatttaacagccagtcctacagtgggggctctgccccatcagaacagatgcaagacaacccgatggctgcctgccctaaacaactggcatacatgtatcgggtgtggatatgcatgcgcctgtgtgtgtttcccacctttctgcccttctaggtgtctagagctttctcacatattaagattctcccctcattcggccttatgtttcacttttctttttcttttttttcttttgagacataatctccctctgttgcccaggctggagtgcagtggcagaatctcggctcactgcaacctccacctcccaggttcaagcgattctcctgcctcagcctcccgagtagctgggattacaggcacctcccaccacgcccggctaatttttgtatttttagtagagatggggtttcaccatgttggccagtctggtctcgaacttctgaccttaggcgatttgcccgcctcagcatcccaaactgctgcgatgacaggcgtgagccactgcgcccggccttttacttttcacaacacgtgaatctgtatattctcatttaatcttacagcacctctgggaggtgggcagggcagggattactgtgtctcctttgagcggaggaaacttaaggctcagaggcagagcaggaggccccggttttctatttccttttctagtactctttgttcctcaccaggctgccttccctgcattccttggaactctgtggaagacacaaaaaatgttcattgctgaacccaagtaaaaaaaatgagttcttaagtatacatttaaggattaagaagaacttttagatctggttagcttcattttggcagatcatgttctggagacagcttggcaatcttgaaaaacccattgtctatttttaggccacatctttgttattatttaggacatctgcatattaaagttttatgtaactttttcctaaaatagtaataaagcccaataagaccagcaatgggatcagtcaacctttcctctcaccacttgctgacagtgtggctgtcaaaggtaacaccagaggccacaaataaatgccctcctgggtggtataattagtcagatgagaaggcaaatgctgagatgcttttctgtagaacccaaaccccgtcttgcccgccacagccctggaacaacttagaaggtgcaatcggatttagagctcatgaggtacctgcatgacaagttcgcccttggcggacacgcagccatcagacttctcacctggcctgtcctgtgacaagaaaggaaagacaagcatcttttggaaaaagaagcctaacacaaagaaagagatcagatgaaaaacaaacggctgatataaagaaagagatcagaaagctagtgtagtatggagacgaggttttcaacatagggcttctgacctaaataaagaaatgtacccctatgactttttctaggattcttcaggcctccagtgatgacatcacgggctgactttacctttgaggcaagggacatagtggggagcactgaaagtggcagaattccacttggttgatttagaagcttgagctctgagaagaaaattcttagacttggcgacttggcttttcttcctttcttttttttttttttttttttttttgagacggagtctcgctctattgccaggctggagtgcagtggtgtgatctcggctcactgcaagctccgcctcctgggttcaagtgattctcctgtctcggcctccttagtagctgggactacaggtgcgtgccaccacgcccagctaattgctaattttcttgtatttttagtagagatggggtttcaccatgttggccaggatggtctcgatcccttgacctcgtgatccgctggcctcagcctcccaaagtgctgggattacaggtgtaagccactgcgcctggccgtcgacttggcttttcggctgagcactatctaatgatatgatattgtcatttttcttggttttgtttgtttttctaatgtttattttattaaggttttctcacatatagtaaaatgctcaaatctaaattgtacagcttgatgaattttgtatatggggatggcctcgtaactactacctcttcaagcataaccctgttgtgactcctgataccacatgggttttgcctggcttttgaatttcatataatggattcatagagcatatcttttcgagtctagcttctttggttcagcattatgtttttgagattctccatgtttttactctatgcatagtttgttcttttccattgcaatgtagtttcccattctatgaatgccagatgccgatatgcctcaatttattcatctattctcctgttaatggtcatttaacttgtttccagtttttaactgttatgaataaagctgctatgagcattcttgtgcatgtcttttggtggaataaatgcttgtattttccaggtagatgcactggaggagaatttttgagttatggagtttgtatatttccaatacagtaaatattgctaaatgattttccaatgtgttggtatttttcagggttttttatttttatttttgagacagagtctcactctgtcacccaggctggagtgcagtggtgtgatcttggctcactgcaacctccacctcccaggttcaagcaattctcctgcctcagcctccccagtagctgggattacaggtgcccactaccacgcctggctaatttttgtatttttagtagagatggggtttcaccatgtggccaggctgatctaaaactcctgacctcaggtgatccgcctgcctcagcctcccaaagtgccgggattacaggcatgagccaccgtggctggcctttttctcaggtttttaatgacaaagaagtagctggtcaagtccagagtgagatgtgaggaatgggtgggacttgcaacatttttaagatgggaagatggcaaaattaagtgtttgacgcttgtttgaaagaggagtcttcaacacaggcgacaacgtgccaggtgggggtaaaggagcttaattttgctgctttcatttccaaatcaggctgagacatccaagtggaaactcaggaagtagagggagatactgtttggatgtggcagggagattgacagagatgagggaggttgggagcctggccatgcataggtggtgactgaggttccttgtgctgtgctctgcctgcaaaaggcttagaacaaatgtgctttccttgctgggtcatttcagggtactcggggtggtcagcaattggcaacagtttagtcagagaagatttctctcaaaatctgatctgtgcagcgctgacctctttcaagcacatactgaaagcacaaacccaacagagaggagcagaaaagattaacaactgggcactgggctaaaaacccaggtgataagataatctgcacaacaaactcccgcaagacgtgtctgcctgtgtaacaaaccctcccatgtactctctaacctaaaataacagtaaaaaaagaaagaaaagaaaacacaaacccaaagagttgtcagggaagccctgggaaggatgtgaatgtctgaaagctgcctacatctgaaaccagaacccggagaagctacagccctcgccggggcaggagcacttacccgggtgatggggcatatggaggtgggcagtaagatgtggtctctgagttccccaccgtcacacaacgttgataattcacatttgcggtgaaactggggggagaaatgaaaaagagagtgagtgaaagtgagcaaagaaacatcaaacatgaaggtggagaggtttgggggagaggtgagctgtctagtgctcccccaaatcctgatgcactgctggctttgacagtattgccgtgtgtgtgtgtgtgcacgtgtgtgtgtgtggttaagggtgcaaagtctgctgtgggctgagcaaagaggccaagagccgctcatggctactgaagcgacacagtcatgagccggcctgtgacccttcagtgtggcaccccatgttgattccagagcccccttagatatgtgctctccaggccctgagactctgggaggagggagatgttgatgaacaaactcatggatggctgagagtaaaccttgtgattcaacctttgtattttgagagttctgcagtctggtttggagaaacctacattttgaggctgatacctggggagaaggacaagagctggcagtgagttttgacaggcaggttggccagctcagtggctgccagtggcattctgggtgtctagtggggctgtggactctagcatgtgctgtggctggtggcagcaggtccaaacctttggcccaggcagtggggctgctctgaggaatgtgccttcagggcaggcaccccctcctatgatgctcctgttgtccaatttttctcccactctgtcagtgtccccggccctaggtgatagccaggtaaaagaagttcatagtcggggctgctgatcccagctgccaggccacacagacagtggactggccagcttcttcttcagcagtcctcactcccctggttcgggggtgccctctctctgggcagcttggtaattcactggagcatcgttaggctgagggcattgaataggcgctgtggggtcctcctagcctcgctcccctggctttgctcatgccctctggccggatattcactgctcctgggctgcagcttgggcaaaaaaacgttgaaaagaagcagggccgccctgggcgccaacccaccgtcatccggcaccacacgcagtgccgcgcggtgacactctggtagcacttgatacttttgtggcaccggtcacacttgacggaggagttcccttccacccatgcgtgctgcatcacctgcgggagggaagcgaacgatgccagggaaaatggcagaaccatgtccccggggccctgggctggaggagaaggatctgggaggggacgcgggggagccagagggactgtttcctatttagaggatgcttattggatgttgggtggcttgcctaatggcacgatgtggttcctccctgcctaaccgccattatgcgaatcaaagtagattaaaagctcgctttgccacattttgaacagctcaatcgccctggaaggcaggcctctgagcagcatcttgtctggcagtccatctgtttgtcttgcagaacgccttgcagagtgatgtgtttgtatgcgccctcttctggaaggcagcatggtgcagaggaactctggagggcttgggtaggccacagacaaaactggctggagtccctttgaagtggtggcctttggccagttcttagacctctctgagtctcaggtccctgacctgtgggaattggtataagaagtcccacctctggggttactggggcaatgcaatgagatagcacattttgaagggcctccctggtgcagtcctggccctttgggagtacccacaattgggtaatgcccttctccttcctcagctttagctgcccattagaagtacctgggggagcttttagacatcctaatgcccagccgacactccagaccaaataaattagagtctttgagggtggggcacatgattaatatgttttaaagcactctgggtaattataacgtgaagccgagactaaaaagcactctagaaggaagttagagaaaagtccaaagaagttagtgagggtccattggtgcttttcacacctgtttcctggggagctggttgtatctgctccgtgaccaggaaagaccaccagggcaggctaggcacttggaaacaggtgggaatagtgggattgtttttgtatgtgtgtgtcagtgcggctaaagcaagagcagctggctagtagccccactgtctgggaggctgaaccctcagttccctccccctggaattctcaccaaaattctcactcaaaaattttcactatggtaccacaaataacagaaggaagtggatatggactctgggagaaggtgggggacataccctgaagtgcctagccacaagcacggtattaaaaacccaggaaatatctgcgtgattctgtccaggtttgtattaaataagaataaacgtgttttttttgagacagtctcactctgtcgcccaggctggagtgcagtggcatgatcacaactcactgcagcctcgatcctccaggttcaagcaatcctcccagcccagccacccaagtagctgggactacaggcacatgccaccacaccaggctaatttttgtatcttctttttgtaaagacaggatctcaccatgttgccccggctggtctcaaactcctgggctcaagctattggcccttgtcagcctcctaaagttctgggattacaggtgtgagtgactgcacttggtccaagaataaatgttttaaattacttagcaattaagttgcttaaggcctcccctaagaatgtttttggcaaaattattgctttggaagatgtgtcacgtttggttggtagcttatcaccttgtgccttgcacttctgagggtgtaaagaactcagtttgccaattaatctgtcatctacatggccacaattgaatttgctctgagattattatttccattttgcagaggaaaaaatgaaagtttcagagaggttaagtgactggccctaggttccaaggctggtaagcggccaagtagggtttcctagccaggtcttctgaccccaagtccagggctgtttccccaacaccacatcgccttacccattctctttgggatctgaggagatggtgaaagactgggttgctcctgcaggctgagaagtttgtgagtgtgccctgctggcccctcattggcctcactctgttctctgtgtgacaggtggccagagtgcaggcttagggcctgcgtccagcaggtacaccgtgtgtcccggtgaaaggcatggacatggagcagggtgtgcatggggtggtgcagaaggcgtggacgagagaccatgcagtgtccatggggcatgcacacaaattctaggaggtgcctttctctaccaggagtccttctgcaggagggctgggtaccactctcatggctaactgtctcctgactcacactcctccatgtaatcttcccttttcaggaaggctaagtgcccttcccctgctaattttaaggtaagtctatttccagacttggagaatggcgtcacccaatgaccgagttagaaacctgggagccattccctaccttttcccttctctcatcctccgcatccccatcaccatgtcctggtcctagtggtggtacttccaaattacctctcaagctctcccttcattttctctcctttagccagtgtgacagtcaaaatacccaataaccagcatggcctgggggaccctcagcacaggaccatcctagagcagtgagtgtggatcccaccccagtcgggccctcagcgcagtactgccttttacctcaagtattggaagagtttccctcccctgatttctctcccacatcacactcagagctattaacctaattcacaaattcgatcacatctttatgtgcttgaagctcttcagtggcccccggctgcacagaaaacacctttctcactcagctggcctcataagacctgcttcaggccagatctcaccactttctgagtgcatctcctgccacttccctttaagcatcctctgccccagctatgccaaactaagtatgaatcccggaataagccgtgtctcatgcctttacacatgaggcttcctctgcctggagagtctggtcctcctcgatgcctcatgaagtcctcccaatttgtgttcaagacacaactgcaatgccagctcctttgtgcaacttgccccgtgcttccactgtaccttccacacagctgtgttactgtagcacacatctcactattctgttctttgcttacatgcccgtctctccttctagacagcatagttcttgagcaggctggggagcgtctcttacaacctgtgtaccccctagcatggtgcctggcacatagtgggtaccaggaaggtgctgaatggatggatggatgaacgggatggtttacaggtggtcctcaaggcagagaagggactggatgaagctcccagtgccccttcctgcccaggaatccatgttgatggacatgtttcctggatgaggcatgcagtagaacaaggcagtagatgtcaccaacctcaccactccttttggcttttgagtacgttttgacacaaccaggaatgtttctggacacacagcgttcgtggacagtgtatttacagtctgaaaagaaaaaaagtcaaggcaggtgcttgtgaatagccacgtaggaaaggcccagctgccctcccaccctagccaaggtctgtacctccctttgggtggctggcgaggggcaggggacacatggggctggtcttgcctaacggaaattcaaaacagtctctaattgttcttggaggacagagaccctgcttatctgctgcggctgcacctccacctgcttcactgccttcctctgcaggcaatgaacacagcaggagcacatccccagaaaggcgctttttcctgaaggggagtgtgcggcatcatcctcctggctatgccagtgccactgtattgcatgcccgggacattggaaaatgaatagaaaggccagggcttttttttgttttgagatggtgtttcgctcttgttgcccaagctggagtgcaatggtgtgatctcggctcactgcaacctccgcctcccgggttcaagcgattctcctgcctcagcctcccgagttgctgggattacaggcgttacaggcgtgcaccaccacgcccggctaattttttgtatttttagtagaaatggggtttcaccatgttagccaggctggtctcgaactcctgacctcaggtgacccacccgcctcagcctccctaagtgctggtgtaagccaccgcacctggccaaggtcagggcttttgaaggctaggcaggcccccgtgacaatccacatgaccttgggtaaattgttttacctctctgaaattcagggttttctgtaaaaagggaagaaaacggcctctctttctctttctctttgcagggattgttgcagtagtacatgagatagtttgtgtaaagcatcacgtgtctgggtcagagtagctattccacacattattgctgttgtttttactaccattatgtgaacagcagaggcccacgggcctagaacttaatgggaatgagattgatctataaaatgtgggtaagagctgggtttgaactggcgctggggagactgttgtaccccttttttttttttttttttttttttttgagatagaatctcaccctttcaccaggctggagtgcagtgatgcaatctcggctcaccgcaacctccgactccctggttcaagtgattttcctgcctcagcctcccgagtagctgggattacaagcatgcgccaccatgcccagctaatttttgtatttttagtagggacggggtttcaccatgttggccaagatgatcttggtctcctgacctcgtgatccacccgtcttggcctcccaaagtgctgggattacggcgtgaatcaccgcgccaggcctggcggaccccttctttagcccgttgatgcttggtctttgtggacagcgggcccagctctgccaaggcgacttctgtggctgaggtcacttgctgcctaattcacacgtgcatgttggataaagcacttcagcctggagcacagccagcgggcctccctgcagcagcagctccccggtgtctggtgggttcaggctgagtgttgctgtccacatcacggggcgggcggcagggctctgtgcacccacatattctggtgcctgccatgccttcttgctgcagcccctctgccttctcctcctgctccctgtgtccccttctttcctactccttatcactcttttcccccatctctttttgctgtctccctttccagtcttcctctctgctttttcctctaccacttgtagttttttccacctttccactctgactttactaaaggaattaaaaagtgaaacaactgtagagttttaattcctattgcctttacagaatgtaaaatgctttttttgtttgtttgttttttgtttttgagacagggtttcactccgtcatccaagctggagtgcagtggtgcaatctcagctcaccgcaacctctgcctcctgggctcgagtgatcctcccacctcagcctcctgagtagctgggattacaggcgcatgccaccatgcccagctaatttttttttagtatttttattttttatttttttatttttattttttattatacattaagttctagggtacatgtgcacaatgtgcaggtttgttacatgtgtatacatatgccatgttggtgtgctacacccattaactcatcatttacattaggtatatctcctaatgctatccctcccccctccccccaccccacgacaggccccagtgtgtgatgttccccactctgtgtccaagtgttctcattgtccaattcccacctatgagtgagaacatgcggtgtttggttttatgatcttgcgatagtttgctcagaatgatggtttccagcttcatccatgtccctacaaaggacgtgaactcatccttttttatggctgcatagtattctatggtatatatgtgccacattttcttaatccaatctatcattgatggacatttgggttggttctaagtctttgctgttgtgaatagtgccacaataaacatacgtgtgcatgtgtctttatagcagcatgatttataatcctttgggtatatgcccagtaatgggatggctgggtcaaatggtatttctagttctagatccttgaggaatcgccacactgtcttccacaatggttgaactagtttacagtcccaccaacagtgtaaaagtgttcctatttctccacatcctttccagcaccttagtatttttagtagggacaaggtttctccatgttggcagggccggtcttaaactacaggcctcaagcaatccacctgcttctgcctcccaaagtgctgggatttcaggtgtgagccaccgtacttggccccaaatgcttattaatttttaaaaaataagtttcctctgaacatacccagaataaatattgactagaaaacccaactaaaagtagtatgagaaattttaaattatttgtggactttaataatttcttctagggggtcagtggctcataaaaagcctccaataataaatagtccaagacctgtccattggacttgggtagggtaaaaacaggacatgaaggcctcgctttattccttctgttgggacaatatgggtggtccctcaagctgggaagcagaaataccaacattttctctgcaatggatcaaccaaccatgcgcagagcaagatagtgcctgggggaagaggtttgaaggaaatttactcacaagtgcagcacaggccttgcttgcggacgcccatgagcatgatatggcagaagttgcagtaggttggtttcttgaagtgcttcatggtccaggcgtgccgcccatcccccttggagccctgcaggggtaataggaggtgagaccccaagctggctgccctgagatggaggaagccaggggctgcctcttgcatgttcttccttttcatctcatttagaagatgagttattgatattttttactgttttaaatacaaataaaaacaaaatttttgtgtgtgtgttttaaaaattagcaaatattaaaagcaagaaacatctgaatggaagcatgtgtgtgtgggataaaataaatcctctcccgcatggctggcagaagcataaactgaacaacaatctgatctatctatctatctatctatctatctatctatctatctatctatctattatctatcatctatctatctatctcctttaaatgtttacaacctttgacttaccaatatctccttttcgactttatcctaaataaataatttttaaaaggcagatgagcctttttgtgccctgccagatgcttaacccagcattatttaaaataatgaaaagctggaaatatcctaaaggtctcataattaccaaaaggctaatgatagtacatccgtctgatgtaatgttaggtggcaatcaaaaagatatttataagactatctaatggcatgggaatgtgctcatgatacaatgttaagcgaaaaaacagaatgccatttcgatgatatgttatgatttcagttttatataatagatctttgatgggaagtaatttcattaacctgttaacagaggttggctatagctggcagcaatatggatttattgtattctctgatttctactttctgctgtgtgttccaaatgttttacagtgtgcatgtactagtgtgataatcaagatgaaagagtttagtaaaaacaatgtatttctcctatcaactttcggtacgcagaaaaaatagtgaaaagacagacagagaaagggttagaccatcacctcctgactttgttcagaagtgaaatcatctgcatctactaggtacaccaagcctcacacagtgacacccacatctcccacatcccatcccaggggaacacagcacagcttgaggaatgtccctcctgcatgtgctatccctgaacttttctcataggctccattacaagagtaacactcttgggctggtttcatgatcagtaaaagctacggtaaggtgatgaggatcgatggtcatggatgtagtgtccaatatgcgggactcaaatgtaattcttacttctggggtgcgtatgcatttgggctggtcactgcaaccagacctcagcctgtgcccaggcttcttttatgatctccagaggagctcacattcttttccaaatgctggctttctcctctgggccagagaagctattttcttctcattacctcaaaccctgcttcttccaggacatgagttttatagaattaaaaccctcttatctaacggtctccactttagtaaatgcattcacaaactgataatgattcatcaaaagattgattcattcatttattcgtttgaccaacatctacctcaagggctttttgtaagaattaaatgacatcatgtaagtaaagcttctagttcaatgcctgacatattgtaaattcaaactttcattaaattcttattccattccagatgccggaagacacaaaataaactaaaaagtgtttgttgacgtggaaggaggtagatttgttcccattctagaaatgagaaacagagatttggagaagttcggtaactagcccaagcccacatagataatgagggactgaatgagtagtcagacttgggtcttttgctggccagagcccatgctctttccatcctgctcctctacctcacaagccagggttttcctgtatgggtagaaggaaaatgatagcactcttcagcagacttcttcgtggagcccaaaggattgtcagtgtatctgaaaacacctctagtagctaagtcagttagctcatccccctttctcagctactatttttatggatataagaagtgcatggaccgtgacttgggataaagtaacgtttctgcttgggttatagcaccatcatgtggctctttcctttccacatgatggtggctgcagaacgtgggcgtagccttcctcgtgctcaccaggttttatgctgctgctacgattttcctgggagagagtctgttttgcaaatatctcattcagtgattccccagacttttcagtggttgtatgtgggttttgaaaaagcccaagaagcaatggacttttaagacattgatgggggctttctccaaaaccccaaatagtaagtgttaaaaacttttaaagtacatatttaaaaataagtgcataaaactcttgattaataaaactaaacttgcattggccactttcctgatataaatgagagttttctacaaggctgatctggcatttaggggagacatttgggagaatgctgaggaagtagatgggctctccttcctcctgccacaagacagcgggtcttttccatgcaaagagttggtggtattttgaacctcagcaagtccaaagtagaacagaaaatggaaattgattccctgtaactaaaatgtcccatctttattccctaaatgagaaaaaaaaaatggtgttttggaacagaacttccattttgtcttgagtataatcttaagtgagtaaagtcagcagaaagcatatctaacttatctgagcccttccagttcctggatcacatgggttcttgtacataaagcttcttggcaagggatcattgggtgagaggcgtgatgtgagcgagtaagggggatgatctctggtgctagttcggtggatgtccttgggcaagttccttcatttctctgggtctcagtttgtaaaagaaaggggatcaaccagggaccacaaagatcttttccagcttgactttctagggttctaaggaataagaagggggtcatgtagatcctggttccttgatttctccttagagcttggaaagcactggacatgctatgaaatgattgcaagattcatagttcttgagcttcagaaatgggggctcagctttagtcctgaattgcagagctatgaaatgaagatattataggcaacttggtcagctagaggctcacccagctgcacttgctgccctgttcctctctatggaatagtctcaaagaggtgtaatctttgagatctgtaatctcaaagtagtgttgtcacacaactggtgtgactagtaaacgcttaatgtcaccatttgtgctcctactagttttagtcttccctacctcatgcatggaagtgagttcacttggtaaataggtggagaatacagtaactgggtcagatgaaggtatatataacaatcagtttcacattaagcctgtacacatatgccctactctgatcaaatgggagatttgcctaacacacccagaactttctttcatttgtgtttttaatcaagctgttctccaagccataaactctctctaggtctttaaggccacctgctctttattctcaagaatgggacatcaaaatctcatgcattcttcagggacaagtcaacaccttccaaggtttcttcccactggcctaactctcatgtgtgggatattacaaagtgcaacatctttggtgtcagagacaaatcctcactcctccttttgctccttagggtcagaacctcagttttccatctgtataaattgggataaaaatatttaccttatctggttgttttgattattaaataagataccactaatggaagccacccccacaacagatccgtattttttcctctctcccttcgttctttcctctcacccttccttccccaattctcttagcatttttaaacctaatttgttgaaaagacagaattcttctttgaagtttgtggccctttgcctggttgagtataaggttcttgcaggcagataatgtgtctgtattccctcacagcatgcagaacagtatttttaaagtagtaataatgtagtaaatgtctgtcaaatgaatatacttcaggcactaatggatacaaaataatgtaaatagagaggactttggggctggtcatggcacgtctgttgggcagtctggagcagaagccaaagtgatatgttgatattaacatgaagcccaatgttcctgaatggcaagagatctctgaactccagcttgttgacttacagagtcatccatccccaggaggaccagcaatgggatggtggtcatccctccatggacccattcctgtagagacacaaagccgtcccggtcgtagtccatcccttgcagcatctccttcaatatctgtggaatccaaagagcaatcattgtccattttcatcatcgacatgtctacctgccttctgcctctgctgtcttgttcatcttgcattatctggtttgtgttttacccctttcccctcctgttaagtgtgaatagagcagactgggagtgaggaggccaggcttccaggtctggctctgcccttgggccttgggccagtcaccctgactctgtgggctctggtttgcttatctgtaaaaatggaaataatattgttgtgtttgtggcactgtagcagggattagagaaaatgaatgtaaagtgaataacaaaatacctgacacataggagcccccaaatgtaattattcttataattcatattatctggtgattgaggaagatctctacaattctttctaatagaaatctctacagttctctctaaattctttgactgatgaatttctgctataacattttagttctggtgaaaagattagcatggttatttcagttatgtctgcacgttttcctgctgcctacatttttcctatcagagaggtaggaggtaaagtgcaggactccaaagaagctgcctataagaagatgagtctgggagcacctgcagggttaacactcattcatgtcttgagtgtgtccccctcccgtcttagaagctcactccaaagccaccccatccttatagaaactcacaggcctcagctctgtgggatcccactccaggtactgggcaatatgcagcatttggttgacaatgcaatccatctcctagaaaatagcaaagggagaaaatatcaaaaggagacaaccagagatgtgtcattaagagccgaactcaaaattaagcccagtgggaagagggacagggcagggcaagagaagaagctggtgcagtaactgccattttgtgaggagctcagtttatttctgtctcgaccacaaagctcacgagaagcacagagcatgcataagctggaggtatgcaaaaagctcataaacactgacttcctcctggacccaccttccttcccttattctgtgctttaacttggaaagcatagaaagcactcctatttttatccctctttgtgattatagcttccacaaatacttacaaatcaaggcagatttctcctgtcacttcttatcactcatccccacagctgtagcaacttgggatccatctctcagctcgaggccagtttctcttgcatggagggttactgtgtgtgtctcagctcaggtaccatgattttgattccttttgttatctcctctgtttcctttttaccatggtccagcccttagcccagcccccaggagtccgtgaacaggaaactcatgaggaatatgtttacttgatgactgagccttttggtactgaggccaggctccatctaaaacctcacagaattgttggctgccaatgagtcagtgttctgagagccccgctgaaacacaccagactgaagaggcatttggtgtcaaagttagcaccatttaggcaccagttaagatgttcacagtaagattgctttgggaggacatgttggtagactgaagcaaggttcaaaagtgttacctctgccagatagaatgccgggtccaaatagcaagctaaaacccagcagggattttaaaaaattgtattttatttaagttaaaaaacaatccattgcaaaactacaggataggccagtagatgagggtaagaaagtgggcacaaaggtggggaaaggttttggcagaagttccaaaagaaaagagcttgtgaatctctggttgggtccaagatttaaagagaaaacgtatttcaggaaccaagaattggactcagtcttgggctatgaaaatagaagcagagttggcagatttaaaaaagaaaaagttcccctgaggtcttcctggtcaggccacatttggatacttaaagaatcataggggacggattctgttctgtgccacattccaggaatggcatttacaaaccagagcttgtccaaagtggatatttaagcctgccttatgagaaccagtgtaggaatagagaaattttagcttggagaagattttaggggagatgtgatagcaccttcaaatactcgaaggcctattgtatgggataggtattccatttgtcctggccaggtatgggggacagaaggaagcagagagggatgcagggaaggaaggagttgaggactggcttattttggcctccctgttggattgggggagaaggggagcagaagcaggttttgagttgaaaacgattccccaccacaaagaggagtgcctgtgttcgagaaggaagccctctccagcagtcacccccagcagtggaatggctgtcttaaggtaggagtccatatgacagggattccggtgaaaggttgaatcagataactcttttgagatttgcttcagtcttccaatattacctttaaaacgtatctggaatttaacaacttcttactacctgcaatgattctaccctgtacaagtctacaccatttcatgccttgattatttcaacggcctcctaaccagtatccctgcttgcattccctctgtcacccaggctggagtgcagtggcgccatctcggctcatggcaacctccacctcctgggttcaagtgattctcccatctcagcctcccgagtagctgggactacaggcgcccgccaccacacccggataatttcttttgtatttttagtagagacggggttttgccatgttggctaggctggtctcaaactcctgacctctggtgatccgcccacctcagcttcccaaagtactgggattataggcttgaactactgcacccagagtacagtgattctgttaaaacataagtcaatcacatcactcctctgctcaagatcgtcaatggttctccatttctctggagtaaaagatacactttttttttttaatttttttgagacggagtctccctctgtcgcccaggctggagtaagtggcgtgatcttggctcactgcaacctccacctccagggttcaagcaattctcctgcctcagcctcctgagtagctgggactacaggtgtgtgccaacatgcccggctaatttttgtatttttagtagaaacggggtttcaccatattggccaggctgggctcgaactcctgacctcgtgatctgcccgcctcccaaagtgctggggttacaggcaagagtcactcgcctggccaaagataaacactattaatcacctataacgtttaataagatttgcaaactccccactctcctacccccatcccatgacttctctgatctcatcccctattacttcctcactgtgatctcatctgtttactcattctgctccattcacactggcccggagtgaatcttctaacatcctagggaccctcaggaccctcgcactcactgttctttctcctggaaggctcttcccctagaattactccctcaccttcttcatgcctctgttcagatgccccctcctagagaggccttcctcggcgaccctcgctaaagcttcaacttcttccaacatttcctttcctttatttttcttctcagcacccatccctacctgacacatgtttttactatgctgcttagtgtctgtgcttggactagaatgaaagcttcatgagggcatggaactttgtcagttggctacactgccataccctcagtgcttagaagagtgcctgacataatgcagatactcagtaaatatgtgttgaccaaatgcttgagaatctgtgattctctggatgtttcctcaaatgacccaacccgcagcattgcaatgtagctggagggatcccatagaggcaccctggggtttagagggaattgggatgattcagtttgtctagtggacttcttcccttccttccttcctctggtctgactcagccccatgcatctcaacctcagggccttcctgttaatgagccctatctctgacattgacagtcaggacaacagggcctgtctgactctgtttgccttcttctctttccattcttccttttactccacgagccttgatcgatccttgcctgttcctgaaggggtgagggtgagtctcaggctttctcaggtgcaatgggatgggaacatgtacttagagcagacagaaccagactcctaggctagtgccctggagtaggagaggcagccaagggtgacggcaaagcacatcagcagtgaccagcagcctccttcctctgaaatcagcagtaaccagcagcctccttccttgcacatcaacagtaaccagcagcctccttcctcgtgcccttttcccttggtcttgttgcctcccccgccctctcctcttggcctcaggactcctgcaggaaattgcaggaggcgcttgtgaactgaatgggaagttaaactaggtgacatgctaaagcatccctccatcctgagatttgatgatcccaggcttctagagcgaaaaggtaagttggcattcacgctctgcaaggccggccctttggaaatagcgggtggagaggtcctagtcggatttcctcagcctgcatcgagacattgctattactacaaagacggaactgaacattttcagattcttcctctgcttgctccctgctcccccagcctttctcaggtccatgagggatatttagagtgagaacttaccgcttggtccaggagaccgttctcatctgaatcatagaggcgaaacatgactgtaagaaacacagaggtaagccttgaggtgtcctctaagaagcgcggatggctgaagttttgatgctgccaggtttttagattagttctgtcaccactgtgacgaaggttatggcagccagctctccctccctctgagcacagagtctgacttccttacagagaggctgggccaagggaggagaaccacctggcttctggacctgtctaagcaatacctatgtggctgatgaagtccaggtcatgagtgtaattccctggggagcatgaacacatttcagcgtcactagaacacaacctaaagcaaatgcccagctgggggtggggcagaggcaccagaatttttcttctattgagcatagaaagtgtagagttaggcagatttaaatcctaggactgccctgccacttctggggggtgcccaacaagttacttaacttctttgagctcagcttccttatctataaagtggagagaataatagttggtttctcctaggattattatgaagattaatgtgtaactgataggccaaatcaactgggcttagaacatagaaagcactcaacagatgttactaatttttattttccttttcaaatgaacatttatatatggcatttaacatatacaaggtactgtcctatagactttctcattattgcttaatcctcaataatgctatggggtagttattacggaagccatcttttcctttttctaaaggtattcggaaatacgctattcagaaacatcttcaatcacgttctaactgctgggaagtgatgtaggataaggaagatctgggagaaaaatctggacaagggactacatgtttacttatgggacctggaaacctatgttttactcaaccaaaaggaaaagatcctgtctgtggtctcataagtcagcatggcaggaagcagagataagcatttcttcattttcctgctattctttctttctttctttttttttttttttttgagacagagtttcactcttgtcgcccaggctggagtgcaatggcgccatcttggctcactgcaacctccgcctcccgggttcaagcgattcttctgcctcaccctcctgagtcgctgggattacaggcatgcaccaccacacccggctaattttttatttttagtagagacggggtttctccatcttggtcaggctggtctcaaactcccgacctcagatgatccgcctgcctcggcctgccaaagtgctgggattacaggcgtgagcctctgcgctccccggcctttcctgctattgtttaaaacccttcatcatgcctgctttctctgcggagcacccgttgactgatgcggtgcaaccacttggggcacgtaccagcctggtccccttatttctgctaagttgtccttgtgtcatcatttcctcctagatgttttaatgtctctgcaccttgtgtttttttcaggggtgcatcgctggtcaaagtcaaagtcctttaaaggtagggtcatgggctttcgattctttgtgattcctcagaaggtcccagtcagaggcatgcatcgtatgctgctgactcacccagcagatggttgaatgacatagaggacagaccttttctgctagcattattccaggactctgggcctaggcgactctccaacgctgacctctctctggtcctattgtgcatgaacaatagaactagaaaggcctgagtaagcatccttattttagcagtgtaaccttgggcaagtcttttaaccttcttgtgccttccttctaggttacaatgaggttaaaatgagaatgcattcaaagtacttagcaaatagaaggtgtttatcaatgatagttgttattattgcattggcaataggtgtgggatttcaggctattattcccaaaaaatacatgtttggtttttaaaaagaaaagtttaatttgttttcagtccttaaagttaaggaaggatataaattgatatggtttaataaaaagcaaaccaaaatgaaaactctatatgaccaagtttctgtaacaaaaaattgcaggccgggtgccatggctcacacctgtaatcccagcaatttgggaggccaaggcgggcggatcacctgaggtcagaagttcgagaccagcctggccaacatggtgagactccgtatctaccaaaaatacaaaaagtagctgggcgtagcggcgggcacctgtaatcccagctacttgggagactgaggcagaagaatcacttgaacctgggaggtggaggttgcagtgagcagagatcacgccactgcactctagcttgggcaacaagagcaaaactccatctcaaaataaataaataaataaataaataaaggaaaaaattagcaaaagatggagagggatccaaaagattaaaagagagtaaagagacataataaccagtggtgatgtatgaattttactcggatcctgattcaaacaaacaattaaaaatatctaggataattggaaaaatgtgaatactgactatttgataatagcaaaaggaatcattttctttagctgtaatgatggtattgaggttatatttaagaagaagagtctgcgattttagaggtacatactgaaatatttacagattatatgatgcctggaatttgcttcaagatactctgaggcagagggaatggtgggaagtataaacacaacaagattgaccatgagttgataattgttgaaactggatgatggggccacagatgttcactgtactctctacttttatctttgaaattttctgtaataaaaagttttaacatttctttgcatggtcattataagactcagttggagagtcattaatataaaaaaatctgtcaccttctctttggtagtcactaacaaatacaatgcctgaaactcaaaatccagctaaatgctggaaataatttgatgtttcacttttaacattagctagaagaaaacagaaatctgctacatttgccaccaaattagcacttaagacttgcaattgttaacacttcaaacctatgggagagattttaagctcagctaatgagcaaactgtttcattttgtttttggcaagaattagcctttggcagacttcccttgcttatgtttaagttttgttgactagtcttattattaactggaattttgactttggctgtaacatgtacatttttttccccttactgtctacttaagttcccaagagaagcaaagacaatacagattttttaacaaggtcctgtcatctcctatttttttagaagtatgtctgtaggctcacagaagccagggaaaccatcactggactgaatcatctacaagactgcaggctgtttcagccactgtgaactttctgctcccagctcttactctcctcctgaagacatgtttttaaaacctactttagtagcaccacgaaactgagctcaactcctttaattaactggccccctcgttctctagaggccaagaatcttggggtggcgggggggcataggtagagaaatggacaaaggcttatcaagacagaggttgatgagatctcaagaaaagaatatttcctcatagttaaagagttgcctgggcacagaataggggaaggaggacagatgttgaatatctttctttaaaaaatctattaagaggaggtagcagttttctgagtaaaggctttcaggaagtcctgccagcaaagcaaggaagtcttgaccacttgatgggaccccttccctttccagattctggttctcaatacctgggtttcagatgcccttcccatgtgatacacaactggcaatatgtcccagggtggattctaggagttgttcatatcacttttggtaacaggacaaagaaacctccccaaagaggcgggacgcatatccgtgatatcaactcaatctccagtgtgtttaggaataatggatagaaccccagatccttctctaggaaaaagctgaagccccttgacagggtgagcacttacactccagcttatcctgaggcctccccgtctccagcagggacaggtagcacacaacatccttcaggtataccactggggattccgagcttgaagaccgagggacggggggttccaggggggtcgcagccacttggtcttcagctggtgcttgcttctcagccatatttgattctgcgatgaacaaaaggaaaacatccaaggacattttctgtttagtaaatattaacccctctttgttaccccatccttttcatggtagaggcaagaattttgtagaagtgtcttcaaaagctttggttacatagatgtgaccaaattagtggccctagaaatccaacttgtggagttcatattctctgaagggatcccatgctgacccctttaagagtctatttccttgcaggaaattcatctatactctgaatattcagaaaagatgatagtgattattggtaatatcaataatcaacaggtaaatgtcatttggcctacttttttgggaacatacccaacttatagaagtaattttggctgggatttcaaaatggtaaatggccaacagtcatttctcaatagaccttgcaattttcttttcaaacacatttaaagacacataaaggatgaatattcaaaagagaaaaccgggattgataattaacgaatctccagaaactaggaagaactcaaactaactgcaagtctaatttggatgaagaaaatgcagaaagtggattattgtaccacaagaatggggtaagttttccctttaaaatttctcctttctaaggtaggaaaacactttgtctcttccacactctgtcctgtggttcagaaatataagctctattactaacaagaaaactgggcacccctgttttcctgtgtgaattctattttttgagacactttgagtgctgtcttccgtctctacctccatgctcatcagaaatgatctcttaatatctactaggagtgtacaactcacagaaaacaactagccagggaacaaagggaagatggacagtggaaaatccaatgttttaggtgttgttatattataccaccaagtaacaaagtactgaaggtagaggcagtgggagagacagccttgatcgtaatgtctgttgaggaaggcaatgttacctgtacactcttcattcggagaaacaaataaccaagcaatgggagtgaatattccattttaggcaagcagggctgtgctagatgaaagccttccaggttccagggattcagttgtgggtctgaggagggagttaaccatcatccagatggacaataggagaaaccaaaggtcactgacacaatttgtatattacagagggcctcatgaagaaaccaagatggagcctaggaaacgtggctgcaaagtaaggaaagaaagcttcatcctgaggtctcagaagaccagattttcaaaagtaattttctactggacaaggcccttagcgggatgcaagaagatatcacctctattatacaaaagcagaaagcctcagggtttggcaagtagagatgaaaatacaataggatgagataaagacagggatagtgagataggggaggttgtaataaaattacatatttaatgaagtattaagattgtcactggaggaaaacatgggaacaggcctttgtactgtgtagtgcattacacccaaagttattgctaggtcctcatattattcatcaattaaaactctatcagtgacttctaccttgactaaaatgggctaacagagaccagatttaccctctcacctaaaacagtgacaaaactggacaaaatgtatgaaacaatggttcataggacattatattatcagggaggaccaaacactgatctctgagaagatgagatgactcctacaactgccacatcagactgtttggaaagagcttctaggccgcagcacagagaaggggaagccaggccaaccctggaagtctctctgagtggaggtgaagctggaatctggagcccacagtggctaggattcacagagcaggcactggagaggagggtatgcacagagagctagctctgaatgtgtgtagaaggtcccctttgagtaacagcagagagttcccttcaattattcagctgagtagtaattagcacacttgtggaaggaaaacacctaaggctaaggctggggaaagaactaggattagagcgaataatccctggagagaaccaggagtaatgcctattcccaccaaccagggtagaaaccccccataattcgtgaatcattgatagagtattcagaaacattttttctcagtagtgagtaaatgcctttctggtcctgtccagtgaagcttaaaagatagatccaaaaagatcagactgtttccaagtaacctaactgtacctaaaaacaaagctcaggactttgtaggaatgtgaaaatccagtactcaacatttagtgaagaggcaccataaattctatacaaattcttccagaaaatttaagaggagggaatcctacgcaacccttttggtgaggccagcattactctaaagccaaaaacagacaatgacatgataagacatgaacatgcaaatcaatatcccttatgaacacagaggcaaacgttcttaatattttagcaaattgaggctcataatatgtaaaaagaaattaaataagaccaaataaacaattaagtacatgaaaagatactcaacatcattaaagcacaagaatatttataacatttttatttatgataattataaattggaagcaatctagatgtccatcagtaggttaacagacgaacaaattgtggaatatctatgtattaaaacactaatcagcaactaaaatatgtgaactattgatatatacaaaatggataaatctcaaaattattacatggagtgaaaaaaggcagacccaaaagagtagagagtgtatgataacatttatataaaatctagacaatgtaatttaatatatatggcagaaagcagatcagtagttgtatggggatgaagggtgggcgggtaaggagggtggagaaaagggattacaaagaaaacttttagagatgatgggtatgttcatcatattaattgtggtactagttttacaggtatatacgtgtgtcaaaacttattaattatacacttaaaacatgcaattttttgccaatttacaactcaatccttggatcttgaaccatttctctagttttcactgaagtctactgctcactcctgtcatagagatgcaggggtccaggaaggctgagaggcactgacactgtctcattagtgtccttcctcttcattctgctttatatgaaatagccctgacctatggccatctgagtacgaccctcaggtaccaccagtaaaaaatgccaacaccctcttccggatcacagaggtcctgtcctggtgccatgtcctaaaccctttcatgtgacggctcttgggcagacctgacttgttccactttctcccttggtatctgtgttacttgttccctttcagtggggcagtgtggcatagtgggaagagcaccagaccaggcagcagaagaccgtgattccaccgctgagtttgtgttcagttgtgtgtgatttaacacacaaagtatgtgtgtgtgatttaacacaagcaggcttactccaccacactcaacctcagttttctcatctgtttaaagaggggattgcattaaaactgatgtttacccaaagtcttgaattacagaaatcattcaagtaaatgacttaactaagtgaagaacaaaactgggtcccaaggccgggcacggtggctcatacctgtaatcccagcactttgggaggccgaggtgggtggatcacctgaggtcaggagttggagaccagcctggccaacatggtgaaacactgtctctactaaaaatacaaaaattagctgggcgtggtggcgggtgcctgtaatcccagctacccaggaggctgaggcaggagaatcacttgaacgcgggaggcagaggtcgggaggcagaggttgcagtgaactgcgatcgtgccactgcactccagcctgggcaacagagcgagactccatctcaaaaaaaaaaagaagaaactcggtcccagattatctatacaatacagtctgatcccaattctgtaaaaaaattatagaaaaatctacaaggagattacacacacacacatgtaattgcattggtaaaattatggatgattttattgtgcttttttaaaaacacattttttagagcactgtaaaattcagagtaaaactagaagagggtccagaggtttttcacacaccctgcttccctacacatgcataacctaccatgcctcactcccccaccagagtggtacatttgttacagctgatgaatacatcaacacatcattatctcctgaagtctataatttgcattagggttcactcttggtgttctacattctgtgggtttgggcaaatgtacaatgacatgcattcaccattatagtatacagagtagtttcgctgccctaaaaatcctcggtgctttgcctattcatccttcccttcccctgacccttgacaccactgatctttgttgtttctttatttttttgtgtccttcaaatttcttacaatgtgagtgtattacttttataatttggaaaaactaacacaaaatactgggggactttccttgagatttcaatattccaagtcgctgaaacatctcgacagcctgagaaactaacgaaacaccaggacactgaagttctccttgttcatcccagttagtcctgggccttcatgaagggaaaggtgggctcagcctttcctgagctgacactctgacagtgatagattgctcaggcctccgagccgaagtctggaccctgaaagccctgctcttctgtctttatggctctgggaatgaagtgggctttgctagatctgagcttggagactgatctgataggcctagacaggccacatgaaataagaatctaagctctttccctggcttccacctgggcaacaggaaaaggctggtcttttcagcagatggcctgattgaaggtgagtccagggcttggctcttccttgccggcagaggcccctctctgtggtgactgcctggtcctataattcttgtttctggtgaacagggacatctaattaagacatctgtggaagagggcctaccaggaaaaggtttttttcccttaaatctcaagtgtcaaaagaagataaaaaaatgctgtatacctccttgggccaagagtcagataattgccctttcatgattttactatagggggctgatttttcccatacacaaggaaaatggtacatgacaaaatcacttctccaggaggaaatctctggaagtttctcttttagtcccagaatgatacaactattgcaaatacgcatggaggtcttaaataagtcagctaatttccgttatcatcattgatcatcttttctcaaatatcacataaaatgacatatccccaataagttcttccttggtacctcagaaacattagccactaaaacacaacctgctcagacaatttggaacctcagtgaatgaattgtatcttcttctaggttcctcttgaagttccagataaaataaaccctgtctctacaaaaaaagaaaaattagcctggccatgatggcatgcacctgtaatcccagctactcaggaggctgagacaggagaattgcttgaactcgggaggcagaggttgtggtgagctgagattgcaccattgcactccagcctgggcaacaagagtgaaactctgtctcaaaaaaaaaaaaaaaaaaaagtctctaggtaaataatttggggcaggatgctttttaccactgagtttcttgctgggagtttaaaatctcagagctcctagtttcacactttcctccctagtatgagaatgatctatgcctgaatatgcctcctctagtccatagaagatataagagttatctgtgccttacacagatgcctgaatatgcctcctctagtccatagaagatataagagttatctgtgccttacgtccatttcaccaaggggctatggactagcatggctgagtggcgtgctgggcagggcatggacgagccagcaattttgtggagtcttggcctgctgctgtccctgaagccttcgggaaggcacagctgctcctcatccttgctttctggtgctctgtgcatggagtttgctgagcttatgatccaggggtaactgtttttccccaaccatgctctgctttccatctatcatgacctgtttatctcaccagtcctcagttaaacactgaaaactcgataatccttccagtttctctttttgctgtgacaggagaaaagattagaactacattgaagaaactctctcttcaaggtccctgttgcaattagttccccttctccttcagctgtagtacctctaatctatcttgttttatatacatttaaaatataggctgggcggggtggctcacgcctataatcccagcactttgggaggccgaggtgggcagatcacgaggtcaggagatcgagatcatcctggccaacatggtgaaagcctgtttctactaaaaataccaagaattagccgggtgtggtggcacgtgcctgtagtcccagctactcgagagactgaggctcaagaatcacttgaaccagggaggcggaggtctcagggagctgagattgtgccactgcacttcagcctggtgacagagcgagactccgtctcaaaataataataataataataataatagtaataataataataataatactgcattctttttcccctgggcatatcctaagagctggaattcacctttggatatccataaagcttttcaataaaatgataatgcacagtaaaaaaaaaaaaaaaaaaaaaaggtctgactctctgagtctttgtattgaaagcttcaggaacaacctgggagaaagaaagcccatgagagacctttcatgggaagaggatgcccaggtgacacacttggagactgaggttgcaggctgaaggagataatggcagaccatactgagttaagaatagagtatacttctgtgctgggtgtggtggctcatgcctgtaatcccagcgcttttgggtggatcacttgaggtcaggagttcgagaccagcctggccaagatggcaaaaccctgtctgtactaaaaaagtacaaaaattagccaggcgtggcagcacactcttgtaatcccagctactcaggaggctgacgcacaagaatagcttgaacctgggagctcgaggctgcagtaggctgagattgtaccactgcactccagcctgggggacagagcaagaccttatctcagacaaaaaaaaaaaaaagaaaagaataaagtatacttctggaaggtggcctgaataataaatgctaatatttatcaaacatttactgtgtgccaggcactgttctaagcgttaacatatctaactcacttaaccttcataagaacatttgttatctcacttagggacactgaggcacagagacgttgttcaaacatgcccacggttacagagctaggtagtgttggctctgggaatcaaacccaggcatcctggctccttaagcaacatgctctgttgcctgatccaacttgagttgatagtactcaggacatttgtattgaatatgagaacagaaattaagtatggtaaccttcacctctcatttttgtaggagcttctggccttgggctggccagccaacagcagagaggaatggcttcccattgataaatgtgtcagggaagattccacatctctcacagcccaacagtgggcctatgggcagcaggcaccactacagcagctccgctgagagtgcagccttgctcattccacaggaaccaaccacaccaccaggaccactgtgtcctctctctctataggaaagactgcaggagttttgaggttggatgattctggattgaatccctggctccacaggtcacaccagtggtatataatctcttaaggcctcagtttctcatgtgtaaagtggtgtgattgtgaagcttagatgaaatgtgtaatgagcagatgcctggcaaatatatcttcaagaccatttgagctggcttcctttgctaacttattagcaactcctcaacttattcaaaatagtgtatatatgttgttggaagtcaacaagggcacatttttaccctcttgctctgttcctctccagacatccactggtagagtcatctgcacctcagccttacagccacagccacctctctctgtctgtctgtctgtctctctcacacacacacacacacacacacacacacacacacacttcccctgagaaggctctccactttttctgggcaggcagacatatcagagataaacatctagcaagctgtcccaagtcctgacctgctctgttctagggcaagtgaagcaaaaacctttacccagcctcagaatcccagaacattcaaatgacaggagccccagagatggaggttctgaaggccacaggaggaccagatctgcataagattgcacaattatatgaagacagcactgttggttaggtttccccacttctccccaaggatgaggtattccctacttttcccacaagtcttatattccaaagacttaccagtatcaggggcacaggcctcgtctgctttggtggcattatctgcattctgtatattagtatctgaggaaaaaaaagaagatttaaagaccaacccaggccctctagcttcttggaagggcaggtacaggacatccccatgggacctggtttgccttgattgtgtctgtgtctcggggttatgtgtcagctgggttcatgctcgcttattgggattggctgtgtctcccccattatagcccaagctccaggaagacagggatcatggcttccctctcctctaacacttccaagctagtcccagcctggacacagaagctgaatgtgctccatccgtggaccgtcagcctttgctgaaggctctcttcccccaccatacattattttgtgtctcctctttccccatcctgctctttgatccatagtggcaggaattatgcctcctgtttattcctcttgctgagaggttcatcagggcttcccgtaaggcactatgaggaaaggcgtccctgtcccttggttcatgttcgcaccgttggggcagttactatgttcaggggaccctctaggaatgcagtctgtggctgtggcaggggatgagagctgcgcaaggtcttcccatcttggggaaagctctgtgtacctgcgctgttggcctcactgttgctggctccctccgtcgggtggtcagaggtctcgtgtctgggcttctggctgaaggccaggaagaggtgagtgctcagtggctggggaaggtccacctccaggtacgccctcatgaacagcttgaagacatcatagctaatcggctgagaaggggcaaaagggcaaagtcagtggagagaagcaaagggacagagaggaagagagaaggaaaaggaatagaaaagctggcaggtgaaaggaatggaaagggaggcagtaggacatggaggagctgatggggacaggaatgaaaaggccagggaagtgatagacaatgagaggcacagggtgcaggggatgggtgtaagagagagaaaatgttgcagttgcatattggggcttggtggggcacagaaccagggcaggctcctgtaataagaaatgatattatgtaaatttagataaaaagggacatgttggagagtgagccttgggagtggaggccaaagtgcagggctctgccttagtccaggcctgtgtgagggatgtggctctaatgagcagggacaagatctgtgccctagaatcctagttaagatgaagaaggatgcagttgaaaatatgatgcaaagaaatagttcttctgtggtatcttggtttccctcttgtaccatgacggatgtgatgcctgagtattcaggtctcagaaagtaggaaagacctggaagagaaaagaacaggctccatccttcatgactttcatagtcctgatcttccctggaaaaaccctcaaataacaagggtgggtgtgtgtttctggctcagctgcttctcaaaacatgtccttgtgaaggttttaggcaccaggagaagagcaggaagccaaggacagaaggtagaaccaagagatgtgccaaaaactagaccctcttcctgctgtgtctctcccagtaccgcctggcttctggtcccaggctgggagcagctatgccagaaagggctgctgcactcagcaaacactcaacaacaacagtttgcagtgagtcatcactggcttgtgctttgatggcatcagattcttcatcaaatcggcagatgctcctggaaatcatttgaggaagcactactctgagatctgctgtgcaggcttttgtgaataatagcagccatgagaataaaatccctttgcaggagcctacttgatgtacccatcaaaatgttggtagcatttaaccccttgtctgttctgggagatctgggagacgtcccagaaccagagactggcttacatgtgtataaacaagtttgagttcaaaatcttggccttaaaagcgagtaatggcctccccaccccactgaggggctcacaaataaatttctgtttagcaccaggcttggctgttctatccgtctcctttgcagagtgaaggaagtctgattcagctggacagaggctcttaccagattaggggaactccaagcaaatggtggactcacatttcttgtgacagctacccatctctctgttccttttctgtccccgagtctctgtgtctctttatttcacactctttctgtctctctctgcctctataacttcattgcctcagaatgtcccttcctcccacatcctcctcctttttcctaatatacaataacaaaatcttttcttcctcctctcttttctttttttcttcttttctctttctttctttctttctttctttctttctttctttctttctttctttctttctttctttctttctttctttttttttttttttgagatagagccttgctctgtcacccaggctggagtgtagtggcacgatctcagctcactgcaacatctacctccttagttcaagtgatcctcacgcctcagcctcctcccaagtagctgggattacaggcacgtgccaccatgcccggctatttttgtatttttagcagagatggggtttcaccttgttggccaggctggtcttgaactactgacctcaagtgatctgcctgccttggcttcccaaagtgctgggattactggcgtgaggcaccatgcccagcccctcttctccaattgtaacccacccaccttgatccttgattccatcctcgctggctctgattgcatctccagcattttcttttcatttacctgcaagtatgttaaatgtccactattccaaagaaattgctgtctaccagatctactggcccatccttctcccctttcctttcaaatttctccaaacagaccagattagcctcctcatctccttaatcccattcggattggatcctagcccattacctctgaaactgctttgttgaaggtcacagacgtgatcatctctttttagactgtctcatctttggcctctctgcaacatttcatcttctcttctttttaaaactctctattttccatggaattgttctgttttggttctcttcattctctactttgatttgactgaataatatggcactgttcttcattaatttatttctaaagctcttttttgcattgtctctttgtaccactttaattgacaagtagtattttaaaaggtagttttcagttccaaagtgtactattaatctctttcagctagcatcaaatgaaaactatcagaataaaatatttctggaaagcagactgtactaaatgatctaataaaaagaaagtttagttaaacagtctaacataatgctgtaaaaaaccaaagccaaaagatcatgaaacaagatcagcatgagattcaggaaacctcgtgactggtctcagaccaagcgcatttctcccctttttccaatctgtttcttcttcagcaaattgtgagtgttgaactagaagatttcaagttctaaacttcaattagcttgctccctgaaaaccagctcctcttcctgactccacaatttctgttaatgccaatgacaccattatgctcccaacattacaggctgagctttgaactgtcagttggctgagactagttcttgtcccttccttctgtccactgttcttctgcaacatctgtcacatccagaccttttctatgtccattgtccctgctgccatcaccaaaattcctggattctgacttctgttccatacatctcacctgggccattgcaatacctctccaaggcttccttaaccccatgtccatctgttggtcctcccacctatcttgcctatccttgccctattgatcttcctaaagcacaactctgataaaattgcttctcttctcaaaaactttccatgtgacgggtgcggtggctcacacctgtaatcccagctctttgggaggccgaggcaggcagatcatgaggtcaggagatcgagaccatcctggctaacatggtgaaaccccatctctactaaaaatacaaaccattagctgggcgtggtggcgggcgcctgtagtcccagctactcgggaggctgaggcaggagaatggcatgaacccgggaggcggagcttgcagtgagccgagatggcaccactgcaccccagcctgggtgacagagcgagactccgtctcaaagaaaaaaactttccatggtttctaattgcccatggaactgaattgagattaactgaggtactactgtgttcttacactatacattataaaatatttgcaaaactaaattggcaagtggaaattagatgaatgtaaatagaaggcctaatatgcagtgttctacagtccagtggaccatcctgtgtactctcctagacctttggtattcatagcctccaataatcccctccaacctagatttgtagttacttcaagctctgagatgattctcatattctctcctattattccccatgtgcgtgtatgcactctgtccatgctgacctctgtgttctttcctgagcaaccctccatgcactctaccctgcatgaactgcttccatctctacatgttcaagttccagtcatgctttaaggcccaacccggattccactttttccagaaagccttatgatcgtctgtccctgaatttccctacttggcaccttggttcctgccttgtgacactcatatgtgctgctctgcattgatatatagttgtttgtgacagaccttggttcctctactcaatccagagctcctggaagtagtgagaatgtctcctttcatctttgaatcccccacaccacctaccacagggttcttcataggtatttgaatggatgatgtgtcctaatcagtgcacctgaggaatagcctggtgcctggtccctggatgtcatcaactactatgggatccattcagtctatgtatagattgaatggatatatgtatctccactcacaatttgctgaagaagacacagattggaaaaaggggggaaatgtgctatatatatatatatatatatatatatatatatatatatatatatacatatgtgtatatatatatatatatacatatgtatatatatatatatatatacacatatgtatatatatatacccacatacatatatttatgtgtatatatgtgtgtgtatatacctatatctatatctatatctatatatctatatatcttgagcctcttaagtgcagggcacagtacagtgctgggcaccaatgaattaggcatgagtccgtatcttcaaagagtcagtgttatataagaggtaaagatattgaaataattgcaatgtgtggtcatcagtggcgagtgccataggaaaagagctgacaaactgttatgagaacttagaaaataatactgatggaactcatccaaccatgcatgtccccatcctagagaacaggatgcacagaataaacccagaagcacagaacatgcaaaccagaagagtctcagaggggactcagtcttctgatgcctccgaggctcaggaaattcagtgatgagccccagcgagctagcagcagagtgaaaccagaagccagacctcctgactccctgtccagtgctcctgctactatatctgtcacagggtccagagctggcatagtgctccctgacactccctcccagtatcccatgttcagcaggcaaagacatgcaacgatgtgccacactctcaaggtgatatctgggttatacaaaagttctttaaaagcacagcccaggaacagagtagctgcttagtaaatgcatgatgagagactaactagggagtggctaggggtcatgcccaaaccagatgaccaaccactatgaggcatgctggcaattctctgagacctggactaacatcccaggcacactcatggttcaggccaaaggaactctgtttttccccagcagcttttatgcaggaattagctgggcaatttgctcctgctgcaacacacttaaagagagtgtgttaatccttacacagaccaagaagagagaactagatggagagcttagcaggcatccggcactttcattctcaagacagcagtgtggggaagaactgttactgtcattctggggataaaacaaattttgacaacataaataacttgctgaagatcataaagcgtgtggcagagctgggctttgtgatcaggtgtctgggtccaggctcacagtgccaccaagccacctgcctcttttgcttttctgggttttgcccactctctagctgtctgccaccactctattctccagagaatcacttggtactgatgggcaagcgcatgttcatcacggccagatgcagctctgccactctgcaaagttttattcccatcctacctttgctagcaatctgccccttcccacagctaactcgtttctcattgagacattttagcagcagtaagccatcaaactcaagagaaattaaacccttcttatttccctaaccctgtgccatgacattacacctactagaagtcagctgcactgtgtgagagaacgaaatcagagtgacagagctccctgggacccagcagtgcctggcattacaaaaagtgggggccagccccgacagaggcgagggcggctgcgtgctcatagcagccaagcgactccctgcttctgaaagctcctgtggcctccacacctgcagtggccctgaccaaactgttcctctcccactcatcagccccagggcggacaagctgattagcagccgccgccaggctttgttcccgtgtttttggagctgggggtggggggtgtggggcagtgagttctttgctggctctgctatcttctctgcatggtttctcctcaggaatgttctttgaaatggtgcattctcagtctcgcccctgttctggcaaccttcttcctgcttcattctctctgcaactggtgtattttatccaaagccccttttaggtgtaccttgagggcacaggctctgttgattcatttccagtgtccaacggagaaggtgttgactcagttttgttcaatggatgacaacgtgaataagaaagtggccagtctctccctaagtgaatcctgcagatcagtcacttttctgtggttagtcttcataaaaggactcaggagcagggaaaagggaattgagttaaaaacattctggggaaaggggatggaagagggataataataggtacagatttttaagtgcttgtagaatgttagccactttgcaaagatcctctcatttaattcactcatccacaaacttcgaggctttttttgttatgtacagtttatagatgaggaaagtgaggctcaaagatatgaaatattattcaagaccacttgttgatggcagaggtagaagtctaacttaagaccatgtaattccagggtcatggctttcaaacctgaccctgccagtaggaagtaagtcctggagggcaggaactgtgcttctatatttttatgccttctacagtgcccagtacagtgcatagaagcccaagaaatgttagagtcattgaatttgaaagtagggggagatcttgcattcatttattcagtccacaaatgtttattgaatgcctgctataagccagatacttttccaggcactgaagacacagcagtgaacaaaaatatgctagtgggagagacagacaattaattaagtaaattatatagtgtgacaggtggtgagaagtacttaggaggaaaataatgcagagcagggggataggaaatgtcagaaagagggcttcaagttttagatgaagaaggtgatgatcactgagaaggtgacttgagcatagactggaaggtggtaagataatggacaatgtgatgtgctgaggaggaacattttaagaaacagtaacagcaagcacaatggtgctgaggttacggtgacactggcttatttgatagcatcaagaaggctaatatgctgaaaaggaatgaagatggggagagtagcaagagatgaggtcagagagctgggggaggtgcagcttgtaatgaccttcatgtttactctgagtagggattgggggaaccatgggagattgtggagtagagcagtgacaagctctgacataagttttaacggattgctcaggatgtgtgtgaagaatagactgaagcagcaagggcagaagcagggagatgagttaggagactcttgcaataatctgggcaaaatatggtgatgactcaggtcgggatgctagcagtgcaagtggcgagatgtgtctatattttggatacattttgaaggtagatctaacagaatttgccaatgaattggatgtgggatgtgagaggacagaagttgatgatgactgcatagtttcaggttgaataacttgaagggtagagttgtcatttactgaaatggagtagactgctggaaaaacaggctttataggggaagattaaggacacatcagtttagctcatgttaagtttgagatgcccatttgatttttaagtgtaaatgtcaagtagaaggataagaagaaatcaggagaatgtagaatgtagtgaagaaaatggaggatgacttgaccaaccgtgtccagtgttgttgagcaaaattgctattggatttagccatagggaggcccttggctatcttgactagtgatttgagtggaagagtgaaggttatagactgatgcaaggcatttcaagaaagtaggaaaaagagaatttggaggcaatgagtatagagaagtattttgtacagtttcgctgtaaaacacaggagggaaatgaggtggtacctagaggaggaagtggagtcaggaaaatgtttttaatatagaagaaataacaggatgtttacatgttgatggaaaaataaaatatacgaagaaagctgatatgaaggagacagaggtagagatatagagaaaaggagggacgaggagggagggaaagagggagtctggggaagatatgttgctgaagcaatgcctgtaagtaggccaaaagaggatggggttgagtgcacacgtgggggagttggacgtagataggagcatggagaggtcatctctggttatagaagaaaaggtacagataggtgggcctatggggtgagggagcttgtgaaagatctgttctgtttgttctattttttcagtgaagcagaaaactcagttgttaactgaggatgaggagaggaggggtgagagatgagcagaggagaagtagtggtagtcttctaggacagtggaatgagtgtatgggcttgggaaacatataatgccaggtagcacaaatggctcacttgagacttaagaggaaacatgctgaggagcaagttcttcaaggcaagcggagtctccaagagggaaacaaattatggaaaggctaaaaaacacaggggtttttaaaggcttaaaatggaaatgttcttacctcatgtgggtcatattgtttgaggctcccaccctcattaaattcagtcaaggcatcttttatcttcttggaggaatctgaagagacacaattcacatgtgaaacactggcaaatagctaatggaagctgggccaagtaaattctccctgtgtaaccatgtttatgttggagctgcccctcagtcccagaaaatctggagaaatgtcaccctcttctaccctttgtcctctcacttcttcttttccatctgacttcccccctgcatctaaattatctttctgaaacacaaatctgatcagatcatatccctactcaaaaccattcaagggctttctgttcccccaggataaagcttaccattcttagcttagaagataagcccttaacttggaataccagcccttggtgattttatttatcctattcctcatttccctatttactctacgtttcagccatatcaagttacatttccagacatccctgaacatattgtgcactctctcatgatgtttcttctctgtcttgcaaatttcactcattcttcaagatccagctcaaatgtcaactcctttgtaaagtcttcctttgcaccagtcagagttaagcattcccttcattggctcccacgtgacttgtacacaactatgtaatagtgcttgtcatatagtgttataattatttattaacttgcctatcttgctcatctcctgcttcagctttaccttgagagctgttaactggctggtgagtctttgtctatcatactaaggtctgacgtgtaactagggctcagaaaaacaatatgtagatgagtatataaacatctgagtgaaaatttcaaaacattaaaaattcattaagtatgtaggatgagtgggcattaaaccccataaggctctgtccttggtgctgaaacactgttgtacactatggcaagatagtttcttctacttctggaatcttgacaactctgtcccttttttttttttttacctgatttttattttttatcttgatggataaaattgagctactcattctgacacataaaacataacctcaattatgtctcataattagcatggttgattttatgttcccatggtatttctcacatatttctgacagccagaagattttcctctgaaagttgaggcctccaccccccgccatgatttccccttaatgttccctctatgttgcatttactttggaaggggataaagaaagactcagataattcatcaaacatggtgttttcgaaaatgctgctttccataggaaatcattcagaagcaactggaggcaagactggctgcttctttttggaattttataaaggaattgggaatccagaaaagagactcaataattgttattaaaaacacattatgaatgcatcttgtgcagctatcagcactctagacatcaaagcaaaccagggtttctctgaccttggctatccctctcttccaatattgtgggtaattaagagctttccaagctccattattgttgctatttaaacatctgagccaaaggacgatgttattaaaagctcacacagtgttttttgttgcccaggctctttgtacagagggttaatgtctcttaagcctaggtaaagtagacatattcgtgggctgggctgttctccatggctttgctgacttggattcaatcaagcagaagttctaatcatttcaggattgagacatattgaaatacaacaggaaaatgcttctgttgcctaaaaatggaaatttctttctgaaattcaaaacagatgttgaaaaactaatagctcagtaagagccaggcagcagatgctgtcaatttgggctgcttccattcaattcagaaaacactaaggagggtaagatgcggcaagatactgttaatggactagtgggaaagatgatctaaataactgtggtactaatagctgtcccttactggagaccttcacctgcatagtctcataaactctcctctactaatccatgcaagtattttcttcagtttacagatgaagaagctgaaattcagaaaaattaattcgacttgctcaagagccagggttgtaactcaggtctagtctggctcaaaagtgtatggtcttttcccttgagcattattcactatagcttcctaaacatttgttaacataaagaaaggtgtaattaagggtgacacaatgatatgaagttctatgaaacaccaagttgggaagaagaaaaattaagatgaaagtggggtaggggtgggaactgaggctgccctataaaggaggtagcatttgagctgaggcataaagaattgggtaaggtttataaaggcagatatgaagtggaaagggtattctcggaagagaccaagggagcaacggtgcagagatgggcaccataaaacgtttaggacaagtcagaaccagagagtcatttgtggctagatttgtgggggtcttgaatgtagagttaagaacattgatttgaaatggttaaagatttttttgagtggtgaaataatataaccagctctctgttttctaaagaccactctggaaacaggatgaaagagaagttagaatgagaccagagctcagttaacatcacacatatatgttattccacaagcagcttaattatttaggaaaacaaatcctacattttagaatctattttaatgggaggttgttagctcagccaaaatggctaaataaaaaaaataaaaatctgagaacatgagtacccctggtgtgacttctgcaagaagagtgtagagttagcattttgattgagaaccagtggagtaatttcaattgaatatatgatattttgatgttctcatctcattttggatattccaccattcactgtagcagaattcctttgattctaaagagctgctgctctattttaaaaatcctgctttatatttaaatgtgtgatatatatacacacataaattcatcatatgttcgcataaaataaactgaggttttaataagaaaaaaatagaaaagacatttattttaaaatatctgattaatagcctgaaattaaatggaaaaaaaaaacacagccgggcgcggtggctcacgcctgtaatcccagcactttgggaggctgaggcgggcggatcacgaggtcaggagttcaagaccagcctggctaacatggtgaaaccccatctctactaaaaatacaaaaattagccgggcgtggtggcacgtgcctgtaatcccagctacttgggaggctgaggcaggagaatcacttgaacccaggaggcggagcttgcaatgagccgagaccgcaccactgcactccagcctggcaacaaagcaagactccgtctcaaaaaaaaaaaaaaaaaaaaaaaaccacacacacacaacaagaatccaggaggtttctaactagctttccgtgaggtggattactcatcacacatttacttcaatttgctttatgggctttcataggattatagtatcaataccctttaaaaaagggaatcaacttaattctcaaatttgggacacattactttctccttggatgtccttatatactttataacagttttcttcttaatagatgtctgggttgggtttctttttccatgaggagtaagtaggtattatgcatgactaatctgcttcagtgacagctgctttattctgtttcatcttaagacagaaaagaacaacgagggaatagcatcccttggtcttattttaggtgtcatctgtgggtccaatagtataacctcacagaaaattcctttgtcaaagcctttaccataataccagcactagattcagaggacaccttgttccatttctgcctgtagaaaatagggccatttccacagctctttgtaacaattcccattttgtagagtgcttattatatgctagacgctgtcctagtcaccttatatattttatttaaatccccacaactaccctctaatgtaataattatccttattttagagaagaaaccgaggcttatggaatttaagtgattctttcaaggagacagctcgtaagtcacacttcttaaacatttctaaatcataggccatggttattggattcactggatacttgaacactggtaagttagaagccaggactcttcctctatgaaagtggctctcaaacctgcctgcatgttgaaatcacctggggagctctatacacactgtaacccaggtcttaccccaggtgaattaagtcagcatctcttgaggaacccaggacacagtataatttaaaagcttcctggaattcagatgtacagtcaaggttgaggactgccattctaggacatgattttattgttgtaaatgaagactgtcctaaaaagcccctgaacttgaatacttattgccaagggaaaaaaaagcttataacttctaaatttaaaattgctgtgcttggcagacattatccattgtttaagtggacaacaccaaagaactctacccaacaggtcaacttgttcagctgcttggcaaggtaggagcatgttttgcattcacccagactgtcaggactatccacatacagttctgtcctaaatcgggtgttcagaaagtttttctctttgatcaaggttaccagtgccctaagaagttttcagtccaaaattgtcttctatactttatgtgccaagaactctgggacctaaaccaagcactgttcctagtgtttgagcaaattcaaagccttttaaagggaaaaatttggccctacacacagacacctttgttgccttgtcagtgtgggacaggggtgcgttccatctgaacaagcagacaaatcagagacttcagtgtttacagcagaatattagttgtgctgccaggactagaccccaaagtttatagtctgttgtctagttaagaacacagagtaggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcggtggcgggcgcctgtagtcccagctactcgggaggctgaggcaggagaatggcgtgaacccgggaagcggagcttgcagtgagccgagattgcgccactgcagtccgcagtccggcctgggcgacagagcgagactccgtctcaaaaaaaaaaaaaaaaaaaaaaaaaaaaaaaaaaaagaacacagagtatttgagcattagaccattaaactgttaaactccgaaaaaactataaatcaacattttcaaaagtgaatctgaaaatccatatatgagagtggaattctaaggtacatgataactcttcattcctcaaagttctctatgagcttctcaaactgtaatgtgcgtatgagtcacattgggatctggtaaaaatgcagattctgtaggactgggccacagcctgagattctacattctgaataagatcctaagtgacaccaattttgcaggttcacggacctcacttgatacgcaggctctaagcaatgtccctgtggatctggggctgactgctgaggcttgcctgtcacaacccagaaaagaccacgatgccgaggacaaaggaacatactcaatggagtagaaagaccataagtggtgggcagggggagtcactgagacgaggggaagggaaagttggcgcatgagcaaaaaaataaaatctagattttccttcttccagtgaaggctgggatgtaagaatacattttctaattactctaggaagttatacagtgagatgcacaaaaacaagagcagagttttgtgagggtcctgaaaaatgtcaaaacagaagggccagggccaagagcactgcatcaaaaggcccacctcttcagccagctggagtcaggcctcagagcagcacgtgggaagcacaggggagaagcccagcttcataagcacggatgtacttgctacacacatattctcccatctaaactttgtttctgctcactgttcatccccagcatgcagcccattgcctggcaaaaaaaatagatattcaagaaagatctattgaataaatgaaggctagcaaagggattgagctggtcacacttgtcccacatgtcctatattctcaggggtatggaaagaaaaggtagactagtggttatcaaccttggctgcttattgaaatcacttgcagggctttaaaaaatactgatgcccaggccccttgcctacaaactgtgattaaatgatctgggaggtgtgggcagaacattggaagtattccaagccttccatgtgatttgaacatgagccgaggctgaggaccactgacatgtggaagtgatggctctgacacagatgttacatatgaaataataagaaaagactttatatagaagcagaggaaattggggtcaatagcaataaaacgttttttaagacacaatttttttgtcataaatgatctgaatcactggtatgacttatttgtgtaagtaaaatttgtattgctagaacattttctcaccttttctccaaataatttggcttcatcagtcgtatttcaagtgaaggtggaggaatggatcagacaacttggaccatcttgcaactaaaagtgtggtccctggaccagcagcatcagcatcacctgggagcttgttagaaaagcagattctcagcagtaccccagacctactgattcacagtctgcatttcaacagctctccaggagattcatgtgtacattaaacattgagagctattgttccatagaaattcctccctatccgtagattctgtgactcctggtgggcagagtcctactcatcgttaaaagaaaaaaaggtctgtggtgctgaaacacatgtaggtgagaaatagttatggctatccttccaagatagaagcaactagatatgacccttcatgggcccaggacttcatgagcatttgatcaagtctcactctactggccagcataaatagcaaggttttagtgacatttacttagagccttctatggttctacatatcagccctaaatatgttctctgactctgacagttttgtattttgaactgtaactacatcttaaagtcagaaactttgtcataatctgattcgaaagaaatatatttcctaatagcacaatttactgattgattctctttaattacatcttaaaattttgctttaatgtaatttaattgacatatacatatctgcacacacacacacacacacacacacacacacacacacacacacacacacacattaatgtatgtttgaaggttgagctccagtgggtactttttgtttaatttgttgttgctgaattgaagcaaatgagtttgtactagaattgagggacttttggttctaatttctattttactatcgaccttctttctatatgaccttgggcaagtcactgagctcttctggacgtagtagtctcagttttaaaatgtgtaatgcttggcattgatatggttaagatttttcccaacttaaaaattctggctgagtgcggtggctcacgcctgtagtcccagcactttgggaggtcgaggcgggtggatcacctgaggtcaggagttcgagaccagcctggccaacatggtgaaaccttgtctctactaaaaatacaaaattagctgggcatggtggtgggagcctatagtcccagctacttgggagactgaggcaggagaaacgcttgaacccgggaggcggaggttgtggtgagccgagatcgcgccgctgcactccaggctaggtgacagagtaagactccgtctcaaaaaaaaaaaaaaaaaaaaagttctacacagtccaagcaactgctggctgatgtaggaaatgtttggtttaatttcttagagaattaaaagtttaatggatgcttcttcagttgtttttccttttttctctttctgaataaatgaatagtttctgtccttgaggcatcatggaacttttaaggaattaacaaaaaattgaagaaaaaatgcccaccccccaatggccaccagcaattattgttaggaagagggtcagtaggcggcatccccacatgcacacaccctctgcggtagaaatctatttaaatatagaaaccaagtattggaggagctaatgaaggtcatttaatcaaccagatgactaaagctgttatctcccctatagtgtccaaacaaactctctgcccagacagttccagggaaaggaaacccagtcacttttaagtcaattcgattccatcttgggcagatttgaccactagtaattaatgtattccacactttaaagacttcctataacttcctcccattagtcctagggctacctcttgaagccattcaaaattaactacacacctcttcccacaacagtactgagctattttaatacaacgagctcttcttcacctttcccttcccttctccaacaaatatgcacagtatcttcatttctccataatgtggttgtgaggccccttaccaactctcaaacaagttccaggttgtccatgtccatcgtaaaccatagtgaccataaataaattcagttctctagagaggtctgacggtctatcagggtaggctagaatgtggatatcagtttgccttactaggcactgtgagtctatgaatacagcctaagattgcaatgactgatttggttagatgaaatagtacaaatgtagtaaaaaaaaaaaaaaatctctgcaaccgctaacagctatgcttctgaagagtacagaatgatgtgggaatgactcatgatcgatattgtgtgctagccagtttccaaagatggctgccataaattctttccctccctatgtgagtccctcctccctgaaatgtggagtccgttcctctacttcactgaatgtgagccaggcctgtgactgcactgaccagtggaatgtggagggagttccgttctaggatctctgatcccaggtgctaaaaagatctgacagcagcttcttctgtgctcttggagccctgagctgacatgttagatttccaggttaccctgctgaaaagaaaggacatatggagaggccctggaagacaagaaagtgctggagaaagaggttccatgaaggaacactaaggtcccaccatgtgagtgaatgagccatgacggatggtctaagtcctcacttgtttgaggcctcccccttgaaggtccaaacactgtggagcagagatgagtcatgcccaccatgtctgcccaggatcctgacccacagactcatgggaaaccaaaatggtggttgtttcagcacacaagttttgaagttgttttgatgctgcaataggtaactgaaacatattgttaagggaaagaaaacagcatacaaaatagcacaacatgcatattctcaagtttgttttacatgtgtatgttgtatatgtgtatatatgtatatgtgcttgcatattttgatatctatatttatacttatatttatacataaacatgctagtgctggttatcactggaaaatagaatcatgagtagctttaaatttcatcgttttataatacaaatttcttaatatcacattagctcttttgataagtactttacattgtagattgataacaaacttactgtcagctatatgtgtgtgtgtctgtgtgtatatgtatgtacgtttacatacaaagttaagttacttgtctccaagagcagttttaagatgccccaccctcaccctatagaaggtcaccagagaaggtgccaactttacactatataaatggaaaacaacaagagcctctcctacctggtaaccccactggagaaagttctcaattctcaggctgtacacttcattattttgttattgtaaagctcctgtttatgtggttacggaagagtggttgctatggcaatgcaatccgactgaacaccagaatgtgtctaaaattggtgggaatgactttttcagggtttcctctgaggattaatcattttgtaagaattgtatctttttttcctctcctgttcgaacaacagtagcagagtgcctcatccagtcccgcgacatggacaacacgagcaagggtcagagaaggacaaaggtaaatgtttaaagaaaaggcccaaccccaacacaaccctcttctactgaatactctggttccttttcatccctccgcctgctcagcggctttgctgcatttggagctcctccttgcctttgcgccctccatgctgcactcttttccacctacttgcctttctggttcttctctctgtgtcttctgctgaatcctgatagaggcataccttaagcctcattctccagcctcttcttttctttcctaacattcctactgtctgagtgccttcattcattttctttctctccttgccatctcctcgcatgattcccaaaccagagctatggactgacccctcatttccactcaaatcccatcacacaccctcctggggcctacaggacatgtttcttagaaagcaggattccccaggatggggtcctactttcctttctagttcttcccccaacactcctgatgccaccaccaacacatgctctgggctccagcctgggagctgcttgcagttcttggaagctcccatgatgtcctccaccctgccctgcccttgcccaagccacgtcctctacccggaatgcccttctccctccctgccctacagttcctggagtctggaaacaatgcgtgcatcaggaggcctcccaccaggctgagcggggccttctcctcccatgctgcccacttctgagcaccggctatactgcagcacccgtgcttgagtcctgtttgtcttcccctgtgaggcagtgatctctttgagggcaggaactgtgtctcatttattgctggatccctggagcctggcacataggaaggcgtagtggatgtgttatcaccatctccaaatcaacaatcccaaacattccccatcagccctgcatcctgatgtcattttctacagattcagtctgcaaggtatctttgatggcttccttttgttgtacgtgcattgatgatatttccaccacagtttcccacgaattagcatttgttcatggccacactcaccaccttagctctttggctcagactaggtttcctccaaaggatcctgcccagttccctggcctggaaactgcctgatccaaggcaccctgcacacagtctccagattcctggctctaaattttgcccacactttgacacacaaggcccaagacctcctgctatccccacgcctcctatgtcctcctcattttctgtgccttctcaccatccagcccagaagctctccttacccacccctgcacaccacaggaatgcttagtgggtgtgttatcaccatctcaaaatcaacattcccaaacattccttttgcttccatcgttccccttccatctgctgctcacattttaaacctctttcctccatggagtttatccagctaaatcctctgttatcggttcaaccgtgccctaaacctcaaatttatgtgttgaagttccatccctcaataactcaggatgtaaccttatttgggttgttgcagatgtaattagttaagatgaagtcatgaccgaatggggggatccaggccaataaggttgtgcgcctaggaaagggggaactttggacacagagatatgcacacagggagaatgtcacgtgagggcatgcagggagaatacggccatccgcaagccaaaaacacagccctgggatggatcccttctccacagctctcagaaggagccagcgccgctgactccttgattgtggacttctagctcccagaactttgagactataaggcttagagacaataaacccacgctggattgaaccaaatagcaaacaacccccataccagtttcccttggtttttgatccccttctcgtttccacgcttagtttatccagctgtaccagagctgtttgcctgctgccttaaagcagttctctgtgtcacgagcacatttctgatgccctaacaagattctgattcctccagggtaggcctctcctttgtgcttcttcttcatccctgacagggcttggtgctttgctgacctacagagctagctgaattaaattgaatttaccctggagggtgattttttgcttcttgtcaatatattagagtttttctaaacccatgggggtcagatgagagaccacaggctctagagtaccaggagggtgacaaaccattagccctatggtcccctgttgacctcggagagcattcggagtcacaggatgctgggctggaagggaccgcagggagagaacacttagtccaaccctcccattgtatagaagaggttgctgagacccagggatgttcagggatgtcacagcatagagagcaagaggcagagctggcacctgaactggattccctgactcctagaccagcgctggggacaaggactgcctactgtgtgagaagggggacctgtgcaagagcaatagagcaggtcaacagctgcaggcctcatgatttacagaagcatcaacacagttaatgtgaagggagaggccatgggacaagggcatggagcaggcagtgcagctgagagctctacaagatgaagggcctcctggaaagtcagtgccatgcagggtaagtgacggtcactctgtgtgggcagcgtgcagtggtcaggtggtgtcctgccacagtccagcaggttcctctcaccaataaggattaggagtaacctgaggggacaagccatgggcccatgtgtggctgtgcaccctaccaccactgtgtcttgcactgaattggttctggggcacaactaatgggaaaccaagagccccaagtaaaagcccaagccttcccaaaacaaagtcaagaaagaaacacacattagcattcagcatcttactgcaagaaggctttgggtccaaatgcaggaatatactacagtaaacgattgagtaacattgtagccatgcagcatgcagcccttcaaaattatgctctgaagagctttaatgacctgagcaaatacatacgatatattaggcggaaaatgcaggcttaacgcagggtgtatacagtgtgagctcaacggtgtaaagcaatatgcacagcagggaagtgctctaagatgtttgcagtgttgtcagtgatttttaacctactctttttttctatgtatattgcaaatttctatggtgagcacgtagtatttactgagcttaaagataattgcgtttttatgttaaatacactaattctgtgtttataaggaaatataagccgtcaggcctgacatcattctttgtggctttgcaatgatcatactgctatgctttccagaaatgatttctccagccaagaagaaatcccgtcccagggctgtcaatgcatttactcacattctgaatatttctggagttggtcaaattcttctggagtgagggagacccaccgttcttcacccatttttaaactttatgtgagtggctaaagggcagtgatggagttttgttcactaggctgaagtggaggcccagcccagggcctggctcattgcaggtttgcgatgtaagcctttcaggagacttctgggagcactcaagtgtatacagcagcagcaggcacctctcagaagatgagacaagatctctgctattccttaggcaacatcctcctgtctgtattcaaggtaaattcagaagtcctggctcttcctagatagaagcagaaaagacattgtaaatgagaatgttaaaaaaaaaaggccccaaatgttctttgctgaaagatctacaggggacaattgttcaatggttcttaaggatggttctccccttagagaggtctgaagagggcacaacgacagttgtctggctggtggtgagagttgaggggcaagctgtggcctgtatgaataggtgggccatactactcagctctgggaaatgttccatgtgtcacatgagaggtggtattagagctgcctaagagcatcctcagggcataaaaatgccttaggctattggatgcttcatgagtaattacaggaacaggagcctatgcagccgttctgtcctgcactgatttctaaattccaccgtgatagctctggtgagccattctggaataaccccaaggctggctaacatctagtgactgaagcagttctctgtcctcttagagccataaaaagggagttagaggaatgggctgctggcctcaatgaggccgggaaatggggatggattcaaacaaacactgagcatcttttcctttgagcctctcatactgtgggtcattaaatcagttttgtggttgtgaaattgatgtaatgagtcacaacaagcatgtaaacacatgaaatggaatagggtagaatgagatggagtcgaaaacactagagtgcatctaccacagtaaggggatgtattatgtcataagacttttccttcagttatacacccatggttatactgatcatattgtgaagtgtctttcttattctcagttgaggttacaagcatggttgggaagccaccaacctaaaaaggtgagaaataaagaccaactgaaacacaggctctactgttgccaaagaacaagcacagttttaacaaaacaggatccatcctgagggccaactgcaaggcaagtctggggttcctggagcatatgagcagtgctggatgagacgaccaagttgggaggtatatatggaccattctctggggaaatgtgtagactggttgttttggacctggagagtgaactagagctgagggaagatgctggagagagagagattctagctttataaagaaaaccttccattaaccagaatgcatggcaaggaaatgagagacccacattcctggggacattaagttctagtctctcgccctgagaagtccaactctctccttaatccagccagctcgactctgctccttggcacatgctactgtcaaggtcatcagtgacctagctgccaaatccagcaggcacctttcagtccttcctcggcttgtttctctctctgcaatctttctttgccatggcagaaaacttccacctagagactctcttatgtttctgggtgtttcttgtcagtctccttcagcctcttcttttgccatctttaaatattgaaatgtttccacagcaaagatatagaatcagcctaaatgcctatcagtggaagactggataaagcaaatgtagtacatatacaccacggaatactacacagccataaaaaagaatgagatcctgttccttgcagcaacatggatggagctggaggacattatcctaagtgaactaatacaggaacagaaatccagatacagcacatcttcacttataagtgagagctgaacactgagaacacagggacacaaagaagggaacaataggtactggggcctacttgaaggtggaggatgggaggagggagagaactgaaaaactacctactgggtactatgcttattacctgagtgacaaaataatctgtacagcaaacccccgtgacatgtgatttacccatataacaaacctgcacaagaacccttgaacctaaaataaaagttaaagaaaaaatgggcacttccaaaatcctgtcctcagccctcttctcactctacatcccttctctgatggacctcatccacctccaagctttaatgacccccggcatgctgcggcagccctgagctctctccttggtctgaatctgaatattcagatattcagatgccttaatccagatctgtatatccaaccatctactgtgactcccttgtgtgtcccaaaccacccctgatctgcatcttccagtgtccccagccgctcgggttatgcccaagagaagccagtgcccaggtcagaggcaggaggctcagctaagctcctccccttttctctcctgccaaacccaggcacagctccggagtttgactgtccactgtgtgctccctcttgtccaccacaccagccctggcattaactcagaccttccttatctcttgcctggcctttgacaacagcctcctgctgctctccctgccttgcgctttgttctcctccccttggtctgctctttaaattgccaaccagatcacatctctctcggtaataaaattcttcagtagtttctactgcctgtagaataagatgtaatcttcttttcatgatacacaaagctctttatgatctggctcgtgatgatcaatttagtacgaaagtgaggagtatcctttagaaacctttgccatcgtgccagggaatctagcattgcaaccactgtcaccgctgctgctgctatcaatgaatggacctgtactttactctgtgctatatgctttatatacattatctaatttagtcctcttaataacatgtcaattcaatattgctgtccctgttttgcggatgagaaaaaaatgaggttaggtatttagtaaacatggtgaggagaaagaaggagccactagtgcttctgtttaagaatgcctcctgctgggtgcggtggcttatgcctgtaatcccatcactttaggaggctaagatgggcggatcatgaggtcaggagatcgagaccatcctggccaacatggtgaaaccttgtctctactaaaaatacaaaaattagctgggtgtggccaggcgcagtggctcacgcctgtaatcccaccactttgggaggccgagacgggcggatcacaaggtcaggagatcgagaccatcctggctaacacagtgaaaccccgtctctactaaaaacacaaaaaaattagccaggcgtggtggtgggtgcctgtagttccagctactcaggaggctgaggcagaagaatggtttgaacccaggatgcagaccttgcagtgatctgagattgcgccactgcactccagcctgggcaacagagtgagactccgtctcaaaaaaaaaaaaaaaaaaaaaattagctgggtgtcgtggtgcatgcttgtaatcccagctactcgggaggctgaggcaggagaatcgcttgaaccagggagtcagaggttgcagtgagccaagatcacaccactgcactccagcctggcgacagagtgagagtctgtcaaaaaaaaaaaaaaaaaaaaagaatgcctccatggcctgggcattctgcacaccttcagaagcacagagggagatctaagaggacgcataggcacactgcatgacagaacaacactgaactaaaaccagaaggcagagaatttgaatctgggctctgcccttctgagctatttcaccctagacatatttttcatcccttgaactttggtttcttcatctaaaacatgaagatattaatgaaaaagcttactgggttggtgttaggattaagtgggttaatatatgcaacaaacataaaaacaaaatccccacctggtgcaatgcctgcacatagcaaacactcaataaatgattgttattatcatccagttgcaaatacaacatgtagcaatgtggcttaaacgatcagctgaaaaaaaaaaaaaacccaaaataaccccattaaaaagtgggcaaagggcacaaacacactcttctcaaaagaagacaatacaagtggccaacaaacatgaaaaaatgctcaacattgctaatcatcagatacatgtacatcaaaaccatgactattattaaaaagacaaaaacagatactggtgaggctttggagaaaagggaatgcctatacactgctggtgggaatgtaaattagttcagtcactatggaaagcaggttggagatttctcgaagaacttaaaacagacctcccatgcaatgcagcaatcccattactgggtatacatccaaaggaaaataagtagttccacaaaaaagacacgtgcactcatatgttcatcacagcactattcacagtagcaaaggcatggaatcaacctggatttatccaatttatccatttatccaatgatggactggatggataaagaaaatgtaatgcacatataccatacaatactacacagccgtaaaaaagaatgaaatcatgtcctttgcagcaacatggatgcagcttgaggccattatccaaaatgaattaacacaggaatagaaaataccaaataccaaatagaaaatatgtgaaaaccaaatactacatgttcttacttataagtgggagctaaacattgggaacatatggacataaatatggaagtaaaagacactggggattactagagggggcagggggaaggggcaaaggctgaaaaactgaaaaactgaaaaattgggtactatgctcactacctgggtgatgggatcattcatactccaaagtcaacatcatgcaatatactcaggtaacaaacttgcccctgtaccccctgaataatagttgaaattttaaaaaatcagctggcagtagtcaagtagaaagtttctagtattgtgccacaggtttctgaacttgatctgatactgctccaggttgttgtaattttgtaattgctcatcaacccttatccactagttttagcgtccactaatgattattgcctggattaattattacaatgatactgattttctaattccatcattccctttatatttgttagttaggagtctattgtaagtaagagctttcccttctgttatttatatcaatttatatgtctactataaataaagataaattataaatatataaagaatatatatgtgtgtataaaaactgcatttatatataatatatatttattttcacagattcttattttattctgtgggttacaaatctgttgctatcttcgactctcagattattccagatttgatcagtggaagctcagtcaaggtggcgatctgttctttagatatatctcagtcattttttcagcacatccttattttctagcactacaaaatgtttcaggctcatctcgtacttcctcagctcaagtgctaaaatcagtcatttctctaaggagttcctttggtgaagaatggcatttgaagccaaagcttgggtaccacgtatgctcactgctgctggggtgtcattgcttctaggccctatcaaggacagagctagaaaatagatgcgtgtgctgggcgtggtggctcatgcctgtgatcccagcacttttggaggccgaggcggaaggatcacttgagcccaggagtttgagaccagcctggccaacatggcgaagctctgtctctattaaaaatacaaaaattagctgggtgtggtggtacatgcctgtagtcccagctactcaggaggctgaggtaggagaattgctcgaacctgggaggtgggggttggatgttgcagcgagccgagatcctgccactgcactccagcctgggtgacagagtgagacactgtcttaaaaaaaaaatagatgtatgtacacagatacacacacacacacccctcatctctctctctctctctctctctctctgttaaataccttgagttcatacttacacctccaactccagtccgacattgcaaagtcaattgtagccttcccttccttccatattttttaactatcttctctaacaagctttgtttccatcatctacaacatacttatttgcttaatacacagaaagtagtttcagaattgccagtccacacctctgtgaaaaacaaaatagacttcaagatttgtttacagttctattgttttcaggcaacggcaaatcctcaaaatgctactctcaaaagttacgtaggttagttctttctcactcccatcagtttctgtttgtatttcattttaggatgttttcttcatatccactgattctttttcagtatggttccaaagtcaaaactatatagaaagatatattcagccaggcgttggtggctcacacctgtaatcccagcactttgggaggctgagccaggcagatgcttgagcccaggagttctagaccagcctgagcaatatggcaaaaccccgtctttacaaaaaatacaaacaaaaaaattcaccaggcatggtggtgtgcatctgtggtcccagatacccaggaggctgaggtgggaagatcacctgagcctgagggatcaaggctgcactgaactataattgcaccattgcactccagcctgagcagcagagtgggatcccgtctcaaaacaaaaacaaaaagaaaaagatatactcagagaagtatccctcattcctcttactcttttcccatctcctcttttctatcttattctcacttacccttatagtatctagtttatacttcctgtgtttagttttgcacatgtgagaagatatgtgaatatcttatttccccctttcctcctccttctcctcctcctcctcctcctccttattctttttcttcttcttttttttttttttgaggcgtggtttctctctgtcacccatgctggagagcagtagtggaatcacagcccacagcagccttgaactcctgggttaagcaatcctcccacttcagcagccccctcccagccctcccagtagagtagctgggactagaggtgtatgccactatgacctgctaattttttttttttttaactttttgtagagacagtgtctcactatgttgcccaggctgatctcgaactcctgggctcaagtgatccacctgcctcggtctcccaaagtgctgagattatatgtgagcctctgtgcctggcttccctttctttctaatacaaaaggtagcacattatagatcatcatctgcatattgttttttcaccaatcaatacatcctatgaatcacaccatacctgttcatagagatctttctcatttagaattaaataggactctgacacttatctccttaaaatccttcagaagcctcccttggcctccaggaaaaaaagagctgtctccttagctagttccacaaggttctttacctgtggtaataactcacctccccattctcacccccattacctcctgccccacacactccaccttccagccaaatctaccttctgtctactcttagcactagcaaagtgcctggatgtgggaggaccccataagcattatggcctgacaaacacaccatgcctttgatctacttgaaatgccctttactccttccttcctaaaacaaatctctactcatctctttagatccagattaaaaggtcacttcttttctatagctttttggaactctttgagcaaatttgcctgttctcccagctgtgttccacagaatcctatgtatttctctattgcggtggttgatgattccctgtgggggacagacacccaaacagctattaataattaacatacaagctggcaagagaagtggtgcagatatgtccagagatttatggggtcatctaatgtgtctgaagcaggcacaaataatcaggaaaagcttcctgaaggagctgatgctcctgctgaggaggggtgacgaggtgatgtggtatacattgctataactcaacaaatattcatattatcattatcatggttgttccattgtagctcagtgcttgaattcacagtggaaaaggctacaccattctttttttttttttttcttgagatggagttttgctctgccgcccagactggagtgttgtggcatgatctcagctcactgcaacctccacctcctgggttcaagtgattctcctgcctcagcctcccgagtagctgggactacaggcacctgccaccacgcccggctaatttttgtattttttgtagagacaaggtttcaccaccatgttggccaggctggtctcgaactcctgacctcaggtgatctgcctgcctcagcctcccacagtgctgagattacaggtgtgagccactgcgcccggccttacaccattctttatttccttcaagaaaagttaggggcctaaaacattgcctgactctccagatggtatcccacgtgacagcccgcctctgccttctgccctttgatgaaggtgacagctgacagccaggagggctttctctagctcacgaagctcggcacttccctcagcagcctgctccatcactcccctctcagaggctctttgtagtatgaacaatcttcttattaccaccccaagcatcttttctgacagaaaaaattgaataggattttctaaataaaactcagattggatattgtctgacttgggtaggagaagagtattttatgtctctacagctatgtcactctgagcaattgcttcagctcctttggcctcagtttccttgtctatgaaatgagggggtgggaataatggtttctaatgcattttctagctctgcaattttatatactggatcaaattctatttgttctgtacggatgtcagcatggaaatcacaagtcaggaggaagaaggcaaattcaatgagtattgaattgcaccctgggtctctctattcatttgaatgaatcagccatacccaattatccaggaacaaacacctcctcatctcctctttgctctcctaaaaacattaattcatgaatatgacatcagattggagaagcctatttatgtgcatttgaaggtttattacaaagccataatgagtacatgttcataagggaagaaagactaaaagctacaaagataaaaacctctttctcttctcagacttgtggaaagtcgcaacttgacaagtgccccatctctggctttaactcctactgttccttcttcaactctataactcttatgcaggctttggagtttagttcaaattgcacctgaagatgccctctttaattgcccagacctggctgggcatatcttgtctgctctccagtagcactttgggtttttctccattatgacatttactgcagtgcatgtacttaccaactgtcttccctacaggactttgaactccttcagggcagaaagagtgtcctgtctgctttgcacctctagctactacaagatttctaagagttcattttttgacactagaaaaatgattctcaaccttttattgaccaagatcattttcatggagtcaaagttcctaccacatctatttacatgtccctatagaggaggaactgggtgataaaaagaattcaagaagaacagaagatgcaagttgcagtacaattgttgatagtatcacttacaagtcacttaatttaccataaaatatacatcaacactcacattttatattaaaataatgacctacacaagtataggctatcagggttataaagttataacagatatagacttataatcaagttactttattatgcttaatctgatagtattttgtaagttacataagttgcttgaatttatcaatgaactgtcactattgtggtcgtcatttacattggtggtcccccaaaccatgcttcctgatatttatgccctttctagtttcttcccttgagtccgggctgcacctgtaacttgccctaaccaagagagtgcattagaagtggtgctgtgcctgtgtcaagcataagccttgagaaggcccacttctgagttcctaagggcactgaactgccatgtaagaagttcagccattttgctggagagatcacatagagaccacatggagaggccacgtggatgaagggagatctaacattacagagaggagaactgagcaacccatctgatgacaagaactgaagcccaagatgtaagaccccagtcaagccattccagccagcacccagtcatctaagtcatcctagctgtgttgtgagacaagaagccatttgggatttcacagccttggcagacatcacacgtggagcagagataacccatccccgctcagcctggtctggattcccaatgcacagaaacacatagacgaataacataattgtggagcaacaagattttggggcagttagttatgtaatcgtagataaccaagacaactacacaagcacttttaggggcaggttatgcatgtgtctatttggcaacagaatctgcatgattcatgcttgaactgcaacttattcatgtcttaaaatctagtagttggaaaattataggctaaaaataccttcgatgcaaatatgtatcactgcctgctgtagggttagccaaatatccttcacaaactaatatgataattatgaagtcaagtgaactataatttctaattaataagcaagaatagcagtagctgaaaaccacaaccaactcaaagcaagactgacatgcaatgacaacaacggggccttccccaggtcacaggattctaaccatctacttgagtgtgggggctgtagctgctgagcatttagaagcagcctgatttcacagataactgaattaaagcccttggggaactttgcaatgatctaatttaagtttatgagtggtaaatatgagtaatacctaataactcatttagcatattactggcatgtagtccttaaataaacataaacacaaaagtcttgggattgcattctatccataagaattcagagaggattttcatttgagaggtactttgtacaccattagtggcctcagagtgaatgtgagaatctctgccgcaagatagtcatgaaaatgtcaggctgaaccaaatgcccaggtgggggagctgggagtggctggtacccagaaaaagcttttgggctccaaggagaagttgaggactgctactttgggggtctgtctttggcacaggcaggcagtgttggtctaagaagagtgtttgtagctcaggggcatcacaatctgaggattggtcattcattcatttgttcacttgctcaacaaatcactgtaataacaagcaatagcagcaacctccatttatagattgcaacacatcttgcgctttgcaaacttcatctgtaatagtcaccaaaccctgtgaggaacgtatgttttatgcccatttaacatctgtagaagcaggcccagagtaattctcccaagttatcctactagtaaatgatgagactgtataggaatctaagtctgtgttgttcaaagctcatggtaacatctttggatgaatgagtgctgagtacctaagtgttgagcctgtgcaggtacagatgccattaataagccacctgtggagatgccacgccctggtcctcaacatggaaggggaatggaagccagaataaaaaccatggcctgttcctgaaaagccaacattatttgagggaggaaaagctatattatattaaacatgagcacagaatggaatagaatgcaaaatatccaggaaatttgtaggcaaaacatgggacttcgaaagaaaaccttgctcttgccctggggccacctctgtgaatcctgggagagttcactcagcttcaccacttggggcccttaacagtggaaatttaaggaagcagggttgtgaatagcaatggaaaagtctgattctgaactccagtgctgaggggctgatgtagggaagggattgtgagtagaggtctcctttatgaaattactacctggggaagcgtctgccctagactcatgccctgtgtcagggagacttctgcccagagcaccaagcacaagtctgactttggaattagagaccagaattcagatcttggctctatcctatataactgtgtgacattagcaagttcttcttcatctctaaatgggaatggtgaaaatattaacacatgcttcccaaggttattatgagattatttgtataatgtttattatggtttgaatgtttgtcctctccaaaattcatgttgaaatttaatctccaaagtggcagtattgagaggtgaggcctttaagaggtaattgggtcctgaggacactgccctagtgaatggattaatccattcatggattaatggtctatcatgggaggggaactggtggctttataagaagaggaagcgagatctgaactaacacgttcagccccctcaccatatgatgccctgtaccaccttgggactctatgtagaatcaccaccagtaagaagggcctcaccagatgcagtccctcaaccttggacttctcaccctccataaccgtaagaaataagttccttttctctgtaagttacccagcttcaggtatcccgttataagcagcagaaaatggactaagtgtttatgagagcatcactagtaaaactttctgtcagtggctttgaaagcgtggtcctcatcccagcagcatcagcaccaccgggggaacgtgttaggaaggcaaattcttggaacccgcaccagagctagagaaattcagggagggtcagcaacctgcctgtgttttgtaatcactgctttacattaatgtaaggaacaggactaagaagagaaacttggagtatctggagctatttctttttcttaatggggaccttaagcagacagattttgggtctgtcaaatcagttccactttcctgaggcagtaaaacattatagggaagctggaggcccatgactgccagaaaactgtcatcatgccacactcctaaaattgtcatgttatgacttatattccctgcagaattttcctttctttccaatctggatgtgtttttcatactccttctataacattttgtgcaaaatattcatctagagaaggcatagaacaggtaagattttccatcatgaagcaaatggacaagaaacaaaccaaaaatccaagaaggtaagaaaatgacagctccattaaggctagcagctcattcccacaccagaaatggacctgtcagcgaagagacattgcagagccctgggcatgagtatggggcttgggcaggtctagaaagacagctctgtaaaaatgcctaggtattgtggtgatagcggcgtggtatgtacgtgtgtgtgtgttttaacagtaaccgcaacaaaaccccactaaagagaaaacactcaagtttggaacggtgtgtaaaaccacgctcagcttggtaagttcccatggagtagaaggaacttgaggtcagccatccagtcatcattctccacttcatgaagcgcttgtgttctccctcccctctctcttctgccaacgcctgatctcctattctctaattctcctttccttttcctcatcccctttttgtttcccataacaacataaacagcagcagccgcttactgagggtctactatctgttctatattaatgcaatccttaaaataatctctcaaggtaagtaatattacacctgggaccaggttccttgcaggaaactgagcaatcattcaaacccatgtctgtctgaatgcaaagcccatattcccccaccccaccctgcatctgtactgcttctcagacctacagagattattagtaccatctctagattgtaaactgatggagggtggatttactggttcattccagaaacctagggctgagtttatggaaggctctgggtagccaggtgcctcttcctccaccaaccagcagtgtcctaatgggcgattatgtagtaatgattcggcactgtggacaacagcatctagaggtgcatacacctcatgcctagcccagacaatatgtccctggatggcctcctctaccccagaggtgtctagaacccagtttgaaataaatacttcattaatattcagtaacctttacaatgtgacagatggtcctaaacaacttgcacaaattagctggttgactcttcataacaactctgttaggtggatacaaatattatgctcattttaaagctgaggaaactgaaacacggaggttaagtaacttgtcctaggtcacagagctattaattaatgaatccaggattccaatcctggattggaattatgttatatgacacaaagttaacgggcattggcttgtggcagtacttggcataagaaagtcatcgagaaaatgcaaatatatctgtaataattttaaacattgtcatttgaataaagtacaacattgaaatcatttcacagggcactcataaaccccggttacagaaacaccacagcttgatggggtttggaaaccagaaaggaagaacaaattaattttctaaagcaaataaaaggtgttgtaagacctggagcccttgggtctaacccaagtcctggtatttattagcttgcccaggctggagtgcagtggcgcgatctcagctcactgcaaccttcgcctcctggattcaagcgattctcctgcctcagcctcccaagtaactgggacaacaggcgcctactactgcacctggctaatttttttttaatgtttttagtagaaatggggtttcaccatattggttaggctggtctcgaactactaaccttgtgatctgcctgccttggcctaagcagtcagttctactctctatgcttcaagtttctcatttgataattgtggtgagtgaaataagtaatatttaagctctttttaaacagtaatttcattttccttccagaaatgttagacataaaccctttactcttgccacatggtatctcgtgccaccattttaggctggggaatgccttttgttttcatattcatttaaagtatactccattggatggaaacaacagtaagatacttttgccacctaccaaattgttaacaacttaaaaatagttaatatccttgttggtagaaaggaaggaaacagaaactgtccaatgctgctggtgtggaagtaaattagccaaggtaacgctatatgccaatagccttaaaatgtacatttccatgacattttagttctataagtttatcttaagaaagcaactatggacagtaataacagtatcactttcgcaactactactattatttccacaagatttcacctcccaggacatttgtggcagcactgtttaaaatagcaaaaaatcgaaacgatttaaatgccacacaatataggattaaatagcttttagtatgtacatctaaaatattaaactatacatatttgtagtaggtgctgaactgtgccaatcagatctcccagatacttgggagtggtgctggcagacagctctcacctgtcaattcttttcaggaattgccttaactctaaaaagctgccttgtccaaggtcatgtccccttcttgggcagcccacacccagtgactggatgatacacagtggtacggtataaaagcctggtcatctcaccccaactgggagcaactctgcaggaccatctcagtccaacttctcccttcaccaagttccatttctgtcctttcccttccacgaagggtgatcccaagcgtactccctaataaaactcattaacacttctgcatgacaatctccatctcagaatctgtatcccaggaaatttcattggcagcaatatgaaaattaagaaaaagatccatgcattcttaagtaactccatgtttaaaaaaaatgtaaatatgaagattttaaatatcaatgtagtagattacaatttggttagagcaatgcttaaaggacactttgcagccttaaataaatttcttagaaaacaaggtagatgaaaacaaaaatgaatgaagcctccaactcaagaagctaaaaaagggacacaaacgaaatctaagtgaagccagagagggcagtaataaagataagggcagagattatcaactagcactcaaaacaaaacaaaaaactggacagttttggttaaaagcaaaagtccttttggttgttaatattgttgaaaaatctaataaaataggcaatcctttggcagagtatgagacagagagagagagaaggggaaggaggaggagggagaggaagaagaagaaccagtagcaatatttggaatgaaaaagaagacataactataacgtaagagattttattaaattatgagacactactatattcaactttatagcaccactttcaagaacctagataaaatgggaaaattctgcaaaagtataagtgatcaaaagtgactcaagaattagaaaagcctgactagttcaataatagataaaactgaaccaatattaaaaggtctacttgccccaccctcctggcccagacaatattacaggcagttctaagagtcatcaaaaaacagataattcttctcttacataaaccattccagagcatagaaaaatatgttaagttacaatttattctatgaggctagcataacccggtaacaaactgaacaaggaaaatacaaaaacaaattatagaccaacctcatctaaatagagtaaaaccccacataaaatagtaaaattcagtatagcattaaaagaacaataaacagtttatttcagtaaggcaagactgggtcaatgttataaaacctatcaatatactatattaatagaatataagagaaattcatatgaccatctcaatatatgtagaaaaaaattaacaaaattcaacactgaaatataataaaaaaacaaacaaaaaaacaaacaaaacctttaagcacatcagaaggtaaatgaaacctcctttaacttcatgatggctatcctccaaaatcccacagcaaacttcatatttaaatggtgaaatactagaagcattaccattaaaatcaaggacatgataaggatgcatgttagaaactctactattcagcagtctcagtctatgagagatcccagttaatgcaattaaataagacaaaattagaggtatataaattggaatagaaaaggcaaatctgtcattatttttaagtgatatgatagcaaacctagaaaaaccaagagatcacataaatataaattattaagggatctcagcaaagtgactgacacaaaatcaatattaaaaaattgctgctttcctttacactagcaacagccaattaggaaatatagcataatagaaaaagatctttttcaaaattttaataaaaagtagaatgggctgggcacagtggctcatgcctgtaatctcagcacttagggaggccgaggtgagcagattgcctgagcccaggagttcaagacaagctgggaaacagggcaaaaccctgtctctacaaaaaattttaaaaatgagctgggtgtgatggtgtgtacctgtagtcccagctactcgggagactgaggtgggaggatcccttgagcccaggagacagaggttgtagtgagccaagaacgagccactgcactctagcccaggcaacagagtgagaccctatctcaaaaaaaaaaaaaaaaaaagaaagaaggaaaagtagaatgtacattggagtgaatctaacaattaatgtgcaagaccttcatggagaaaaatggagaaacctataggcatttgtagcaggacaatagggaaatctaaataaatggatacatattttattcacggataggaaggcttactttagttctggtacttactagctacgtgactggtaaaatttttgaaatctttgtctatctaagccctagtttattcatgtgagtgataatggaatctcccttgtggagttttttgtgactattagaactagtaaacgtcattttaaaaacctctcaaaattacatgcaatatttgtagtggtacaaatattcttatgtaactgaaaaaagagagatgtgaaaggatgtacatgaaatgtaatcatggttacttccaagaaatacataaagtttagaagttgaggttttgttatctgtaactttttaattcttttttaaaaagggaatgtattaatgtattatttatactttttaaaaatttgaaggaaagtccttatttctactatctaggtctgcttctttctatttttttctggcacaactcaatcttttcaaagtttacgtacattggttagagatggaggcttacggaacattgacttgaaggcagatacccaagcagttactgcatggaacatatcaatgtatactatgtatgaacatgtgtaatgtatgtgggcttataggataaacaatatgtattatgtcttttcattctttatgagtattatttatatacatgagaattttagtatctgtgaacgatgcatgaatgtataccattgttaaataaatgaatcaccttcacctaaagttcccctacaccagaaattatagaggacttattctaccttgaaatcctgttctatcttctagttagtttatcctttcctataaagttggttaaaataatgatgttcaatgggcaattatgcttgtgcatttatcaagcttttagtatgtttaaaatactctgctaggagctatgggggaggcaaagatgaattaggattaccttagccatcagtgaacttaaagcccattggggatatcacagagcttccataaaagctatagtactgagctgtgtgtgctaagggctgtggagctcagagaaagaagagctcagacagcgatgatgttgacatggttgactgagaagaaagagcagaaaagactcctgtttactaactgtgtcttacatgcctccaccggagagaggaactactaaaatcaaaacctcaagactcctaaattggatgtaactttaaaagaggttttttcatgctatgagattatgtttttgtattttcaatttcaataaaaaatacagctaatgggttcctcagttcaaactaattaggaatgtgctatttcatttcccccaaatcttccaaaataatgagcccagcttactgaagcatgtgtgtgggttgtgggggtgggtggtatgccaagaggcctgtacgctggggcctgtgagatattgaaggtttctctgctgctcctttgtaccactggcttctgatgtggagcacaaagtgtcagcagtacccggaaatctatatctgccaggaaacagaaaagagtatcaccccaagctccaacaaacctgagtcagcatgtcctccatgacatttcctatatttgtggtcttgagcatactatttattctacctaatctcttgagcccaagtttcctcatctggaaaatgggaatagtggtatcaccttacacagtaggattaaagataatgaatataggtttcccagggccgtgcctggcacaggtctccacagatgttaattcccttcccttcctctttatcagacacaggtaaatgtgccaagattccctgaccccttgagtgtcctcataaaatggagaagtggtttaaaatgagagaaagtatgaatttagagatgaaaaatcttcgaggaagaggatgggagggaaagaagatgcttttcagtaccagctgtagaagacaaaacattgtaaattttcaccttcatctctagaagctgttaatgaataagtaaatttaaaaaactataaactttatggaaacatctgcttgcaggggttaggagtggctggatgtgtgggccagactaataacactggaggggttgggagaagagcacagagttagtcatttggctgaatgtgtttaataaattacaacccaattggagggactggctccctgggtgagtcactttgaactaggcaaaaatagccaacagaaaccagccccaactaaagaaaaataaatcattttatttgattgactgacattgttttgatcagagtgtgaaatcacatgctgagtttagtttggtcagaaagccaccctgttgctgatggaatcacatgcacatattcattcctctaaccacttgctagatgtaacttttaaatatataaatactctactctcaaacttaccttcctcccacgtctatctccaaaactaaacaactaactttttcaatgaagaagtcattctccacatttcctgggcttgatacattggctttatttacctttagtctccttcccctctctgaaatctcaataccaaatcagacatcaattcgccaagttttgtcttttatctttcagctctgcccctttctctccattaaattccttgtaacagcacctccagtttctgggtaggggcttcttaatggccctagcaggtctctggtctcataactatcttctcactcattttagtctgttctgcacatgagactaccgaaaaccacaagcttcaattattttccaggtcaagaactaaactatcagtttgtgttcagtgccttttccaagtattcaaggtactttatctcctaggctaactggatctcccactagtttgaggggcgagactgtgaaggacttgggaatagggataatgttgtcattgttctttctgctgatcattgggattctgggataacaaagaagcagatatcactaagtggctgtagatttctggaccatgatttatcatatgctggaagggtaagttcatgtctggtcatgaaggacttgcatctactaagcatgggggacatgtatttagtacagggtgatgagtaagaggatcaaagagctgggatagagccagatgcagtggtacacaactgtagtcctagctacttgggaggctgaggaaggaagatggcttgagccaagaagttcaagaccaacctgggcaatatagtgaaaccaccaactcagaaataaaataaaatataaaagagttgggatgataccatgataccatgaatctatccaggaactgctggtaaaacaaagacaagagagggaaggtacctggtgacacgtacacatatgtatacataattataaagaatactagagaagtgtctgttcatgtccttcgcccactttttgatggggttgtttgtttttttcttgtaaatttgtttgatataaagacacatgcacacgtatgtttactgcagcattattcacaatagcaaagacttggaaccaacccaaatgtccaacaatgatagactggattaagaaaatgtggcacatatacaccatggaatactatgcagccataaaaaatgatgagttcatgtcctttgtagggacatggatgaaattggaaaacatcattctcagtaaactatcgcaagaacaaaaaaccaaacaccccatattctcactcataggtgggaattgaacaatgaggacacatggacacaggaagggtaatatcacactctggggactgttgtggggtgggaggagtgaggagggatagcactgggagatatacctaatgctagatgacgagttagtgggtgcagtgcaccagcatggcacatgtatacgtatgtaactaacctgcacaatgtgcacatgtaccctaaaacttaaagtataataaaaaaaaatactagaaactacattaatgggctgaatagtctagacagcaagagattgatttgttacggaaattcacgaccctaaggatagagcacctagagatatcatgagtgagcagaatatggtaaagaacacatgtgagttcattatgagcattttctacaggccgcttggccacaggaagaaatggagggtggattcttagccactgttattctgtcataagggaagttacagcagtgaaagtggtcttgtgctgactgaacacttgcaaaacgcccttttcagctaaaaatagcgcatcagacaagtctcttcatttcccttgttgacatggaataaagaagcttaactagatacactcctctgtctctcattctttatttttttatttgattttttgttttgttttatttctgttttttttctctcggtccctcattctgaccaacagaaagaccctgcttggtgaagcaagcagaagagacatattaggagaaacaagccactccagctcagaagacatgattgtcaatgaggagaaggctggctgtaataagtagccaagaagtctagatttaggcagtctaaaaagttaaaaagaagatagttatgattagatgagattctggaatagaggcagcctgaagttttccaaaatggggaagcgttcaaaaatcattccaataaaaagggaaaagaaatggtccttttaaaaaatgtgcctgcaggctcacccacagattcccatctgaaaaagacacttagaaaaaaaggaaaagaaaggcacacaaccaaggaacatataggaagatggcacaaacttaaacggaaaaattataatgtgaaaaaaatagctgaaagtgatctgaaatactaaatgacaataacaacaaaaaaccccactatgggccaaaaaaagttggaggaattctgggaactgggccagttcattttagacccataagagcaaagaacagcttagtctatcgcttgtgaacgaggattaccagaacctccatggaggctactgaaccactttcgttgatctttgaagaattttggagaaaaacaacaacaagaagccagaggaccagaaacaagcaaatctaatcttctttctttcttttctttttttttggagacaaagtctcactctgtcatccaggctggagtgcagtagcgcagtcttggctcactgcaacttctgcctcacggggtgaagtgatcctcccacctcagcctcctgagtagccaggaccacagatgcgcaccaccatgccttgctaatttttttgtatttttggtagagacgggatttcaccatgttgcccaggctggtctcaatttcctgacctcaagcaatctgcctgcctcccaaagtgctgggattatgtgtgagccactgcacctggactatcttatttttattatcaaaaaagtggaagaaaatatattccacaaactatcaacagcgtgagcatgatactagtcttagctaagaatccaaatcatatttttaaatgattttaaaataaaaatcacatatcatctcattatccaactataatgacaattaacattttgctgtaaattctttctagaatgtatccatatatatgtaggcatctctttaaaaaaaaatttcaaatttgttttagctctttttgtctttttttcacttagcagtatatggtgagcattatttggtgttactaaacattcctcaataccagcaaaacaatactgttttccctggttacctagtattttattgtgtaaatagacataatttattgacagttccctctgctgttgtttatctttaaaatccatctcttgcaactcaaaaccacaatgagatgccatctcacaccagtcagaatggttattattaaaaagttcaaaaaaaccaaaacagatgctagtaaggttgtggagaaaagggaatacttaaacactgttgttgggagtgtaaattagttcaaccattgtggaaagcagtatgcagattcttcaaagagctaaaagcagaactaccattggacccagcaatcccattactgggtatgtacccagaggaatagaattcatttgaccataaagacacatgtgtgcaaatgttcactgcagcactattcacaatagcaaagacatggaatgagcataaatgctcatcagtgacagattggataaagaaaatgtggtacatatacaccatggaatatatacagtgataaaaagaacgcgatatgtcttttgcaggaacatggatgcaggaacatggatggatacttagcaaagtaacgcaggaacagaaaaccaaatgctacatgttctcacttacaagtgggagctaaatgataagaacttaaagaacttatgaacacaaagaaggaaacaacagacacggattctacttgagtggggagggtgggaggaaggagatgagcaggaaagataactattgggtactgggcttaatacctgggtgatgaaataatctgtacaacaaccccccatgacacaagtttacctacctaacaaacctgcacatatatccctgaacctaaaataaaagttaaaaaataaataagtcaataaaattcatttctaacagaaactatgacttttactatttttgctttgaggaacctgctgaggttttatgtataacctgatgcaaaattaatttttataaatgttctacgagccctagaaaataaattttattatgtgctttggatattacgcagcatataattttttcagtagtattcattatattacacaattcctgtatttatattatgttttgtttgtttacttgatatgtgaaagcctgagagtggtgttttgatatcttccacctctaccgtgtttccatcagtttggggtgcaatattaattgatgtacatatttccatggccattatatcttcactgtgaatttgattcttcacttatagaaaacaatcctcattgtattatttaatgatatttgtcatgaattgcattgtcttatatcaataaaatgacttctgctttagtttttgtggcatctccctgctataccttttctcagtgttttaatttttgcacaacactttgttttaagggttcctatggtaaacaacatagagctgaattttcatttttgatccaatatgaagacttttattaaaaatgagtgatttagcttacttatgttaattgttataactgagttgtttggtgtcttcattttcatgctctattttattatcattttaatgcttccttactgtctcctttgtttaattaatatttagtttgctgcatagagtttgttttcttagacccccttgattcagaaggtgggttattgaaaactctgtaactattgtcttctaaatttaagtgtcaggaatgaaatgacagtctcataattgaaccaaggaattcagaatattttattttcactgtcttatcctttcagacaaacaccagtcttttcaggctttgaaaattattatctggggttttaggcccaaatttttctcaggattttttgtatcaatgcatatctactgtttgaatatattttacttttgcatatagttttgttttgttttgtttttgagaccgagtctcgctctgtcgcccaggctggagtgcagtggcgcgatctcagctcactgcaacctccgcctcatgagttcaagcaattctctgcctcagcctcctgagtagctgggattacaggtgcccgccaccacgcctggctaatttttgtatttttaatagcgatggggtttcaccatcttggccaggctagtcttgaactcctgacctcatgatccacctgcctcggcctcccaaagtgctgggattacaggctgagccactgcccctcaccttgtatacagttttaaaacttgatgtacaaattattagttagatgtcttttttaatttgcttcagtactagttgcctatcttttacactgtcacttccttcacatgcttggtttgacttttgatagaatactctgctcattaattgcagctagtgaattttaattctgctgttgtgcttcaatttccttgcagtccgtccatatttcattcacatctttgaataccatttttcattttcatctcagctttattcttattgtcttttgatttgtaaagaccatgccctctagtgccctcttatgaggattctagtctactaaaatattcttttaggcccagctggagtaactcattttcatttcatatgctattatttactcccttattttacatttcctttaattcctatatgttttactctttattcattcttaaagaaggaagcattctataaacttggtgcttgtcaaacaacaggtctttttggtcttgttctcactgaatgctgaaatcaataatggtgagtggatgtacacaggtcttagacctacatcaaatttcaagaatagattatcctagagtaactatgctatactatactatactatactatactcagttttatttgcctcttactgccagaacaagttctacattttttgaaatgtatcataatttttttacgatgggatcaaaatatctcaatatttcataaacattttaatagattttttcatttcttaaatgtaaagtcccatatatgtccattccatcaagctccttatagccttaaaacttttatacactaatttgtttttggcactcaatttgttgcagattgacagatgtatgttagattttccctctgcaattgtgttttgacaattttattgtatcatttaatgatttttgtattaaattttacttttagctatagtttaatactaatatcaccctcctttctttttgtttgcattttcctgatatatctatgtcccttcattttttatccctttctctcccattttgtttaaaacagcatatatttagaattgggttttgaccaatgcgtggttctttgtcttttaatagaaatgattggccaggcggggcggctcacccccgtaatcctagcactttgggaggccgaggcgggcggatcacgaggtcaggagatcgagaccactctggctaacacggtgaaaccctgtctctactaaaaatacaaaaaattagccaggcatggtggcacgcgcctgcagtcctagctacttgggaggctgaggcaggagaattgcttgaacccgggaggcagaggttgcagtgagccgagaccacagccgctgcactccagcctgggcgacagagtgagactcagtctcaaaaaaaaaaaaaaaaaaaaaaggaaatgattaaaccattcacacttaatgtggtatgtttgacctggcttctatcatcttattttatactttttatattaatgtttccttgctatttccttttttacgtattttttttcttttctttttttgaggcagagtctcaccgtgttgctcaagctggaagtgcagtggcacaatcttggctcactgcaacatctgcctcctgggttcaagtgttctcctgcctcagcctcctgagtagctgggattatagatgcccaccaccacgctaggctaatttttgtatttttagtagagaccaggtttcaccatgtcagccaggctggtctcaaactcctgacctcaagtgatccacccaccttggcctcctgaagcgctgggattacaggcatgagcctccgcacccagcccttttttagttttcattcttggctataatgttccaaatcttcctcctaattttgaagttaagcatggtatttctagttttatattcatctactgtcttcttatttaaaaatgtatttaaacctgtatttttctgtgttcagcaatgaaacaatattcaatgtttcccacagcacaaaatgagacattcagcacatcaaggttttttgccttgagtaatctgagtttttagccccacattattatcattaagtttcttatgtatcttctttgttgagagtaattttggcagttgcattgtttcctgactatattaataacatgtaaatactaagtctatgtttgtgtgggtttattattcacgccacagctttgatatcacatcttttccattcccaagctttaatgttaatttctctgttgaccagaatagtttgagtaaatacattttttaataaaggattttagtggcctacttgctgggtgcttttttttttttttttttccttgtctgagaatagcttttttttttctgtacaaattactgaatagagaattctggctcataatcttttttttttttttttttttgagatagggtctcactgttgttcaggctggagtgcagtgctgtgatcacggctcactgcagtctgcacctcttgggctcaggtgatccttccacctcagcctcccaagtagctgggactccaggtgaacatcaccattcctggctaatttttgtatttttagtagaggtggggttttgccatgttggccaggctggtctcaaactcctgggctcaagtgactgcctgccttggcctccccaagtgcttgatttataggcatgagccacggcaccggttggttcattatcttactacccccaaattccacagtcatacctcaacttatttctgatatttagtgttgcacaatgtctgacacttgcttattttttctctgaaaataaaacattgtttttctgttttcataccaacagattttttcttataattaataattttcaccagaatatacttttaatttttcctggtacacattaactattttgaagtaatgtcaggaaatttttttttatttaaaaattatttaaatttaagttctgggatacatgtggagaataggcaggtttgttacataggtacacatgtgtcacggtaaattaaattaaaaaaaaaaattagagacaggtctcgctctgtcactcaggctggagtgccatgtcacgatcttggctcactacagccttgaccttctgggcttaagcaatcctcctgcctcagctacctatatttttattataacatcttctattttttcttttcctgaaaaattctgtatttatatgtttaatgtattgaataatagcctccgttttcccctcattatttcactttcatgttttttgtcagaattgtgagaattcatgctcatctttagctttctgcattgttccaatgtttgtgcttccactgcatgattttaattctgcaaaatatttttcatttcaaagcaggcaaagtttcacaatctcagattgctctctttcagattgctccatgttgatagttcctgctatatcctcttaaatctctataaatataacttggagatttttaagtttatgttctctcttttttttagcatctattttaaagagtgacattagctttgcattcttagatgtctcccttctttggaactgctagatattgttttcatgagcttcacaaagagtgagtcccatggccccagcacaaggcacatctgaggggccattggatacgtttgattgagatgtgtttcccattgcctgcctacctagcattcctgtagctcttgccactttttaaagtttttttacatggtaaaatatgcataacataaaagttaccatttaaccacttttaagcgtacagttcagtgtcattaagtacagttacattgttgtgcaaccattgccaccatccatccacagaacctttttttttttttgagatagggtctcactctcttgcccaggctagagtgcagtggcataatcatggctcactgcaacctctgtcatccaggttcaagcgattctcatgcctcagcctcccgagtagctgggataccgatgtgtgccaccatgcctggctaatttttgtgtagtttttttaagtagagatgggacttcatcatgttggccaggctggtctcgaactcctgacctctggtgatccatctgcatcggcctccaaaagtgctgggattataggcatgagccaccatgctcagccttccacagaactttttcatcttgcaaaatgaactgtggcattaaatgataactacccatctttcccaccaccacaccctggcagctatcattttactttctatctcaatgaatttaactactataagtacctcatatgagtggaatgtgcagtattttttcttttgtgactggattatttcatttagtgtaatgttttcaaggttgcatgttgcagtatgtgtcagaatttcattcacatttaaggctgagtaatatttcattgtatacatttaccacattttgtttatccagtcatccataagggaacatttgggttgcttttatctcttagctattgtgaagaatgctgttataaacatggatgtacaagtacctcttcatgttcctgctttcaattttggggagtatatacccagatgtgtgattactggatcatacagtgattctattttcaagtttttgaggacccactgtgctgttttccatagtggctgtaccacttcacattcccatcagcagtgtacaagagttccaattgctctacatccttgccaacacttgttattttctgttcttttaaaaaatatacataatagctatcctaatgggtatgaagtggcatctcattgtgtttttgacttacagttccctgatgattcatgatgctgagcttttcatgtgcttattgctattcacatatccttttttgagaaatgtctttcaagttctttatcaatttttgaattgggtttttttgttgctgttgtttagttttgggagttctctatatattctggactttaattctttttcagatatgcggttttcaaacatttattccattctgtgcagtctctgatgctttacctttggagatgttagtggaattcttctaggagtccttttcatttaatctccaggccaacttttccttccattctgatgacttacagttggttggtctttccctcaatcactgttgtgaacactctttattatggaatgttttcagaacgtctgacatgtggattatattggtgtcctttgctagttgtcagtactataacaaatattcccaaatatttttatattaatttggttatttcagtaaaaatcatggaaggtaagagttaaatgtgtaggcttcattttccatttttaaggccttattttttgaaagtggtatccctgcaccataattaccctaactactggttaaaaatactggttcgaggcccccttcccacacctctggctcagagtctctgaggagagagccttaggatccacgtttcattacaaaagaaatctctaggaagttctaatgcaaatgaaaattagagaactactgggttcagtggtgactcgtgagcagttaaaagagaagggaatgatcccttggaactaaccaaggttcaccaagaagtcatggcaggtgattcttacatcttcttgacaggtacattagttatataactcagggaaatgtggtagacagtggatgtaagtgcaggagacttgacaaagttttcatgagccttgcaggcatgatggagaaatacccattgaatacaaaaacagggacaacacgcaagcaagaccatgactggtgcagatccagtttcggttctgacaccttaaagtagttttagagaaactgtaatgcacatgtaggagatttaccagaggagctaaggaattaaaagctctgtaatttgagaaatcgctgaatgttttgtttagcaatggttcttaactcttctgaacattggcatagttggtagcactgggagacgtaaaaaagtactgaggcccaagctttgaccccagaccaattaagtaagcatctctgggagtgggacccacaactggtgctttttcaaggcccctccccactccccccaggcaatgttaatgttaaacagacttgagaaccactagcttagagagaaagaccatgcttacaaatttgtgagctctaatatggaagatgggcataagtgtttctgtaagccacccccctgcttgaccattcacctggcagaagtggacattggtctgagtcaatagacggctactgggacagctcagttgccaagcccagactctcaatgctgtgagatgtttctttcccttattagataggcatggacctccttgacatggatctttcaggtactggcaatacattgatctagatacatggaaatagactctcccctgatctcatgagttttcacgtttcacccaccacttgcactgaggacttcgttatctgggcctccagccacggagctcatctatccaattacatctccatctggatctctcactgaaacctcaaagttaacgtgccctgaactgaacttgttacctaaccccacacctgctcctgttcctcaattctcttggtcaatgaaaccactatcttcccaggtgtaggagcctggtggccacctttggcttctctgcctccctcagccccctcacatacactcagttacaagttctttcctggttctgtccctgactccacctgtactgccattggtttagccctcatctccctggaactccctcaaaagcctctcaggggcagcctcactttccatcttctctccttctaagacagcagcctgaggggttgctctaatgttaaaatgtggccacgtcagtccccacttatgagttctcagtgcccctcccctcatcactagctacaagaaaaaaaatgcacactttaatgtgacaaacgagaccctccatggcccagctcctgtccacatttccagactcatctcccataactttctgactcacagtttttgctccagcaacactgaagtgtagacaacaaaaactggctttgcatacatggttccctttacctagaatttattaccctcattccttcacttaacttcacgcatcctttaaatttcagttcaagctcatctactccagagcgtattacctgatttcctaggtccaataccttcccaggccgaggacgtgaccctttcctgactctcatctaaagattgactctggctgggcatggtggctcattcctgtaatcccagccctttgagaggttaggagggtggatcatctgaggtcaggagttcgagaccagcctgaacatggtgaaaccccatctctattaaaaacacaaaaattagccagatgtggtggcatgcatctgtaatcccagctactcgagaggttgaggcaggagaattccttgaacctgggacgcagaggttacagtgagccaagatcacagcactgcacttcagcctgggtgacagagtgagatcccatctcaaaaaaaaaagtatatatacacacttttatatatacttttatgtatgtatatatatatatatatatatatatacacacacacacatacacatatatatagactctctatctatatctatatctatatctatgtctatgtctatatctatatctatatctatatctatatctatatctatatctatataacagtggactctgttccactcagctcctggaaacccagttgatcctatcccaagaaatgagtcctatgactagcatgaagtgggtgctcagcacatatttactgattgaatattggttaaacgatggagcatcctcaggagagcattgctatggtttgcatcatttagggattaaagaatggtgtggtctttggggcaccatgggactttttcccctataggaacatatggctactagcttcctaatagttgagaaagatcactttgtgatcatccaggcctgctggacatgccggcatgagaaaagggaagagactgacttccaccagtgaatatctttatgtcaggttctggggatcaggaacatccttgttgatgagacttttggatggggagtttggggggctagatgagagtaaccattttgtgtggcttccaaggaagggacaccctggccttctgggagctggaaagagctttctctagcttatttactttaactgcaagtcaggggcacgacggagctggtgaagtactatgagccactgttcccagagcagaggggtggagaaatgcagcaggaaatggaaacatttaggccaaaaacatttcaagtatttcagcatctaaggatcaaagtggcctcactgacctttggctacttggaactttcacaccagatcagccatcagcaaagtgaaaacttggtttctctgcagacgacactgtttattcccaaggcgagaagaaaacttccaacgcaaaacacacagaaaggagtgatggacccaaatgattaactgggcaggcaagtctgggttttgtcagctgctgtctggccattgagtttttctcttccatcccttttcttgccacagcagacttttctagatgcctccatttttcacttggaaaatgagagctcttaagctctttccttcttttctcttacacatcatgattccaggaaagaatctttaactttcactgaagcatcaatgacttaagaagcgaattccaagaggagaaatagatatttttgcaggaaataaagccttaagcttcttcagaaaaggaagtgaaaagaggagttatgccctggagaaggcactggtcagagtggtgagaccctggctcctattctggctgggtaaccccaggcagggcacttattatgttgggggtttccttatttctcaggatgaaggcttagaaccagatgttctcttggctccttctctgatctcattttctatgacgccagaaattcttagatctgccccaaattaatatatatctctaatcctaattgaataacatcccagggtgctgagacagtgtgcaattgaggtaattagaccatgctccttaatttgttcagaatcatagagttaaggaagccactactatctccatcatcaccctgcccccaaccaccattatcattatcaccaccatcacccccacaactatcaccaccaccatcaataccaccaccaacaccactatcgtcaactccccacacaactaccatcaccgctaccaccaacaccaacaccactaccaccagcacgatcatcatcaccaccattattgtcaccccccaccaccactaccatcaccactatcaccaccaccaacaacactactcctaccaccatgatcatcaccaccaccaccactaccatcaccactatcaccaccaccaccaccaccatgaacactactcccaccactatgatcatcaccaccattatcataacccccacaaccactaccatcaccactatcaccaccaccaccatcacctccactgccactaccaccatcaccactatcaccaccaccaccaccttaccaccattacccccaccaccatcaccccaccactaccaccaccacaataatcacccctactactgccaccactatcaccagcaccaccaccagcatcactgtcctaccactaccatcattaccccattatcaccatcaccagcaccagcaccagcaccagcatcactgtcctaccaccagcatcaccaccaccattaccaccatcatcaccaccactaccatcaccttcatgagaaataaagttctactttttaaaatgggaaaatttataaaaatgtcttaatttgagggactgatgttaattccagggaacattctggaatgggatgtggaatgagcttttaggattgaagctgtgatttcaaggaaccagcatggaatcactgaaattagtttatgtcagaccaacaaaattgcttctttgacaagattattggacggaagatcaaggaaataccagtgatgaagaatatttggagtttatcagagacctttgataagattcttctaataatgttgaaaaagatgaagaaatatgggctcagttatagtacagaaagctgaataaattttctaagtaagtgctgtttaattattgaattaatatctatgtttagggaacatacagtggaatgcctcagaatcccatagtgttcattatttttattgatgacttagatgaagaggtcgtgctcatcagattcagagatggcaggaagctggctgagagggccggtaaatacactggatgctagaatcacagccagaaatatctgggcaagttggcgaggcagactgaactgaacaagataaaatgagaaacaatgcacagtctctagagtggctgtgagggggtgtgggcaagtatcgggtgaaggcgagcaggtgggcaatgcagttcaagagcaagtttaaaagagaattgggttacttcagttgatattaagctcaacaggtgtcaatggtatagattcttaattagaccttaaagagttttaatagaaataggaaatagaatgaggaggtggtaatttcagtcttctccatgctgattaggactcccttgaaattttgcactttattctttaagaataaagaaattagagaaaactaggacaagagtgatgataataatagtgagggcactggagcaaatggcccatgaggtagggtggagcagtgaaaagggcgttggccagggatttgagagccaagttaccccattaataggttgcgagatcttaagagctggttcaggactccctgaggagaagcacagactatggtggttgactggtctgctcttgtaggtttttggttccccgcccttttcccccttctcttccaggggaggagatggggccagcatccaccaactcccatcagtaggagaggggagagttgctggcttctgggttctttcctcgcagaggctcatgcatgcacagcctgggcctctgggagtgtccaggttggagggatcctcgccatctgttgatggtgttgtgtggggagttggagcagttgggggagctggaacagatgatcttagtagttactcccatctctgagagtctagatttcaagacacgctgaaatcaggtcaggccacactatggatgggttcctttctccctccttcacccatccagggacaggttctcttaagaccctgagcaaaattttgcactcttgatatgtgattcagagtcataaattatacccattgtttctcttggaaagctttcaaaagtcccctttctgtgatttcccaggaagccaagatggtggcaatcctaatccacatcacaacacacagcagttattgaggcagtaaagcaaaaggtccaagaaaaaaagagaagataaataaagagaaaaggctttgaaatcatatagacctgagtttcaatctcagtctctcctatcagctttgtgaccataggcaaattactgaaactttctgagactcagtttccttatctgtgagatggggttaataccaggagtgtagtgatgtgaatatcaggtgaagctatgcgtgcacagaacatagcccaatgtgggactcagagtcggtgcccagtaagtgctattgctaatattaccacaacatttactaccaccatccctcctttatctttctctccctcatctcttcggggctaggcactgtgctagtgcagaggatacagtggaaaacgagacagacatagacacacactttgcttgcaccaagcttacactgtagcacagtccagttaaactttttgcaatgatggaaatcttttaaatgtgcattctccaatatgatagccagaaatcacatgctgcatgtaagcactagcaatgtgactggtgtgaccgaggaactgaattttaaatttcatttaattttaatgaactaaagttaaacaggaaatagtcacatgtgaaaacagacagcacagctctagacacctttcaggtatatttctgggactgactagcctgagcagaataaaggtatgctgaaagagaaatgcacgtaaagcatccagtacaggacctggaaaattctcttattcgttcattcgtcacatttaattgttgactatggattggcactatctcaggtgctggggatacagaaaaggattagacatggtctctgccttcagggggctcatagttcagtgggagatatgcaaatagtgacttcgccatagcgaggtaagcttacgcacaggtgctgtggattcaggacatctctagggtgggcttccctgaaggatgtttccggacctgagctgaatcttgcataaattgatctcagagtgggagcaacaacagattatattccagggctactaaacccactgctggtggcagaggtggcttggagatcaacgaggctctaggaacaactcatagctagggccagtttgttttcttctaaccctttgtgtgtgtgtgtgtgtgttttgtattgcctaattcaatctctcttctgccagccacattttgtttccacctgaggacattttttttaaatgatgggtataactttatttttaaattgttttattactattaatagttactagccttgatttcttttttttttttagtcagacaaactctgttacttataaagtgacatcagctctcactatggttgggtgtggaattctgatacttggtacaaataaacaactctttgaatatggccagtatgtgaggaagctgttgctgatgggttaagcttgctgaacctggctgtgatcatgatgcacgttcacaagagtgaatgttgttataatgacttgtatggagaagtgggacattatacacatttgtatattttacatgatggtttgatttgttcaaagttagtatgtgacatttagctagagaattctgcagctgatacttgctcacataaaaataggtatagctttatgttgtatggtttccataatccctcccgagtgtataaagcaaggtgatatgtgtgattccttcttccatgagactgaagaatgctcgtgtgatgtggcttggtcgtgtgaggccttggcctatttggattcctaaaggtcatctgcttgaactatggccgagttgtttctggtgaatggaatcctaaattagtgtaccctttttgaaaagtggcttctcatatatactgtgagccttaaaacattcatgccctttggcctggtgatctatttctaggcatctatccaaaggaagtaatgggaagtgtgtgcagtaaagactttgcccagagttatttgtagttgctaaagacaggaagcaacttaaataactaacagtgtaataatatgcagccaggaaaacaatgttcatgaaggtcttttgctacaacactaattcagaaaaaagcagagaaccaatagctacaggggctcagcaaccatacttttgagtcagacagcctgggtttgaatcttgattctgccacatactagctatgtaacttgggcaagtcacctgaagtcttagaaccctagaaaaatgcaaccctagaaaaatgggattgatagtaataacacctcagagggactcctgaggattaaaggatataatgaatataaaatttaacaccatgcaaagtatacttattaggcacccaataaatgctggctctctatggattgtataatttcgaggcataaaaacagatggaaaggaaatatgccagtatattaacagtgtgggatgggagtggtaggatcatgggtgattgatttgttctttgcatacttttcaacttcccaatttttaggcaatgaacatgaattacttttatactaaaagagtacattataatgatgtaatacaataagatatacattttaaaagttttaaagttttaccacaaagaaaaggtacttccccgcccttttcccccttctcttccaggggaggagatggggccagcatccaccaactcccatcagtaggagaggggagagttgctggcttctgggttctttcctcgcagaggctcacacatgcacagcctgggcctctgggagtgtccgggttggagggatcctcaccatctgttgatggtgttgtgtggggagttggagcagttgggggagctggaacagatgatcttagtagttactcccatctctgagagtctagatttcaagacacgctgatgtttgtcgttttctccccatgtctcggttgatctgaaccaaccactccataaaattctaaggtaggaaagactcatctactagcttcccaccctaaagcccctcccagaaaaatacctgtagtaatgcctatagtgctgggtgtaaacgttaagggtgattggcaaaaaagacatagatcaggagtacgaccgggaagttggcttagttgcagccgttttatttaaggagtataattcatattcggaatggaatctccagcaaatgtagtcttttaatatgacaaacagttaagtaccttcccatgttagacacatgcctggaatgagagtgagagggacataaaatataaaggggtgtgtgtctgtgcctgggttcatgaccaaacctcgacatttgccctctatgatctaatttccttcattgacaaccagggtgccctgtgtgccagcaagtggctctgccagctgtattttacagacagagaatcccaagcaccaaaataacaaagttgattcccccatccagaccagaggggtcgtttccagtcctgtgtcctgaccactgtctctcatcatgacccctggtgttcacctccagatccaaagtgtcgtcgccaagcccccaaaataaaggaatgacaaacagccctcccaggccctcctccccacagagaggtcatcgtatgctaatgaagtccgaggaggcagcggcgcagcgcgggagagcgcgcccacgggttcacagcgctcccgggcaccactgcggcgcagccacagatcgcttcgcgctgcagcagacgctcccgccgcggggggcgactgggggaggggtctcgaccgccaccctgagttccgcagctcatccctcccatctgggaggtggttctagctctagtcccaagctttccactgcagtgatggtggggatgggggcagcacgtcaaatcacctgtagggctttttagaactccacagccccctcccctaattctattccactagttcaaacgaagaaaatctcagactaggcaaggggaggtggaccggtggagtctgcgaaagcaccacaggtgactccgggtacgcactcctcaggacacaagcacacacacggacacatcttgtgactctgagactacacagatcaacctcagattcgacccttccctcctttattctctgaggtgtccgtgttcgcttcagcttccctttaagtcgccctgcgcaggggctttgtggagtgcccccaaagtcctagaaccccgcgggacggtcggaggctttggcggccagacattaggaaaagcatctcctgcttctcggactgcctggagcgcgaactggatatcaaggagccaaggttaagtccagaagaagaaggaaatccgaccagttgctttagcaaactgcctggagcaaggccgcctcccacccgcacagctttgaggcttgagggggcctctcagtcgcagagagagccgagccccaccctgtgcgttccccaagcctgcacccctcgagcggggcatcccttcctgcagggctttgtggcaggtggaactgtcggggtgggcgccgtggctttggctgcagccccttccctggccgcgggaccggctcccgctttgccctcctttaccaagttgctgcaccgggtgctccctgagccggggaccccctccgccgcgccggccgccgtcttacctcaccaggcaacacttggttgcgcggtggcccggggcgctccttcttcgcggtttattcccttacttgggaggaaagaggaaccgagagacagaagggggaccgaagctggcctctgggcgtcttcccgcctgcgcagccctctcgggggagggggatgcagccccagtgggtgccgcggagaccaggctgccaggctgtggttggtagcgccggggtcttcaccctgtgctcggagttcagcagctccaaagctgtctatctccgtggcccgctactacggcactgcggctctgtgccctgcccctcgcagcctggcaagtccagctgccactctcactgcggagccctgcccccgggcgcagagcccgcccccgccacacacaccggcgcgcgcgcgtacacacacggcacacacagacacgcgcttccacacatgcacacgcgtgcgcacacacgaatgtggatccgctcgatgggaacctgaccccctttggtgcaactagggcgcgggcatcattaggacgctttttactgacagggcttcggtttgggaggaggagttacaggcttaggagtgtggagaggatgcaacagtggtgggtaccagagggcccctgaccccggaggcaaaggacaactgtttgacaaataaataccgactgggcgtttccttttctcaactctggtcaaggctaccgtaatatcccgaccaaatcgaagaaaaaataaaaatacaaaatcaacaagttctctttgtttcccaggaactcagtatctctaggatccaaatcactagccctgtccagagggtcatttctgacaaccttgacttcggtggcagtggattggtggcagttcaactcgaaaaggttttcccctcgtagcctggtggagactggcacagcctgcctgagctggactctgttggatgggtcgggtctctgggtgtgtttaattcccattctcctttgcttttaggtgaccttggactgtattcctgcagaataaatagatctcttctttttttaaaatgtagaagagcacagaaaagacgctggggtgaggggtcggggggaataggggagctacattagccaaggcactatgacttgttgcttctctttccatgacgtgcatgtccacgtgagggggtgatggtggtggtgacactatttcaggcatgtcacacagcaagatgactgctgtccatttcacaccacatttagagtcattaggagtttagactgtcatctttaaaatatgtggagtttactcatttccacagccgagaattcttttctgccagtgggcagtgaaggtccccgggccagcactgcagccaagaaaagctttccgcagagtgtggaggcgccgaggggctctgggtgtctgtgcatttggggaagaagcctcaaacacgaatgtcaaacagccctgaggaccctgttgggtggtgtccatactaggctatctgcaggcaggctggtgagacagatgagaaacagagctgagagatctccttaagattccacacagtgatgaagacagagctgataccagaaccccgtgtttgcgactcctcttatcctctgggtcttatccattctatcaccctgggtggcttctcaaagtttccttcagctaggctgaaataatcttggtgagggtgccttcaaagttcttccttgtcctttctttttttcctcttcagtcactgactcattcattttacagctatttattaaactcctactctgtcttcaggtgcttccccgtaactccagtcctgggccttacttgggaggaaagaagaactgagagacagaaagggcttagaactgtcctcatccctggaagagaggagccctgagcacaggtttctggtatatattttcactctgctaggttgcatggatgtggaagacacaatccttgctttttttgactgcatgctcaatggaggaaaatgcacatacatgtcacaagaaaaacattctggctgtctattcttgactccttctaaagaaggctaaactgaaggagaccctgtgtttggctgagcatcataatggacttggggtacatgtttgcaaataggtgttaggacaacattgagttgctctgcctattaggacaggaaggaaataaattgaatggaacaaatgaagaagacatgcagagactgagtgtggagccttagcttcgttgagagcacattggggaagggtaacgagaggggaggagctctgaggacagggttgccaagcaacttgcctgagaacaggcaacagggttgccaagttgtccagggatttggacaggggagatgcttgcaaagattggtaagtagtttgctgtggggtgggctatgaaagcccccggtcctatgaaagaaatcatttgtaaagtcaatattgttcatcggtttgcttgcaaatggattcctttaggatcaggatggagccaaatgatgcatctgagttgctgcagaaggagttcagagaaggctgtgtggactgagttacatgctaataacatggaggaaaagggtggtagtagaggctgaagcaatgtggaaggcaaagagggatggggcgggaagaagcaccaagaacaattagtgctaatggaggcatcatggaggaggtagggtttgcgatcggattttaaaggggaatagagatctcacttaaagatcaacaggacaagggcaatctaggctgggagaaagcaaaagcagagacgtaggacaattcatggtgagttctgggtcttcccagcacaagaaaagaaggctgggacagtattgtgggagtctccaaatgctcttctgggagcatagacttgggttccacagtgaggagctatggcaggtgtggattttttgttgtttgtttttgatgggaaatgagctgggaagcaagctgggaagtatctgatgccagctttcccaaggtaggccttccccatcagaatggagcactgtggggagggagtccttgttgctgctctcacgaagagccagagcccaggtggcttatgtggcttgctgcagagggcacccagctaaggggctgaaatccaactcatgccccacttgcccagccacacaacctgttagggttatgtctgcctggagggagggatgccttttctctaatttgcatgggctgacagaggccctgcaactgagctctttatttgaaaaggctgaagctacggtgaaacaagtgaggatttattgggcatttgctgtatgtgcaaacataaggtaaagcagaaagagtcttgaggtcaggactatctgtgagtctgagcatgtctctgctctgtggtgacaccctgagacttactgtagggtacagaggaggaagcttagtgcctctcctcaaagattttgcaatccatgtcagttataaaacaaacgctccactggttaagaaacagtgaacgacagtatggaatcaagtgccaaattgcacagggcagattctcagggcttgagaaaggagacctcctctgggctgaaagagtcaaggcaggcttcatggaggaggagggctgggtttggcagtggagcatgtgtatgttggttctcagccagagaaaagacctgcgaacaaaaagccagaggaaacgaagctgggggcttctaagcatggatttttagccgccacagccaccctaatgccattcccaattgtagcccaagcgctgtgatgagtcacccttgtttctgagagacggggcatttttggatgtttaactggttcaacactttacattccctgagacttcaatgttggcagctcacactcaccatgttgctctgggaacacatcatccaagccagcagctgatgcctgatctccactgccaaggcaaagcgagggctgagtcaggtacctgtgtctggaaatttttagtcccactgtctctgacaagctgagcgaacagcacttgacagttggagcacagctgagttcagggtcaccaaccgcaaggtgggccgggggggttctgctcgccttcttaggcctcacttttcccatgtacagaacacaaaggattataccagattatctccaagctgtcttccacctaatattttatgatctcataattaatggaatctttccatgttatcaagcaatgacaggatgggaacagatactagccaagtccgaaccttaactttcctcttggttttgactgtgaaggctgtggtggagtgagactgtgggttggaaacaggagaaccaggagctcctggtcacagttttgccatgaatgggatttgggatccagccctgggaatgtaggcaggagattccctcattttagttttcttagaaaataaggaggctggaaatggtccctacaaccctttctggcactgatactctgttaagtactagcaactgaacaacttttaagtaccgcccccttgcctgggtggggccctccacaaggcaagctgggaaaattctcacaatatcaactgataagcttgaaggaaagcacaaaggagaagccatggggttcagaataataaatagataatttagaattagatggagtcaaaagagctaatctgagtctctaagctccaatttcctcttctgcaaagtggggatagtaatacatgcatctcaaggtaatgattaaatgaagaagcttatttgaaagtgttttagaagtgctatgcaaaaatgtaaaatacagttattgaagatagtctgttcccttaaggtagtctattttttaaagcctagttattatactacttgctaatgtgtctgcttcctaagaaacagcaattcaggtcagcaactctttatacaccacattaaaatatagtaatattttaacatgaaagatgctggtggacttcaggactaccagagtgcacatctgccccctgcctggaattctacagtgtcactggagttgcccacagtggatttcccaggaactttgattgtgtttacttgacagtgaaggagacacctacccatccaagatcctgctttgatgcttgcctatccggagacagatggtggaaagaggggaaggaggcgtgagtgagtagggagaaaaaaggaggctttcttctttctgttatattttgggcaaaggatgttaaactttatgctttaatgagcttgtaaaaaggctaatttgggttcactacattactccaggtctgttttctgctatgtctggtcaagagacaccgccgtggaactcttcactgttgtccctggaggggaagcttttcacaggaaacgctgggaagagccacagaggggaaaaggttctaactccctaaatgaccatttgcttcaaagcctgcccagcccgcaaaacttttgaaaagatcagtctagttttagaaatcctggtcacttctttatctcctgttaaccaatttggggggacaaaatgtcacaacatgttagcaattgagggagccccaagtgccagcacttctctcatctgttcttctcatttgctgctgccagagtaacttctgagagtttagaccccaaagccccctctctttgttcaaaagccttcaaagcctcagatccctcatccttaaaagggacataataatacttaggcataggcttttatggaagatagaagaaatatttatgaacagtctacaataggattggtcacatagtaggttctggatgaatggaattattgttattactgccttaaatagagagaaatagagagtccctaaaatggcattcagggccctccacgaagtggtcccaggtcactcatccacttgcacgtccggtaagcttttcgaggacatggtgtgcacgctgcccggctttgtcttcccaacacaccttgcacctgcccctccctgtcctgctcaggctactcccacggctgggagaactgccttttttctctctcttgctccttctatagtgccttttaaatccactcagctgaagttaattattctctctcccgtacttccattgaaacttgtttataatttattccagtacttacaacagactgccttgtattatgattacttgtatatgcttcatacccgttgtccatccccaatccatggaacagcaatttatcctccttagactacatcttaattgtttttctatcacccacagagtattgcacatagtaggcgatcaatcatatgaaactgaatataaagaagacaactacatgtccctgttgtctctgagattctacaattacaggaaggcttattctcattttcaaatcttgctaaagagcttcctctcactgagcacctatcatgagccaggcactatgcagacttggaggttaaccctcccaaaagccctgtgaggagagaatcgtcatcctcactttacacagaggcggatggctgggatctcccagcctgtacgtggtggaggcagcattagaaaccagaagccacagtgtgctgtgagcttcctctaagagagcttctctcacagtgaacttgccttaattttcattctacagcacttgtcaaccaactgaactgtattctataaaactggcttattgttgcttggctatatattttttgtctttgtcttgattctccaagtatattttaatatagttgtagggaaacatgataatagaaataaataaacatgtattaagcatttataatgtttttagcactttatacacacacatcctatgaagacgttattaaccccatcccatggggagtttcactggggtagctgctgctagcaggaagttactacctgggagagcagtactcacggaagagactatttttccaccctacaaaaatttttctttcaaccaccagcatgccagctgcatctcagctcagccctcaatgtttgctgaatgagtgatgggatctcttttatctctcacctatgctgtttaccctgaatccctgactctatacatagcctgtggagtgacaggtccttacttgccctctcctcccactggagaaggaatcgggagaatgagagaggaggcatggttctgtaccaaacagacagaggcagtctcaggagatgagccttcagcccacgtagaagtgatgtggcatctcttctgggctagcagttctctagacgtggtcctctcatcagttgggtcagactttcccaagtgcttgttaaaatgcatattcctgggctctaccctgacccaccgaatgtgcctccctagagggagagactagaaatctacattttgaacaaggcctgcaggtgattcctccaggccctggagtctgagcaggacagcctggtctaagcatctcctcagcagctgctgcaaagacaacgtgcattttttctcaggtatcagcattcatataaataaaaaagaaaccatttaaaatttcattttattgcttccaaggattgcccgttgtccaaaggttacagggtagtttgacacattccatatgtctattttatgatgtgtaaaagaaaagagtggttccatagcatagctttagtgcttcctattattttcctttgcaaatctctcgagttggagctgtgttgtcagttactcttctgaacacagttctatgagaaagtgtattctgaatttcaaacaacaatttcataaatagattttcagaatacagcatgttcctacgtagggaactgcctgtattttaaagtttttgtggttatttgttcctgagaaaaagatttttacaattggccctagaaggatgtagactgggggggctctgaacttttccaaatcaccgtctcacagatctctggctagcgtcatcgcttactttattccgtaaataatttctaggtgtttctgggaggtttgccaattggggatatataaattagaggtatagaaagtactcttttttcccctctcatttgtgaatttgttcattaacaaatgcttcttgggcacttccagggagtagatgctgtgctagacacgagattcagacaggggtgttgctttctgtctctgagaggttcatggtggagcaaaaattatagaccacacaggggagaagttggtggtaagaagatgcagtgggattaaaggcctaaagaagagagagttgaacagtctgtggagggagaataaaagaggagtctcaaacatctaccaggaattctgttgattaattgtttgagatgggggtctggctctgtctgccaggctggagtgcagtggtgtgatcatagttcactgcagccttgactgcctccagcatcagccttccgagtggctgggaccacaggtgtgcaccaccatgcctggttattatttttgtttgtttatttttatttttgtagagatgaggtctcgttgtgttgcccaggctggtcttgaactctcgggctcaagtgatcctcccgccttggcctttcaaagtgctgagattacaggcatgaactatcgcacctggctttgctttgtataatgagagaaaacaatgtggactgtaacctctactactttgaatgttcccaacctctgctgggctagggattgcacaagtggagttccctcaatatttgtggcagtagcaaaaattcctttccctgtgttagggtgtagaggcaggggaaatagactagggtgatgtttcaagtgggtgatgggcagaggatgctaactgaaaagtagcagacagagacgaccctgatttctatagacttgtaggaggtaggaactctatttcttcagagactctaaacctacttccttgccacttcctccttttggtcctggttttgtccactgatatccagaagaataaatcctattcttaaaaaatttttttagagacagggtctcattctgtcacccaggctggagtgcaatggtatgatcatagctcactggaacctcaactcctgggctctagcaatcctcccacctcagcctcctgagcagctgagactagagacgtgtgacaccacgcctggctgattagaaaaacaaacaaacaatttttctttttgtagagatggagtctcattatgatgccaaggctggtcccgaactcctggcctcaagtgtcaactcttttttttgcagggggtctttgcagatgtgtgatggcagcttccgtgcttcccccgccctcccctcccactgaacattcactcattcattccaacatccagtcaataaacatttatttatttacatgcctgcttttccaggaactgcgtcaggtgtgggagaatggaaatgaaaacggggccctgtgtttatatgggaggactggcatgtggacacatggtgacaccatggcctcacaagtgatctacaagagaggagcacaaggggtccaaaaaggtgggtagggggacttctcagggacagatgatggtgccccatctgtgtcctgaagtctattcaaggccttccatctgcccttgtgtgacatggcggcacccactgacaaccgcaggcagtggaggtcccaggggcctaccaagtagtgggctggaggcagaggtgctcatctcttcccaattctgcatccagtgacatctggtgctagtttcaagccagccatggtgggagtatttaagccatagcaatctgcaaatgctataaatcaggactctctttctcccacccccatcatacctgattgtcaaatatttactagtacagcatagatcctaccataccattctaccccaatgccctgtagaaactaacatagggatgagaaagagatgcaacctaccttctggttctaacatgaatggtctgcctgctgttcctacccctacctccaccaaggttatggttgaacattccctggggactctcagagtgactcctttccttcactgcatacctcaatagaagccctaatgagtttctgggagtgatggtttgtggcaccatgttgagaatcacagtaagcttgtttcagatggtgggttttcctaaggctgatgcaggtacagaaactagagactactggccacatggctcttttcaaatgtttcccacagaaatatcactgtcagtggaggataaacttgtgtcttcctcctcaggtcttgaggcaaaacttgaagcacatccctgcatgctttagttttgtttgtttgtttgtttgttttttactggcatcatgtttgttcattacaatttatagaaatgtgggctgcaactccatgatcttttcatgattgcttaatatagaaataaacagtagacaaaaaaagaaaaaga

(The sequence listing continues in the following parts.)

What is claimed is:

1. A method for reducing risk of coronary heart disease (CHD) in a human, the method comprising:
    a) receiving an identification of a human as being responsive to pravastatin treatment for reducing their CHD risk due to having a polymorphism rs13279522 in gene DNAJC5B comprising C at position 101 of SEQ ID NO:1284 or G at its complement; and
    b) administering pravastatin to said human.

2. The method of claim 1, wherein said human is homozygous for said C or said G.

3. The method of claim 1, wherein said human is heterozygous for said C or said G.

4. The method of claim 1, wherein said CHD is myocardial infarction.

* * * * *